United States Patent 10,233,495 (METHODS AND COMPOSITIONS FOR SCREENING AND TREATING DEVELOPMENTAL DISORDERS) - sequence listing, part 43

SEQ ID NO: 499 - DNA, 1470197 bp, Homo sapiens
aggtaaggaggcataaactcattaggacaaaaagaatggcttttctttttcaagatgctttatttttaaaacaggtcacaacacagcgttcggctcattctgccacgaacaagctacaaacgcttgctctgcagccgagaggccctccagtggccatgttcaaaaacagaatgaaaatccgtatgtaggccaggcgcggtggctcacgttggtaatcccagcactgtgggaggccgaggcgggcggatcacctgaggtcaggagttcgagaccagcctggccaatatggcaaaactccatctctactaaaaatacaaaaattagctgggcgtggtggcgtgaccaaacggcatgggaggccatgatcacaggctgctgggaatggatccaagagaggatgaagtggctcaggaggtacagacaagcgccgggcagccgggcagccaaggagagcagagaaatgggcggttgccagtacaggacacgaggtccagggagttctcacagaaggatcacgggagaagtcacagcgtgtccgcaggaaaggaggagagaagggacaggccagtccgagtctgcagcagggcctgacaacagacagcacgtgagggacagcgacaccggggcctgatgcagatggcagggagatgcgaagcgggactcaaccacctgctggtgtgaagaagggagggacagacaccacaagggaggccccaggagtggctggcaccttcagggcccccagcgtgcaggggcatctcacaactaaacacaaccagcgccccagacgccatcccgactggggaaaaagttgtagtgggcactattgagacagcaggcaaaatgtgaataacagtcttgcaccaatgttaaatgtcctgattttcatcgttgtggatattaaaaagtcaacacgggggccgggcacagtggctcaagcctgtaatgccagcactttcagaggccgaggcgggaggatcacctgaggtaagatcgagaccagcctggccaacatggcgaaacactgtctctactaaaaatacaaaaattagccgggcgtggtgggatgcgtttgtaatcccagctactcgggaggctgaggcaggagaatcgcttgaatccaggaggcggaggttgcagtcagccgggatcacgccattgcactccagactgggtgacaagagcgagactccgtctcaaaaaaagtaaacactgggccgggtgtggtggctcaggcctgtaatcccagcactttgggaggctgagacaggcggatcacaaggtcaggagttcaaaatcagcctggccaacatggtgaaaccctgtctctattaaatacaaaaattagctgggtgtggtggctcaatggtaatcccagcactttgggaggctgaggtaggcaggatcacttgaggtcaagagtttgagaccagcctggccaacatggtgaaacctggtctctactaaaaatacaaaaattagccgggcatggtgggccatgcctgtagtcctagctactcaagaggctgaggcagaattgcctgaacctgggaggcagaggttgcagtgagctaagatgacaccactacacttcagcctgggcaacagagcgagacgccgtctcaaaaaaaaaacacggaagtatttaagtataaagaagcatggtgtctgcagcttactatcaaatggatcccaaagatacctggagagaaactgggaccggcagggagaatggagcaaacccggacaggcctacaaagagctctttgtactgttcttgcaatttttctgtaagtttgaaattacaccaaaatttaaaattaccaacagtaaatagagccatctaaacccagaatgtggggcattctctagacaaccggcctgatctcttcaaagcctcaatgccatagttaataactgtgggggggattcttgtagctcaaagagcttgaaaactgtcatcaaatgcagtgcataatccatggctgggtgctggactgtggaaaaaaacagctatgaaagtcatttttagaacattttggctgggtgtggtggttcatgcctgtaatcccagcactttgggaggccagcctgggcaacatagcaagaccctattgctacaaaaattaaaaaactagtcaggcatggtggctcatgcttgtaatcccagcactttggaaggctgaggcaggaggatcacttgagcccagaagtatgagaccagcctgtgaaacatggcaaaaccccatccctacaaaaataaaattagctggtcatgatggcacacacctgaagtcctagctacttaggaggctgaggcaagaggattgcttgagcccaggaggcagaggctgcagtgagccataatcatgttactgcactccagcctgggagacagcaagaccctgtctcaaaaaaataaaacaaaacaaaataaacattaaaataaaaaaattaggcaggtatagtggcaataaaagaacattttgggcaaatctgaatagtctgtgcattagaggatatgaaaaagacttattatcttggggaggcatgatcatggcactgggattctgtggaaggcctgtcttggagatttatgtagaaatatttagagatgaaggttcgtgtctataattgtctttgaaattgtgcgtgtgtacaaagtaaatacggtaaatgttcattgctgagactgaagcatgggtgtacaggtgttcactgtaattcctatgttcactagaaaacgaacagaagtgaatcactgatggctgacgccgccctgccctcaccccatacttatctatcccctgcctcccgatgtccccacctgacgcccccagaatgccgagatcctgcttctctgagtcttccctctcagtaaacagccccatccacccagccaccgaggccaaaccctgacgcctttttcccatcacaacccccaactggtaccgccacaaacacaagaagccttgtgcctttcctcctccccagcgccgccccctggcagccatcgcccggcaagccacatcttccagctactgcagactcctggtttccactctcaccccagcccagctcctactccctagcatccagtgtcccccagcagcagggtgatatgggtcatgtcactcactgcccaaagactgccgaggcccccaaccctcaggactagcggtccaccaggccccagcctgccccggtgccctgcccagcaacactggctggcaggcaggcactcctcagactctgcagccggcaggtcctggctgccagctccctgtcatcattgggccttggttgggcgcctccctcgaccacccaacatcacccaatccaaagcagcccccgagtccggctggctcgcagcagcaccttccacccgcaaggccctgctcccactgtcttcacgtttactcgtcccctgcctccctccatgccagacatgcctctatcttgcgcagggtaccccagcaccttcagcagtgcctggtcacactggaaaagacctgctgagtgaaatgtgtaccaaaataatgtagagaaatcacttaaaactctcatgtattacgtcttcaaggacaaaaatatgcatccaagtaaaagggggcagtcactaaagaaacaattaagaacccatgtgtttcggctttttatgttctaattccccgaaaaaattgtgaactgacttgacctcagcctgtttcttggtgggtctaataatgtgacccagaagtaatcagattcaatgtaattacatttaagaaatattcagcaaacataatgtatgtaaagtatcatatccataaacatttggtctacttaatctttgactatacatacaattaacattttttaatttcaaaaattataaatgccttcgtcttgagtaaatcagatcaataatgatttactaatagatacacaaagccaaaacattaaagcattttttaaaacacaaaagctttattttatcaaaacaaatcaacagtctacctctaacaataatcttcaagagtaactgcattgtaaataaccataaacgatccgatcagaatacattcaacatagcatcgctatagaatgcaattaaatgtataatgtaaataaacaacttaaattatgcaactcgcaagatgtaaatgtcatgtggacacagaaaagggacagagacaagacaaactattgcctggcgctgaagagacgagccctcactcaacacagcccagctgcggggacctctctctagccccaccatgacgtagacacaggagcccttcttttgagatggagtctcgctctgtcacccaggctgcagtgcagtggtgctatcttggctcattgcaacctccgcctcccgggttcaacaattctcctgcttcaacctcctgagtagctgggactacaggcgccaccacgcctggctaatttttgtatttttaatagagacgggggtctcatcatgttggccaagctggtctcgaactcctggcctcaaatgatccacccgcctcggcctcccaagtgctgggatcacaggcatgagtcactgcgccaggcctgggagcccttcttggaagaggtccttgtttgttgcagcaaccttagtttgttctctagtcagactcctgcctgggtcaacagcagcaattccccaacagcttggaccaggtacaaagtcaggaccctgtggatctatttcactaaggtctgctcactcctagagggccaaagagccactgaccctggccactgcaacgctgaggccgggacctggaactcgggtcccccaaaggcagggcccaggaccctggaactcgggtcccctgaaggcagggcccagaaccctggaactggggtccccccaaggcagggcccagaaccagccctgtgactgacaccttcttccttttaggccactgaggggctgactgaactcctgcattcaaatcacacgtctagttccagccaaccacgatggcttgctgcaggccactgccacgaccacacagacaggatcacggcaggctggctgtcctgagggactgcatatgctggcgctaacacgccggctcctccctagtcacccagtccacagaagtatattcacccggtccacagaagtatattcacccggtccacagaagtacagtcacccggtccacagaagtatattcacctggttgacagaagcatagtcacctggtccgcagaagtatattcacccattccacagaagcacggtcacccggtccgcagaagtatattcaccgagtccacaaaggtatagtcaaccagtccacaaaagtatgttcacccagtccatggaagtatagtcacccagtctgcagaagtacattcacccagtcagcagaagtatattcacccagtccgcagaagtatagtcacctagtccgcagaagcatggtcacccggtcggctgaagtacattcacccagtccgcagaagtatagtcacccggtccacagaagcatagtcacccggtccacagaagtacagtcacccggtccgcagaagcacagtcaccggtccacagaagcatagtcacccggtccacagaagtacagtcacccggtccacagtatagtcacccagtccacaaaagtatagtcacccagtccacagaagtatagtcacccagtccacagaagtatatgcacccagtccacagaagtatatgcacccagtccacagaagtatatttcttattaacctgctgggcatatttgaagtccagatcagactatttgacacttatctgcatttttgtttctctttcttttttggggtgggtgggggtggggcagggtcttgccctgttgcccaggctggagtgcagtggtatgatctcagctcactgcagcctcgacctccctggctcaattgatcctccctcccagcccccgccccgagcagctgggactacaggcatacgccaccacaccaggttaatttttgtattttttagtagagatggggtcttgccatgttgcccaggctggtctcaaactcctgggctcaagagatcctcccacttcagcctcccaaagtgctgggattacagacgtgaaccactgtggctggccggtttttgtttttctattcttgcttttatccctttcacaagtttttctgagggcaaatatcatgtcctacacacccgtcagccccagtgcaatataccgtacacagcaggtgcccaatttgctatctgacaattgcctcttcacagttatttacacactgagtgtaacacatgtaggctgtgactattactttaataaatgacaagttatatcattaaagagcagagctttgctcatactggacttagtatttgatgttagattccaggaaacaaaggatagtttgagttatccttaggaaaaaggagggacattgttaagtaaaatttgtaaaattctgaaaatctacctggcctaccactaacctttttaagagaatctccatgtctttcctggatgtatttcaggaatgctgtggtccactgcagagttgtggccttgtcagtctcggcattgcagaacggcactaagagattcaactcatcacagcaaatgcggattctgcgcctatagtcaaaacccaaagtcatcaccgagagagaccggagcaaaacaaacatgtaaaaggaagcgtctcctgtagtacttgagggaaccagagctcgtgcatcctggccactgagtgccacggaagcgcctgtcaccacaggaagccccacggctttgccacggccttgtctacagaggcagccactgccttccagaggccagagcatcctcgggtgcccttggcggccccatgacccacaagctccctggagctttccctctttacttctcacgggccaggttcaagtctctagattagggatggctccaaagcccctgaaactggaagcaacattttgtgtctgacaccttcttccatttggaccactgaggggtccaaattgggcagataactctgtcattcaagactgatattacttgcccttcacgggctaaataccctaccaggaactcgtgcacagctttctccaaggggccctgattcagaaaggatcacggcccaacactctgttaatattctgaaacttggtctttgtagagataaacaattggagtcttgttattagactattttttaaacttttacatattacattcagtaacatgcaaagtcctaaacaagcagatactgagcaacttattcaatatggcccttgttactcaccttcacacccgtctatttagaactttaattagagactttgccagtaaaacagcagctggcatttactaggtgcttttggacttctagacattgagcgaaacactctttacacatcagctcactgaactctaaccacaagtctacgcagtagagctagaagtccaactttcaaactgtcaacgtacggtgtaaggctttccacatagcaggtactcaataaatgtctattaaataaatgtcggagcaaaatgcccttcataattcacagtagggtgaggaaggccctcagttagtccatgtgtataaaagtatcataaaaagatattagctagctttttaattttctttctttgggggatgggtctcactttgtggcccaggctggagtgcagtggcatgatcacagctgactacagcgctgacctcccaggctcaagtgatcctcccacacctcagcctcccaagtagctggggcgacaggtgtgcaacaccaccactactagtattgttggtttttctttagagacggggacttgctatgttgcccaggctggtttcaaactcctgggctcaagcaatcctcccacctcggcccacagtcatgagccactgcaccctgccccagcaagtttgaatagatccctttaaaagaaattgccatgccaggcgcagtggctcaagcctgtaatcccagtactttgggaggccgaggcacgtggatcacctgaggtgaggagttcgagaccagcctgaccaacatggagaaacccctcctgtactaaaaatacaaaattagctgggcgtggtgacgcatgcctgtaatcccagctactcaggaggctgaggcaggagaatcgcttgaacctgggaggcgaaggttgcgttgaaccgagatcgtgccattgcactccagcctgggcaacaagagtaaatctccatctcaccaaataaaaaaataaataaataaataaattgccttagctcaacattcaaccttggagcttcaaacctgagtatttgtctcactcactgttatttatttcctgaacttaaagcagaaactggtacacagtaccagtactcgatacattatgtagttaattaattatagattagggaaatattctatgaaaacccaattataggccgggtgtggtggctcatgcctgtaatcccagcactttaggaggccgaggcaggcggatcacaaggtcaggagttcgagaccaacctggccaatatggtgaaacctcatctctactaaaaggtacaagaattagctgggcgtagtggcgggtacctgtaatcccagctactggggaggctgaggcagaagactcgcttgaacctgggaggcggaggttgcagtgagccgagatcatgccactgcactattccagcctgggtgacaaagcaagactccgtctcaaaaaaaaaaaaaaaaaagaaaaagaaaagaaaacccaattataatagaaaaaaattaaccactcttaattctacaaagaaggataccacaaataaaatctacagacaaaaccacttaaataacaattttaacctcttccttcccagcaatcttaaaagaaccaggcaatagccaggagcggtggctcacacctgtaatcccagcactttgggaggccgaggcgggcagatcacgaggtcaggagatcaagaccatcctggctaacatgctgaaaccccgtctctactaaaaaatacaaaaaaattagccaggtgtggtggcaggcgcctgtagtcccagctactcaggaggctgaggcaggagaacggcatgaacccgggaggcggagcttccagtgagcagagatcgcgccactgcactccagcctgggcgacagagcaagactccgtctcaaaaaaaaaaaaaaaaaaaaagaaccaggcaaaacttgctgaactcaagctggctggtaagcagcagttaccaaaacagcctgaccactctcctcagaaaggcctgcagtcagggctggcccttagtggagtctgcaaacctagattcagggagttaagagtgcccccagaacctacactgtgcaaacgatatggctgacactgaacaactgctttccttctgggagactggactgtggttgcatgcatgggggcagtgcctacgtgacacgcccctggtctctagcgagctttcctggttggcaacacctcacccacgttttcagaccacatggctgggggcatgaggggcaacctgcctgactccacagggcgcgctcttagaagcttgcacctcagctcctgccttctccccacgcgcctttgctgatcgcacctggcatcctttctccatagtaagtcacagcctgagagtgactgcatgcggagtcccgggagtcctcctagtgagccagcgagcctgggcatagtctgggggatccttgatccatctgggaaagctaacgatgctcctacctgctttattccctctgaacgcagaaacggctaaggatcactcatctgtgataaccatgtatgactaaggtaatcatatatgagtcagcctgacaagcagtcacacgtattaccttctatctctttccattcggttatgcctctccctacgttgagaccttcctccctggggcccactctgggcctgctcccccaggtttgcctgtgaggactccgaggactgccaagcgccttgtgtggcggtggcaccttcgcccacattctgaatctctccaagggctcttcgctctacatttgtgtccaactgacgcattctactccgattcctcttcagtgcttgtttgcatagcgctgcttctttgcgaaagaagaaaaaagtggtttttaattttgtattcttatctcaattaatgctgaatacagttttggccttttcaatccaagatataaacattattgggtaagcagcacagagaaccgaaacacaaagagatgtactaatgcagtttttcagcatcagcagggaccatgaagcccaagcctattttatacaacgaaactgaacaagaatcaatcatcacactaaatacgttttccaagtgctatgcaaccaatatgacctcatccaaagcccctctttttaattaacaggtgttatctatgaatacagaaaacaagaagttgtttactttttctaaaggtcagaatggaaaaaaaaaaacaacaacaacaaaccacctggacatatttcctcccaaaaatattttctttatatacaattattctaagaacaagaaaaaaaaacaattattctaatatgacagtatttttactgcaatgctcagaacaaaactgcagcagcgtgtgtgtgtgccctcgccgcagaagtggctctcctccccaaagcaggaagaagtagcgtccgagcttttctgctgcgtgacaggctatgccacgtgtgcgtcagtggaactgtatccatcaaaggaccacaggcacgtgactggcaggcgtgctcatgtgcacgcgtatgccacacaaagcacccatttcagaaggatgatgaagctttcagcaggagagagaggaattcggtcgttttggtgatattttattccttaacctgagtagtcggcacagaggctgctttaatactcatctttgtatcttacaaatgtgaacatatactttggcataaaattttatagggaggaaaaggaaggactgacatgggagaaggcggtagctcttcctccccatcttgtcttcaccaactcttggaaagctaagtgtaaggagtgttcttttttcgggtcacttcacaaatcagtttcccagggaggaaggggctacgcaggtgtttcccagggaggaaggggctatgcaggtgtttcccagggaggaaggggctacgcaggtgtttcccagggaggaaggggctacgcaggtgtttcccagggaggaaggggctacgcaggtgtttcccagggaggaaggggctacgcaggtgtttcccagggaggaaggggctacgcaggtgtttcccagggaggaaggggctacgcaggtgtttcccagggaggaagggactatgcaggttagcgcagcagtgccttcagcagtgactttatttccaaactttccgaatcaccttacagcctctccctggcagccctaatagggtcctcctattagcagccacctatccaaaggctttcggcagatgttagatgactgcctcactcatcgagtataacataaggaaaataaaaaactataaagtactttcagtaacttgaaaataactgaaaatttatgtaagtctatcactttactgttaagaaaaagccctcaaacgcaacgttctcacaccaagattaattatgtttgagaatcagaataatgtttaaagcgaaaagacagggaagcgggtggacagacccctgagatacacagacacctccaagactgtttcacatgtgtacaaaccatctgtctcccctgccccccaaggccaaaatgccatcagccacagggctcagtcagaagaaagctcccactacctgctgcttcatcgcttacctcccactttaatccaaacttgctcaggcaaaactttgtttctactacctaacgtctgtttagtggattcaatttcttgctgataacagaaagaaaatgctctaggcaatccaatatcctggtgcttggcagcttcaagtacagaacatgagttactagaactctggaaaaaaatgaagcaacaggaattttatcaatatgtggcttactctcctctttactgcacaaatgaaatgcacttaacaaacatcaaaactactaacacgtaatttgaagaactttagttgcactgaagatttaaaaatattcgcataccacataaacactcaactttcacaggtatttttttgtttttgtttttttgtttttttttttgagacaggctctcactctgtcgcccagactggagtgcagggtcgcgatgtcagcccaccacaacctccacctcccaggctcaagcgattctcccgcctcagcctcctgagcagctgggattacaggtgtccgccactaccacctggttaattttcgtacggggtttcaccatgttggccaggctagtcttgaactcctgaactcaaatgacccacccacctcggcctcccaaagtgctgggattacaggtgtcggccttggcgcccggcttaaaaggttattaagctcactgaagggaaaaaaaagtacttgggacctaaccaaaataagttaaaatttacccatttaatacaaaagagcaaagcttcacaaatcatgttccctacctgtgtctgtgaaagattagaatttccactagtagagcaagcatttgtagtaaacagtgggtatgtaaattgcaaagcagtagttgtagccgcagttttatttttcactaatgctgtacatttgttttgttgctgaagaggaacattcattagttcagatggatgtcgaatgagagttaccaaactgccaagacaaaagaaagcccagaagtgtcagcaatacgtggcagacaagcatccaccatcccactcccatggctctggctagtttttccagacagcaacccaactctcatcctggaaatctctacacaacaattagcaactatcgctgctgtggaagtcctcctcttcctatggaggaaaagcaaaactgcgccacctccctgctctcatcacatcctgacaccaatctcacttttgccatcctccagtgtgaccacgatgggcaactacaggctgggatgagcagaaaactgcggacgcagccccttccacagccatccctgagggtcgccaagggggcggctgcaggctggagcctcattttagagctcaaagcctgcaaacccccgtcgggccttcctaggcttccctgacatccaagagtgccacccggagcacatggttcccaggaattctgcgcgctcggccccactccaggcggggccactgagggagggggtgtttagtttctggaagtacctgctccccggggcccgcacagcgcacacagcctttcggggcggccccagacccggtgaggtccgcgccctgtgccgccgggagggcaggctgggggcgtgcacagcgagggccccctttgcctccgccccggccccggccccggcctcggcctccacccgggccccgccagcccccggccgccgggcacgcacttgttgagcgccccgcccggctcggggggctcggggccgcgcggcgcgggcggcggctcggcggggatgctgttgaagcggtcctccaggcggacgcgcacggccggcttggcccgggcctcgggcgcgccgtcgggtccagccgcagccgcagccgcgcccgcgccctccttggcggcgccgtcggcccgggccctcgctccgtccccgccgcccgacgtcttctccgccgcgcccgcctcgcttagcagcatcatgcgcagctcctggaagtcgatgtggcccaggcagggcgcgtcggccgccagcgcggacgggcacagcacggggtacacgggcgccgcgcccccctgaccgcccgccgcgaagccgcccgcgcctgcgcccgggcccgccgccgccagcagcgccgagttgaggcgcgtctcgagctcgccgtcagccgccgcctccatgtgcgagcagaggatgtgctgcagctgcgtgtactccacctccgtcatctccaccaggctcaggtcggtggtcgtgaagctcagccccggctcgcccagcgccgcgtccccgccgcccgcgccctcgacggccgcctcgccgcctgccgcgcctgcctccggcggcggctcccgcggtccggggcccgacatggcggcgcggcgcggcccaacggcggcgagggcgacgcgggcggcgggcggcgggaggcgggaggcgggaggcgggaggcgacccccggcccgagcactactctgcgccggccacagccggcgcgccgttgggggagggaaaaccgctgagtgccgcgcacagcgcctgcgccgccccgccccgcaacggcaaccccacccctgcgccagccccgccccctccgttacccgccgccgccggccccgcccccgcccaaccgcccgcacgcccggccccgccccacgtcggcggatgcttgcgcggagggcccgcccccacggcccagccacgcccccacagctaggccacgcccccagctcaggccacgcccggttcccagccacgcccctgctgcccggccactccccgctgaggcccggcgagggcggctgcgctggaatcagcgtgatacctacgcggtgacaccctggggagaagccacgtccgtgcgtgcacgtgcgccccattacagcggcaggaatgaagacgttgtcaaaacagctccctggacccacagtccacagtgcccaggccatccgcttcatccgcgtaaaatgcgcagcgcatggccgggttctgtggctcatgcctgtaatcccagtactttgggaggccgaggcaggtggatcaggaggtcaggagatcgagaccagcctggccaacatggtgaaaccccgtctctactaaaaatacaaaaattagctggacgtggtagtgcgtgcctgtaatcccagctactcgggaggctgaggcaggagaatcgcttgaacccgggaggcggaggttgcagtgagtcgagatcttgccactgcactccagcctgggcaacagagccagacttcatctcaaaaaaaaaaaaaaaatgcacagcgcgacggtggtggtacattcccagcgctgggcccgcctccaccgctgcattcaccaccggtctcctgtagcagtcagcacactgcccctcccccgcctgcagccactaatcttctgtgtccaggagtttgcctaggctgggccttccctgttaagggaactatgcaatatgtggtctttaagagacttatttttgcaatcttgaaataattcctgtacttaacctctcacccacattcccatctcactcagtggttgtctgttctctgtctaggcattaggacacttaaaggcctgtgacttgcacatcgtcttctaagccgggtctgaatctttcgctcatttcatcacagtttagacacagaccaatatattacaatgattcaacgatgggctatgaaagctcagccatgcaaatctaaactcacacatgtatacatgaaaataatatatcagttttgggcaaaacatcaggtttcagaaaacactaccaaggaggaaagcaaggacttaaaactctcaaggacatggcaacagaagtcgtctaacgtaaaacagagagggaaggctaagagagtgagcagagcatcagtgagctgtggggccgcttcaagcagtgtgatttgaagtcccctgggggtggaaggatggggagaaagacattttaagaagtaatgattgccaggtgaggtggctcacgcctgtaatcccagcactttgggaggccgaggcgggcagatcccttgaggtcaggagttcgagatcagcttggccaacatgatgaaatctcgtgtctactaaaaatataaaaaattagccaggtgtggtggcatgtgcctgtaatcccagctactcaggaagctgaggcagaagaatcgctggaacccgggaggtggaggtttcagtgagtagagattgcaccactgcactccagcctgggagacagagcaagacgctgtctcaaaaaacaaaaacaaaacaacaaaaaaaaataatgattgaaaagtttttttaaaactacaaacctacagacccaagaagtttaacatacctcaaactcaagaaacatgaaggaaactacaccaagatggaaagcaaattgctttatttatttatttttttattttttgagatggagtcttgctctgtctcccaggctggagtgcaatggcacgatcttgactcagcacaacctctgcctcctggattcaagtgattctcctgcctcagcctcctgaatagctgggattataggcatgtgccaccatgcctggccaattttttgtatttttagtagagacgggattttgccatgttggtcaggctggtcttgaactcctgacttcaggtgatctgcccaccttggtctcccgaatgctgggattacaggcataagccaccgtgcctggcctcaaattgctttaaatcagtgaaaaatcttaaaagcagctgtacacacacacacacacacacacaagacattgtgtacagaggaacaaagataagaatgattacaggccaggcgcggtggctcacgcctgtaatcccagcactttgggaggctgaggcgggcggatcacaaggtcaggagatcgagtccatcctggtaaacatggtgaaatcccatctctactaaaaataaaaaaaaatagctgggtgtggtggcacaggcctgtaatcccaggtaactcaggaggctgaggcacgagaaccgcttgaacctgggaggtggaggttgcagtgagccaagatcacgccactgccctccagcctagtgacagagcgagagactccttctaaaaaaataaatgaaaagattgcagtgattgcagacatttcttcaggaataatgcaagtcagaacagagtggaatcacacctttgaagtgctgagggcaagggagaagctgactgatagtgtcaggcgtctgtattcacaggctctgcgtctgtggattcaaccaaggatcaaaaatactcagaaaaaaattacttgcaccgaaatgcacagactgctcttccttgtcattattccttaaacaatatggtataacaagtattcatttagcatgtacatcgcatgaggtattataagtaatctcgatatgtatatattttagaaacagggtctcgctctgtctcccaggctggagtaggataatacggttatagctcactgcagcctcgacctcctgagctcaaccaatcctcctgcatgactctgccgagtagctgggaccacaggcacacaccaccatgccctgctaatttttattttattttattttttgtagagatggtatcttactatgttgcccaggctggtcttgaactcctggcctcaagtgatcctcccacctcagcctaccaaattacagagattacaggtgtgagtcatcacgctcgccgctacagatgatttaaagtgtatggaagaatgtgcataggttatatggaaacactatgacattttgcataagggacttgaacattcgtggattttggtacccatggcaggtactggaaccaatcccccagggatactgaggaataactgtagttctatgcccagcaaagatatttttcaaaaacaaaggcaaaataaagacttttttgcacttacaaaagctaaaataatccatcactagcagacttgcagtacaagacatgttccagaagtccttcagacaaaaggaaggtgagactggatagaagtcggggtctccacagaagaatgaagagactggacgggttaaagctatttattacgagccttaccacaaccactgcaatacagcaacaaagggtgatggctaataaatcaataaaggagagaaaatggaatcagactctcaaaggggcagaaagtgagatatgattgtgccactgcacaccagcctgaatgacagacctcacctctaaagtaaataaataaatgatacaaaaattaaaaatgcaagaggcagaaaaaagaaaaatagaacaaagagcacacgggacaaatagagaataaatagcaagatagtagatttaaatccaataaaaaaaaatcacatgagatgtaaaaggtttaaacacgtcaatgagaaagcagagaccagaatggataaaaagtcagaacttggaggccgggcgcggtggctcacgcctgtaatcccagcactctgggaggccgaggcgggcggatcacaaggtcaggagatcaagaccatcctggctaacacggtgaaaccccgtctctactgaaaaatacaaaaaattagccaggcgtgggggcgggcacctgtagtcccaggtactcgggaggctgaggcaggagaatggcgcgaacctgggaggcggaccttgcagtgagctgaggtcccagctctgcactccagcctgggcgacagagtgagactctgtaagtcagaccttggagtgcccgtaagaaactcattttaaagagaaaggatggaaagtgcgcacctccctagcgctgtcgaaaggcagctggaataggcatataaacactaaagtcaatttccaggaggcgggtctgaagaaaaagaagaaaacaaatactaaagtagatttcagagccaagaattttgccagcgattctggtcatttcatagtgaaatagggggcagaacattttcctgattaaatgcatctaattagaaagcttaaaaatacatggagcagggccgggtgcagtggctcacacctgtgatcccagcactttgggaggccgaggcgagcggatcacttgatgtcaggagttcgagaccagcctggctaacatggcaaaaccccatctttactaaaaatacaaaaattggctgggcatggtggtgtgcgcctgtaatcccagctacttggcaggctgaggcaggagaatcacttgaacttgggaggcagaggttgcagtgaactgatattgtgccactgaactccagcctgggcaacagagcgaaaccctgtctcaaaaaaataataaataaaaaataacaaaacaaaacaaaacaaaccatggagcaggccgggcgcagtggctcacacctataatcccagcactttgggaggccaaggcgggcagatcacaaggtcaggagttggagaccagtctggccaacatagtgaaaccccatctctactaaaaatacaaaaaaattagccgggcgtggtggcgtgaacctgtaatccagcgactcgggaggctgaagcaggggaattgcttgaaccagagaaatggaggttgcagtgagctgagattgtgccactgcactccagcctgggcgacagaggaagactccatctcacaaaaaaaaaaaaaattctgggcacggtggctcacgcctgtaatcccagcactttgggaggctgaggcaggtggatcacctgaggtcaggagtccgagatcagcctgaccaacacggagaaaccccgtctctacctaaaaaaaaaaaaaaaaaaaaaaaaaattagctgggcatggtggcgcatgcctgtaatcctagctactcgggagcctgaggcaagagaatctcttgaacccgggaggcagaggttacagtgagcagagattgtgccattgcactccagcctgggtgacagagtgagactccgtctcaaaagaaagagagagaggagaaagacagaaaatcagaaaggatgcagaagacctggacaatgccatcaaccaacttgctctagttgatgtttatagaacaccccaaccacccacatcagaatacagtcttttcaactggataggtaacatctaccaagataaaccataatttggaccataaaatatgtctcaataaatttaaactttagaaaaatatgtcctcaaccacgactgaatttaatttcaaatctaatgtaaagatatttgagatattgtaaatctccgaacatttggcaactaaataatacatttctaaatgtctcacgggtcaaagaaatcaaaagggaagttataaagtatttagaaatgagcaaaaatgaaaacgacaacatcaaaattcatggaatatagctaaagaaatacttagaaaagtatagcaatcacaaaagaagacaagtatcaaattattaatctcaacttctgcactgttgaaaaggaagagtagaaaaggaagagtaaagtaagcagaactgtgcgtcagtttccattgtatttctaaatacaataaaaaacagaaaaaccgtagagaaaagctcaaatgaaaccaaaggctggccgggcgcggtggttcatgcctgtaatcccagcactttgggaggccgaggagggtggatctcctgatgtcaggagttcgagaccagcttggccaacatggtgaaaaaccccgtctctactaaaaatacaaaaattggccgggcgtggtggtgggcacctgtaatcccagctactcgggaggctgaggcaggagagttgcttgaacctgggaggcagaggttgcagtgagtggagattgcaccattgcactccagcctgggtgacagaacgagactccgtctcaaaagagaaaaaagaaaaaaaactgaaggccggttctctgagagaagcaataagatgtatcaacctctggccagactgagcaggaaaaaagagaaaaacaaatgaccagaatcaggaataggcggtgacagcagtaaagattctaaagatactggatgggtgcagtggctcatgcctatactcccaacactttgggaggccagggtgcacaggccgcttaagcttagaagtttataaccagcctgggcaacatggcaaaaccccatctccacgaaaaacaccaacaattagccgggagtggtggcacatgtctgtgattccagctacttgggaggctggaggtgggaggatcacttgagcctgggaggcagaggctgcagtgagctgtgatcatgccactgcactccagcctgggtgacagtgagaccctgtctcaaaaataaaatgaagaaaaaaagcttctgtagatattgaacgtatattaaggggctattatgaacaactttatggcaataaaatcaacaacttagacaaaatgggcaaattcctcaaaatacataaattacaaaagctcactcaagaataaatagataactttattttctctatatctgttgataaaattgaactggtaattaaggaccttctcataaagaaaatgcctctaacagatgtcttcacgagctaatcctactaaacatttaaggaagaaataataccagttctattggtaatacgaactcttccaagaaactgaacaggaggggatactttctaaagcattctatgaaacaaacataactctgatatcaaaaccagacaaaacagaactacagagcaatatctgacaggagcaaagatgcaaaagttatttttatttttatttattactttaaaaaaaagtttcaagagacagggtcttgctctgtcacccagactagagtgcagtggtgtgaccatggctcactgctgcctcaatctcatgggctcaagcgatcttcccacctcggcctcctcagtagctgggaccacaggcatgccagaatacctggcaatttaaaaaaatttttttgtagagacaagagccttgctatgttgcccaggctggtctcgaattcctgagctcaagcaatccttccacctcagcctcccaaagtgttgggattacagttgtgagccaccatgcccagcccaaaattctttttttttttttttttttttgagacagagtctcactttgtcactgagactgaagtgcagtggcacgatctcggctcactgcaacctctgcctcccgggttcaagcaattctcctgcctcagcctcccaagtagctgggaatacaggcacccgtcaccacacctggctaatttttgtatttttagtagagacaggtttcaccatattggccagggtggtcttgaactcctgaccttgtgatccacctgcctcggcctcccaaagtgctaggattacaggcatgagccaccccacccagcccaaaattatttttaaataatgttagccctgtaatcccagcgctttgggaggctgagatggacggatcattggatgccaggagttcgagaccagcctggccaacgtggcgaaatcctgtctctacaaaaaaatacaaaaattagctgggcgtggtggcgggcacctgtaatcccagctactcaggaggctgaggcaggagaattgcttgaatccgggaggcagaggttgcagtgagccgagatcgtgccactgcacttcagtctcagtgacaaagtgagacactgtctcaaaaaaaaaaaaaaaaaaaaaacaaaacttagaaataaatttgatgaaagatgtaaaagactgtacactgaaaactacaaaatactgttgaaataaattaaaaagatggacaaatatagagatatactatgttcatggattggaaggttcgatagtgttaagatgtctgttattcccaaaactgatgtatgcagttccaataaaaacccagcagtgtcttagtccatttgtgctgtcataacaagacaccttagactgggtcacttataaacaacaaaaatgtattgctcctagttctggaagctggaaagtcccagatcaaggcaccagcatatgtgatggctgatgagggcctgttccgctcagatgctgccttcctgccacatcctcatgtggcagagagagaaaatcagctcccccaggcctcttgtaaaagggcactaatcccattcatgatggctctcccgtcatgacctagtcacctcctaaaggcccctcttcttattttttatttatttatttttttgagatggagtctcgatttattgcccaggctggggtgcaatggcatgatctcggttcactgcaacgtctgcctcccgggttcaagcaattcttctgcctcagcctcctgagtagctgggattacaggcacgtgccaccacgcctggctaatagttttgtattttcagtagagacagggtttcaccatgttggtcaggctggtcttgaactcctgacctcaggtgacccgcccgcctcggcctcccaaagtgctgggattacaggcgtgagccaccgcacccggccattgttttaaagacccctcttcttaatgccaccacagtgcagattaggtttcagtatgaatcttggagggatacaaactcagaccgcagcaagcagggttttttttctttctttctctctcaaattcttggaaggttgagcagggcagggtcaccaggcctgccggcaactgctccccttcctctcatcctcctgtagcttcttggactcctgggccaattgatttttctgttccgtgatgtggagtgatcaaagctggttctgggttttctggagctggatctttgattgcctttgatttaaaagcattggtaaccgtttctcacgggaaagaggcgctgataattcatgcaaatgagcatcaatgggcaaaattcaaccaagtgcctctggaaccaaggctgccattgaacattctagtaaaaatggggtggaggcttttgcccaagtgctctggataatctgggaaaagaaaatggtgagtcagtgctttattttatttatttatttatttatttatttgtttgtttttgaggcggagtcttgctctgtcacccaggctggagtgcagtggtgcgatctcggctcactgccacctctgcctcctgggttcaaacgattctcctacctcagccacccaagcagctgggattacaggcacatgccacgatgcctggctattttttgtatttttctggtagagacagggtttcaccatgttggccaggctggtctcgagctcctgacctcaagtgatctgcctgcctcggcctcccaaagtgctgggattacaggtgtgaatcaccgtgcccagccgaattttttttttctttttttttctttttagatggagtctctgtcacccaggctggagtacggtggcacgatgttggttcactgcaacgtccgcctcctgggttcaagcgattcttctgcctcagcctcccgagtagctgggattacaggcacgtgccaccatgcccagctaatttttttagtagagacggggtttggggtttcaccatgtgagccaggatggtctcgatctcctgacctcatgatccccccgcctcggcctcccaaaatgctgggattacaggcatgagccaccgtgcacggcctttttttttttttttttttaaatagaggcaaggttcaccatgttgcccagccttgtctccaacaagctcaagggattcacctcctcacagacagtgctcccacaggcgtgagccaccacgccccaccttatttatttttatgtatcttaacttccaaggtggatttatttaaaggttttacaataactatgtccaggctttaggctcatgggaagtaaatgaggacacctttttcccaagaagaatttctttaaaaccaagcacattgctaaataacaacattatatttggcaaacaataattggcaacaaaataagtttattattctgcccaagccagtcccagatgctgtttcttaaccaagatacaaacaaattttgctgtagcaagtctagaccaattttatcaaacatgtctttggttagatgtctagtttcatttaacgttttgaaaactcatttgacagccagtcaagtccctcatctacaccagctccgtgttgcacaagtggcttgaacataccatgtcctgttaggaagagactgaagagctggctggctcatctgtcgtcacactgatggcccgagcgctgggcaaaccctgtttgtttgcagagagcagtggcgctgcgtctccacactcaccggccagaagccttttctgcagcgcgtccgccacttcccgaattctttcatgatcgttgctatctaccagcaaaagaaaaccctgggtattctggaagtaatgcttccagagaagcctaattacatcttgaccatgaacatcccacaccatgaaacaagtgttctctttttgagtcagagtctcgctctgtcatccaggctggagtgcaatggcgcaatctcagctcactacaacttccacctcccgggttcaagcaattctcctgcctcggcctcccgagtagctgggattacaggagcccaccactatgcctggctaatttttgtatatttagtagagacagggttccaccatattggccaggctggtcttgaactcctgaccttgtgatctgcctgcctcggcctcccaaagtgctgggattataggcatgagctaccgtgcctggcccaaaacaagtgttcttatattctactctttccatgttaaaaccaatggcaggaactgtggtgagtacctcccctaacttcagtttatacacaatgtataggcagcatccaatcgaaccgtccaaatgtgcatctgcttcttgctgaagaggcgggagaagagagaggagatggcggggaccatgggttcgtggcacttgtgatgggcagaagcagaggggcttggggggccctgtgctttcttctttcatgcttccaggcaaattgaacaagggggaagagaaagaactgaggaagaaagagggaggcagggacatctcactggcccatgtgctggtgaagctgtagacaggaattagcaggacgaggacctgctggtgatggacacagcagctccagctctcgatgctttaaatgcctggcttggagtctgaaaaaggaacctgaaagcctctatgactgccttaaagtaagtccttatctcctgtagccatggggctgagatttctgcaaagcaaacctgaagcctagtctcctggatgatttaattacagcctaaactgcagtttcgactttgcagtgcctcttttgttaaagttagggaagttgggaaagaatgggaacctgacgttgcaatgggggcatgtgggcggcaagccacccaggtgccgaggcaagagaccgagggcacgagctgttccagtgtaataaaatatataaaacaacaagagttataccagatacagatcatagacatgattatatatgaatatctttcatcattagtttgtagcaattactctttataatgcttgctctataatcataatctaggaaaaaccaggccatacagagacaggagctgaggggacatggtgagaagtgaccagaagacaagagtgtgaaccttctgttacgcccggacagggccaccagagggctccttggtctagcggtgacgccagcgtctgggaagacgcccgttgccagacggaccgtggtctagcggtagcctcagtgtcacggaaaaacacccgctacttagcagacggggaaagggagtctccctttccccgggggagtttagagaagactctactcctccacctcttgcggagggcctgacatcagtcaggcccgcccgcagttatccggaggcctaaccgtctccctgtgatgctgtgcttcagtggtcacgctcctagtccgccttcatgttccatcctgtgcacctggctctgccttctagatagcagcagcaaattagtgaaagtactgaaagtctctgataagcagaaataatggcgtaagcggtctctgtctctccctctctgtctctgccttggctgccaggcaggggagggccccctgtccagtggacacgtgacccacgtgaccttacctatcactggagatgactcacactccttaccctgccccttttgctttgtatccaataaataacaatgcagccagacattcggagccactaccggtctctgcgcattggtggtagtggttccccgggcccagctgtcttttcttttatctctttgtcttgtgtctttatttttacactctctcgtcaccacacacagggagaagcccaccgaccctgtggggctggtccctacaggggcatgtgggaagatcccagtgaagctgaggaccacgagccctgcaagtccattgggatctgccggtgaactccgcaggtcgtctttgaaggcacatgtggctcttctgccactgcctggggagctgagacccctttgcccaaagaccctcaagtgccttccctagggagctgccctgtaaggtgccgccgtcctgcccgggactcaccaccacctctgtgttccttctagacctagatccagactggagttccagcaggccccaaaagagaaagtgtgaggtgtggcctacaaatatgtttccctacgaaaacctgcggaaaatgtgtggaaatcgatgttgagagtgcgggatctgggtgggaggaatataagcttgcgtaagtggacagggactcagatacgagattctggatttgatgcgttggagggaacggctgggagtgacccaccccccacccccattttcttcatcagtcaccgaaactttcgccccacaggtagctgaccctaaattcagtgaaatccagaactttcctggcacactggagaggacggcagaacgctgggatggatttatcgtgcaagaccagcttgatgtccttagggcttggaggtcaccccttcacgaggattgtgaggagtgaattcatcggggagccccgcaccctcacctgcaccctcacccccacccccacccccacccccacccccacccgcacccccacccccaccctcccccccacccgcacccgcacccccaccctcacccgcacccccaccctcacccccaccctcacccccaccctcacccccacccccaccctcacccgcacccccactcgcacccgcacccccaccctcacccgcacccccaccctcacccccaccctcacccccaccctcacccccacccccaccctcacccgcaccctcactcgcaccgcaccctcactggcaccctcacccacaccgcacccacacccacatcggggaagagctccatgatcattcttttctgtaggcgaaaaactgcggcgggaactgctgccatgcagctgggctcccaatgcagtggggatggtggcgctctgggctggcgggagctatcctgccggacgtgattcccagcacagccgtgagcggcagcagaggcgcagtcatctgacccacatagttcctgcgttgcctgatgggcgcagcttccctagaactgaaaaaaaaggacatcctgccaaaggcgtccccgttctgtgctggcagaaaggctgtaggtccgagagcaggagtcctgcgctctgactggaagccccaacacagagtccggggccctcggccaagttccagactctggacagacccaggcccctggaatgaaggacagactgagtctccgagaggaaggggccctgctaaatgccaaaaacatgcagctaatcttcccaccgccccttcccaaaggaatcttcctctgtttatcaggagtctgtgcaacgggaatgggaaataatcaggccttttaggaattactagaccctggagctgaaaggacattcatttcaggaggcccagatgccaggcagagctgtggtttatggaggcggacgacggagttggttcaggttttcctctgaggaggcccagtgagcctcccggcctcctgtggaacagacatactcagccaatggcagggtccccacatggtcccctgagccctggagtgaggtcggctgggagcagcagagcagccggaggaggaggagcaaaccccaggccacagcgtgctcctggagggaccccgattttgtcaaaatttagatgcagagagaaaaagattaaggaaaataccaaattaacgacagcagtgactgctgggtgtgacgttttgggcaggcttggttcttctcccttttgctaggtgtcccacaggaagacggacccagcatgtggggacctgcacccagccagtctcgccctggctcagcctgttcactggcgctgccctgccactgagggctgaggtcactgtccgtctgggcatgtctcatgtggtctttccttttctccccttctggttaggccccctgagctcagccacagccacgatccccactgccgcctcctccctgggactcgctgatgcctggtgtggggagggtgctggctgctttgggtgttaccccccgttggaggcccccgtgccgagttctcgagtgagatggctctttccattttcccccgacagctgcctcggcctctgtgctagaacagggagctacagctcagtgaccctgtggtgccttgtgggcctgtgggtgccagggctccggggcctgggccttttcctgcttggtgtggctgaccgggacgcggccgaccccaggggcatactggagctaggtcttcctcgccatgtttccacagtgagccctttggctgcacaggtcacggtctggagctgttggaggaggctgctcagagctgttgctgccccaccagacacttggccaaggggcctgcaccggtctgcgcgggaacgtcccaccggcgtctgctcatggctgggctgtggacccatacgcttgttcggaagccaagctctggcccacaggcgaccagaggaagctcgcaggccaggcgccagctccccgagcctgtccctgcagccgcgctgtgtgcaggcacgtgggccaccgcgtctcctccactggcactgctgggtctgggccgccaagcccacctgcccacctgcatcctcagcagcagcacgccccgcagtcggcgggtgcacactctgctgcagcctggatgggctggggcctcggggctcactccccaaccatgagactccttcaccgcagttgaggctgttgcagtggtctcgggctcccactcagccccaggagagggtctgaagggggtgagtccctcctcccgaccttcctgcccatcgtctccagagctggatggtgctgggtccccacagggagcgagacagctgccccgtgacggaaggatgtggggacccgcacccggccggtctcaccctgggctcagcatgagttcagggaggggtccaaagggcactcctgcccacgcccaggcaaaccagcaacaagaaactgggtggccagggcgtccgtgcacgaccccaaacttctccgcgttagaaaaaggctgatgaagacccgagacagaaacttcctgtagctgtttattctactgcgagtaacaaaacctaggtcgttccatgttctcatgtacagtgatataagcctccgcaatataaaatacaatgtacaggaatctctatcaagtaaactaaagaaacacacttgatttttacatttgtgtatttaaattagaaaaatttgctttatatgttaaacaaacaaaaccttctcatcgtactagatgttggaacgtgacacctactttaatgtaatttaacctatggacacttggctttcaacaccaaacatctcaaactgatacattctcaatgttttcttaacttaaaaaatctgtgctataaagtgaaaaatctgtagtgacgtacaatggaataacagactccaaagaacaagtgaagttctttaattttacatctgtaaaagtttatgaaaatataaaaaattatcaaagtgtatttgtacaaataaattagccagatttttttacttcacacttcagaagtactcgaaaaatacacgacaagcaagagactgtttcacagtgaacagcttcctgtctcatttgcagttcttgagctagtgatcactagttcccgtctcagactttacacaagtcttgttccacgttcaaggacaaacttttacatgtatcgtctgacaaataccagtttggggccgagcgtacttttcccgggatacagaagaactgctcagaaggcgaaactggaccaacaaaactcctgattattcaaatcaaggactcctccctgcccccaaagtacacttaattggtttgttactttttttaggctggtaaaacttaacatttttcaataaattgttatttaaaatgcaacaattatactaggacagatgttgctttaaatcatgttttggaaaaaattgataaggtgatatataaaatctgagcacgctaagaaatgtgtttctgtttcccagttgaaaattgtaattccaattttatgacaaaagaaagatgcatttgtaaggtttgtgtttctcaagactccagatacaagctactaagacttctcccgtagccgcagggtggacgcctgcaggtcacgcccacaccggcctccggggcggcggctaagacctgtaaaagcagcttttggaaacacaaacggatgagatgtcagtgaaggtatggctctagggtccaacgaaactcccttaaaatttacaataaagttattggaaaagataactatgatctgaaaagcaatatgctccgtaggcaatttcccatttcttttaattttaaatggaaatattaaagtttagtttttttaaaaaagcatcagaattgtaaagatgtgaaatcttgtaagaaaccatttacacaaaattacagtaatgtttaagtccagaatattctatcctgaatctaagatcgtggctatttcaaaagctatttgttcaacgcatcttacgaacgtggctttaaaaagggtctctgcccggccggggcgtctaggcctgcgaggcggtgccagcgtcggaggccctcgaggcctcgggcttcgggtcccgagcgctctctttgctcttgctccggtccttgcggtcgcggccccgctccctgtccctggccttgtctcggtcccgctctctgctccgggaccggtcccggtcgcgcctccggtctcgctcgcgctctcggttcctgctccgctcccggctgcggtcccactccttgccccggtcggcctcgcgctctcggtcgcggttggcgctcctctcccggtttctgtcccagtcccggctggagtccttgtcccggtgtcggtcccactcccggggccggtcccagtcccgctctcggctccagtttcggccgcgctcgcgctctctcctcctgtcctcggacgcccggccctgggcgtcgggctcctccagcggcttctctttgggccccacgtcaaaccgctctctctgcctcccttcgaaagtctggtttctgtattcgtggcctttcccctctcggaagtcggccgatgcccactgtccgtcggcctcggggccctgtccgggcgcactggaggagagcgcggagggcggcccggcctcctcccagcggtccttccggtgctgcggggggtggctgggaagctccagcaggggcctggggcccggcttcatcacctgcggggcctggccctggaagtgaaatcgcgaaggggtctgctcatttttttcagaaaagggtgcggacccccgtagtccaccaaactgcaggggtgcaggcgccctttggtttgtgaatcttggtggtgaatggaccctctggtcttcgaactgctgaggctgaatgcccctgggacctggcataaagttaggcgcttggcctctgggtccttcaaactggttgggatgagggccccgggcagtttcaaactgactaggatggggccctcttgggcccacgaaatgaccagggggtggtcctctctgacctccaaactgagagggaggggggccgcctcgggggcctttcagctgagacagcagtggccttctctggcctccgaactggaaaggcgcgccgcctctgcttcccagaaatggggcttgctctgtcccttcaaactgggcgggggcgcccgtcacctcgttatacggggcgtcctggaactccctcttctccccatggggatccttgcgttcttcaaattgggatggtgccactcctcgtggtccaccaaggtaagagggtgaggggcctctgctgtccccataaggaggtggcccatgttgccccgagaataaggaagggatgggccccttctgggctccgaatctggctggcggaggccctcgtggcccatcgttagaagcgatattctcttctggaaacggaggggctggcccccttggtcccgggaaattggggccgtgaagccctgacatccccaaagcatgaggtccaggttcccgctgaccctgaaacgggggctgagagccccccactttctgtcctggtggggggagcggggcggtgccctcgccgggtctggcctgtggctctctgtccccctctgtttcacctgcagggctgctgctccttccagcagaatgaagatttcttgggtcctcatactgggctgagccgagagccttgtcctgcgacgcgaaccccgggcaggtgaaagggtccctctcaccgtcgtgctgcagcgggaagccgggctgcagggcgccgcaaggcggtgtgggcagcagcaccctccgggcaggcctggccgagctgtctccaaccgtggcggggcgggtgccctccccaggctctgccttccagccgtcctgctcggaccccgctgggggcttttcgcccgaagcccagggggaagaggctggctctttttcctccgggactggcatgggcgcctggcccacgaggccacccctggaagcatctctctcgggcagggcaccctgggcaccacgtgccgagagcctggagagaggctccccctccccctcaccggtctcagtggccaggcgcctcgcctgccgggggtccctgtggtttgacgcctggctggcggggggcagtgaggcgggcttgtctgcagactgctgctcttgctggaacagctctgccttgggcaaggacgactttggtggtggagacatcaaggcgtccgacaccgagaagtgggccatggagaccccgacggcggccctctgctgcctgagagcttcttcttgctcctccagctgtctcttctgctcctcgatctgtttgttcagctcttctagcatcttctgttgctccaccagggagggcgtcgcagccccggccaccggctcggcaggcctctccacggagttccttctcacgtcggcacacatcctgttgggcaggtcatcaacagtcactttcgcttcttctaagatggtctcatcctcggggtcataggccacctcttcccgctcggctgcagctgcttcaggagccctttccacctcgtggcgccgccctcgctccacaagctgagtgtcgaaggccctctccgggtcgtactcctcctcagggtcgtatggcctgtcgtcctcctcttcctctagagccttatcttttgagaactgaccgaactgctggacgatcggatctaacaacggaggtgccggcaccccgtcctctgctgtggttttgggctcctgggggagacctgcggtggacccgggaggctctctggcggacgggtcgaatgatttcttctttccaaagagagtctgcaggatgtgctccagcggtgatgctgttttggaagcagacgaagcggtggaggaagctgccgtggaggctgccgctgctgttgtggctgctgtggctgggctgggggctgcaggtttgagggatgacagcacttttagcaccggtggttctggaagagggggcggaggcggcggcgacccaggaggtgtggtgctgacagccgcgtctgcagagcagagtggatacttggagggcttcttttccgactgcgggactgtggctacttttggataggccggaacgtccgcttcttccggttgaagtcgggtccgcttttcgtccatcttgtctaactctccactgtttgcgggacgtttgattttttggcagattactaacccaagaattatattcggacgtggtgactcaagacctgaaaaacaaaatatttgtgcaaattttagaatctaaatccagcttttaccctttagaggtgaatttcattaagggctttcacggggaacgtttaatagacaaaaataagccattctgtggcaaaataagatcaagtgtcaagacagttgcaaaagcctggacgattccgccccaggaacgcaccgccccgggaacgagctgggaacacaccgtgccaggaatgcaccaacccagtcctcccggagccatgtgaagggggcgactaacccctcgtcaccaaccatggaaccgaaggcccaatccacaagggaattcatcccaatcgtctgaatttgttacatattttaaattataatgctagagcagtagtgtggaggggagggaggccgtggtgtgagcctgcagggtgaaaagggcattgtcgcacatgccctcaacacaacagctcagctatgctcttcttcccctcgtgccactgccaggaaggtaacaaacagcctttttttttttttttttttttttttgagatggagtgtcgctctgttgcccaggctggagcgcagtggcgcgagctcggctcactataacctctgctttccaggttcaggagaattctcctgtctcagcctcctgagtagctgggattacaggcatgcaccactatgcctggctaatttttgtgtttttagtagataagaggtttcaccatgttggccaggctggtctcgaactcctgacctcaggtgatccacctgcctcggcctcccaaagtgctgggattacaggcgtaagccaccgcacccggacccctttttgtctttaacttaggagttgcaacacataattactctaaatatactaatattaaattatcaataaagtcataataatcaataaagcacaagccatgaggtcatccattagtctctggtgtcagaattacaactagacaggaaaaacagcattaaatgaaatggctaaaataaatgctttggactgggcatggtggctcacgcctgtaattccagcactttgggaggccaaggcgggtggatcacaaagtcaagagtttgagaccagtctggccaacgtggtgaaaccccgtctctactaagaatacaaaaattgggccgggtacggtggctcacgcctgtaatcccagcactttgggaggctgaggtgggcggatcatgaggtcaagagatcaagaccatcctggccaacatggtgaaaccccgtctctactaaaaatacaaaaattaactgggtgtggtggcgcacacctgtagtcccagctactcaggaggctgaggcaggagaaatcgcttgaacccaggaggtggaggttgcagtgagccgagatcacaccactgcactccagcctgggtgacagagtgagactctgtctcaaaaaaacaaaacaaaacaaaaaacaaaaattagccaggcgtggtggcgtgtgcctgtagtcccagctactcaggaggcttgaggcaggagaactgcttgaacctgggaggcagaggttgcagtgagccgagatcgtgccactgaactccagcctgggcaacagagtgagactctcttggaaaaaagataaaataaatgttttgggtttagaaattcagtgagcattaacatatcaaagactccctaaggctcatgtctttgtaaacacaggacagacaccacgctcacgtaaagcaccgaggtgctcagcaaacaggtggcaaagagcagagcaggtggacgacgcgcactgggggttttaaggcacagtattagtttaaaaaaaaaattattcaaagatattcccaacgtcgtaagttgtggtaacttcaatcaggagtactaacattccagtaacgaccatccccacactcataatcaatcaagaatgccaaaggggaatataaaaacccacatcccaaaacaggagctgaaggaaagtgatacacgtgggtgggacgtttcagcggcagcgacgtaacactatgtgagattaaaccgtaacaactcaacggtacagataatttaacgtgactgtggtatacaaaaggtgctcacactacagattttcttccccttacagtgaaaaccagtatgatttcccgtgcttcaggtgatgttaaagatcatcacggactgcttcaggcaccaccatgtagttctaagtacatctgttgttcatctccctaaattccactaaggaactgatggacaggctgagcacggaagatgggtgaaggcaggaataccaggcctgccagactgagttgggaccagcctgctccacgggacacttcctccctcctggagagaggaccaaaggcctcttccttcacaggctgctggacagagctgagattcccagcacctcacctccacctcctcttcactctctgtcccccggatagtagcacggtgccagtgaaagggctgggtgggcagaggaggagggaagcaggaaaaccagccgggccacaccgaagggcacagctgagctctgctgctcagcaaacctgtcgagttcatgttctgcttaacatgagttgaacatattttaaaacggtatttctctcagcacaacagctatctgtttactgaataagctattacacagcttactcaaatccacttttcgggtatgttcggttatgaaattggctattatggccttcctggaccatacatctgcagagcccaccacgccctggggtgaagggcactgaggctcaggctgagttctgtaagccgggctctgtaagccaggccctctgcctgcagaacctgacacggggaacagacacaggcatgggctaggcctcgggaaggaccctgggcagtagggcttgtggggcctcgtgtggggaagttacctggggaagcctagtgctgactctgacacagaggggacatgccacccaagggagacactcagcttctaaagggctgttagggtggcagtgtgatgtacaaaatcactgttacgtggtcccgtctcgtggtgtgtcactagaactcaaacttttaatggctaacttgcttgttaatgaaaaaaataattagtatatcccaaccctggcaagactcgttagtcttgaaaacagcaaccgtctggagattggcatcaaacacgcagctggcacgtgtaaatgctcccagctcttggtgctctcaactgcaaacactggtgactgaataaagaaagctgcagagtcagatgggtgctcgttctgaatttccccgccatttaaaatttaaattgggctgtccaaaaaggcacacccgctgtgaaacagtcaaatcttgtcacccaactcatgtttgttattatgtatggttgcatgaatatgtaaaatgtggcaggcgccttggaaataactcttcgtggaaggagcagtgcacttcgcctggctggaccttgggagccatcttcccctggaggaaagggtgtgcctgccactgcctggcatgtccagcagaccagtaaggtcgaaaggtcacagagcccccacctcaggggggcagtcgaggttgcccaggggctgttcccaggctagcccctcccctcggcagctgccccgtggtgtgtgagccctgggagggagagtgccccgggaaggtgcagagactgaggcctgcacgaagctggcaccagccaggttgcgggtggcacagggcacggtaggcttacttacccaccttcctcctgagggctactgagggcctcagttcataaagcaaccaggggccggggctcaggagcaaccagggaccagggcctggagacgccagctgcggctaaacgtgcccctgcacttccactgaagggtactgatcaggcctggaacaagggtgtggatgttcccccaacgccctctgaaaggccagaaggcaaatggctttcttcagggcgtaccacgtgcaagccaacaggcctttttagcacatctgtgtcctttgcgtattcatgacggaggggtctggactcagtggtcagaatcagaccacacgcacaggaaaagaactcaagaaactgaagataaaagggtgtattcgaaaagctgtgtgggccaagaccaaaaccaggatctgtgtccaggtgtgtcgcaacagggactgggggacaaggcagctggcaaagggaaccacctgcttctcagggtgcaggaagcaccctcggtactgaacctgaggctgcaggaagacgctccttcttactaaatgaaccacccgaaacctgactcctcccaaccccaaactatcacagtgaggcctttacccctaaagccacctggcacatcccactatcagtgatttaaaatgaaaactctctcaatggtctgcacctgtcaaaacaaaatgttcacacctgctggaacagaaacggtgtggaagttaatcaacaaggggtgacgtatgacttggatagaaagacttggcaattaaggtgggaagaagtgacttcccccaacccaccaaacacacccactcacacacacacagaccctcccttgttccaactgggaatctctaagacctgcacaaagccactgggtccagcacgtctcaggtaagaggagagcgacgtccatcttcttctgggtgccggggtgccgagaagggccccagggcagcaccagcctgcactgcgtcctctccagcagctgctgggtgggctgcagagctgggcacactagggtgcactgcgctggcttatggaaagcaaacaggggcctaggataggtgaccaggagccaccaaatggttccaattcaaacaaacaaggaccagtttccatgaaagatgtttattgatttaggaggagaaggcagtacattccattcaatactgtatttgactctgattacaatttccatgcaaagctactgttacatacacacatgaaaactgaagaaatgcttacctgacaatatttcaagtcagaatttctcagctaatttagaaagcaattaaaagtgaatacagaaagacactatggattcaaacattcttcccagaagagctttctaatgtataaagacctcagagaaaagagccctttccattcgagcagctacagagggcggtgtttcctcctgccctgtacttggggagaacagactgtgcacccatgtttatggaccgaggttactccacaggcatttcagaccaaggctccgaggcctgcggcttcacgcggaaatgacgggggctgggcatggttaacaggcaggcatcttggctgcggtccagtcctgtaagggccctgcacagaaccctacacgatgagctttcaacctgactcatctcccttccatgaacaaggccctgagacaggccgggactctgcgaccccaagtccctgcggggggccctgttggtaaagctggaactgagtggggtgaacatctaggtggagaaggtcacctggaaccaggcctcccagctgccccccaccgtgatgctgagttacagagagtgcccccactgcggggcagaggggcagaggaagacaacccggtgtttctgtggacaaatcattaagatatgcaaggacaaatgtcctcagggagatccagctactgctgtgaactgcatggctcctgagggtgctgcgggggcagctccactctcactgcccgacaagggccaagtgctgacagggcgggtgacttaagtttcccctgagggcacagctgggcaccttcaggccttcacttgcttaagtgtgaacagcaagcactgagggggctaggactggacaccacgctgtcaaaacccactaggtccccatgtgtgggaggcatggacacctgcaattgtgtggtataaactgaggcacatggacgagtcagtcactcttttctgcgtgaatctctacccccaacaggaccttctccttaacatccccaggggaagatgctcccacatcagtgccctgatgcagacgggcagctcaaggctggggcgccaggtctccttcaggcctgtgctgcatgtgccgcagagaactgaggctgtggaatggagctgggtcctgcagaccctcacccagcacttctgggggcgtgactccaagctgcgcagcacacgctcacccctgaccacagctctgtggagtcaccaccatcagcaccctcaggtgtggcctgtgctgtccaagggcttctgggctatctccgtgaggacagggtccgctgagacaggggaaacatgccaggacctagccttacacacacacacgcgcgcacatgcacacgcactacacatttacaccacaaagccaggacacacatgtacatgtttatatctagaaaacgccaagtcaagtaatcagtacgtgaagcgggccgagtacccgatggcctggcccggggtgaaggctgtttagtgaccatggaagtgtgtgagatttcacgcacacgcattcatgtcaacaaggacatcaggagaagttaacattatactgaagtcttaagttaaaacatttctgaagtgtatggaaaggtttcactagctgttacttttctaaagtcccttgccctgtgttactttacccagacgcctctgctctttatcgtggatcaaagtccctggggcttttgtgtgtccccgtcaggcggcgtcgtggcctcagcaagtgccttggtgggcgagtgtgacgttcccccagctggtcgcggagctgacagtgtgggtggttggtgccatcgcactcagcagacaaggtgagtgaccccagcccagccctccttgtcccggtgccatccgggaggtgctgggagacctgtcctttccctctgccccggggctgcacctgcacagccagcccttgctgtggggagaatggaggcgccgctcctctggtggcctccctgggccccgtcactgcccagtgtggggaacccggtgcccggcatgcgccggggctcgctcaacaccctacaaccgtgctcacctgacagctccaagtttggagatgagcagggagagaagctcaagaaaggatgaaatatcgcctcaattgttttaaaaaggggaggctcgctatctaagaatcatgtttctgtaaagaaaaagtgctctttccaccccggtagggaggtgctgaggtgctgcagtgtctgcactgagtgcacacactgtcgcacttgcaactgaccagtgggtcttcacaggtgcggagaggccagcttctcggtcttcacctccaggagggccgggcttttcctctccctggtcacgtggagctggccagagctcttcacaagcaacaccaagaacctctaccagggtcctttctgccacccattaggtggcatctctttatcccaagtaggatttgaggggacacactaaagcactttgcttttaaaaatttatctggcactaaaataatttaatgcaccacgccagcaaatatttaaccctgaaattactgataccaaccaatccctttatggacatataattccacaacacaggcataggctgagcccactccagctgtgaagaatgggctccagtaggaacgtgggctgtgcctggggcgacagaagtcccgcccaagatgtggagtggcccctacaggaccccagctagctagggtgcggcatgaggggtgtgggtgggaacaccctgcacagctatggcaggaacacccgccgaggcctggtgacagggacagagggcactgaggcacagggtccagacagcacctgcctttatgacgaagcacttcagaggacactgtgtgatccacacacccgctttgagagaacaccaatcctctggggactgcatggccacggagacacttcagttgggcatcagatactaacccctaactgaagtcacatcagcttcttctaaggggctatgaaagagctggtcactaacagagcacgtggcccctggaatcaccctcaacccttgacaaagatgtattttaggctatttgtaaataatcgtttaaatacagtactttccaaggaacgtgcaaacacaaaatagcttgccaaagatgaatgaacctattacaatttgagctgcagattttaaaataattatttctagaaatagttttctatgtcattattgttaagtctcctggaaatccatccctgttagagaagtgatccctgatggagccacttcccggtgtgtgctggctcccgagtctgtctagaggaaagagcagggccgctgggagtgtcacctccctttctggctgagccttgggcttctgggcactgagtcttctctgacctgaggccaagatgagctggttgcaggctgtgggtttttccctctctaaaaaactctcctaagacaatttatgctgtgaatcaggggtacttctcgtgccacagtcctacgccctcaaagatgaatcctattgctaaccgctgcgtctgtgctcctaactcctgctcccagagagccctgggctggtcaggactcagcagggcatgtcagtgggaggaggggtgcaggtgcaggtgggcctcacctccacccagaaagccggcgcttacctggtccctcaaagggcaagagtttggatggaacagggtcctgggcgctcagcgggatcaggtagaggtccttgacgtgcctgttgttattagctacaacaccaaagcggccacggctgctgaaataggagtagagagagatataggcgacctcctcttcctctgtggcggggtggaagcggatcagacagagctcctgcaatggaagagtgggaagcactcataaagaaaatgtggctcaagcatcacacgcccaattcacatcctgctttcaacaggaaaccttgtcagatctctccgactcacagccacgatctcacagagctgctgtctcagtgaggcaattcacgtgacatgtgagcccagcagtgtctggagccgagccggctcttcctacatgcacgacggccccggtcacgaggaaccagctgcatgatctgcaatggctgtctgtgcccctccctagagggggttaaactagacgacagggtctagccctttcgtgaacctgacgaagactacagagattccccagagaaaaccacagacagacacgcacagctgtagctaaatctcagggggtcccagaaaaccagaaccgttcaagagcccaggttgagtgccctgagcctgatcacccctgcaaaagacaccttctgctccttcaatcataaaaaaacaagaaaataaaacgtatctatttcttcctaaaatttaaccgcacatacattataataaatcagaaacaaacttctaccgcggcacactcagacaccttcacacagtcatacaactatgtaaactttttttttttttgagacagtcttgctatgtctcccaggctggagtgcagtggtgcgatctcggctcactgcaaaacttaatttttaacattcacctggaaatatctagtaagctacaggctaacattttaagtgttaacccatccaaacgagaggttaaaaaaagatgtgtttaaatcaacacaattttccatggttgcagaatttatactataagcaggtaccttagacacagaagacttgagtttgccaacataatcccaaactgtcttcggtgcgatcctcccaccaatgtgaattgtgtcaggcaaatcctaaacagaaagtactttgcgtaaatcactttgaactgtagtagtcacagaaagacgaatgcagccatgtgaaggcacacactacccaagattcaagaagactacagctattccaaggaaaagagtcacacttgtattaaatgcattaagtccaggatgacaagtggccaaatccaaagggggagtgatgccaaccttctgccagacaagattatgtttagaaatgactgcccaacacttctatgctgtctttacgtacatacacagagagtaacgattcactatgagccagggtgactccttgcattaaagtcataaatgctagtgctgtcttctggttaattctgaaaactaaaaggcctgccacggggtcatatgcgccaccccgcaagtggccaggtgtgtgtaaagcaggctccgaacacctggctgtgccggtggctgtgcgcacagccatgtggtcagtgccccagcgaaaccgatcactgagaggccagactgcaggctcacatttccgaccctgtccaaactgctgaacctgcggactcatcacggccatcgccactttgcatttagagccgtttctgcatccagacagacggttgcaagagtgtcaggcatttctgtttctctcctacctcatgaattaagggagaaagtcatgtgtttgactctagtttagaaactcctatgaaagacacacacacgcacacacattttcttggttctaacctcactgaggtaatcaaaacacccagagacaggatacgccttagtgacaaattttgccacactctgcatgttaataaatcctttccaaatggtgctgagtcgagacaaaaagagggtcgtgtctccctctggaggggaacgtgattctgaagtgctgtaaaacaaaaccataaaaaaaaagtcaatgtctctctgtgcaatgagaatttcaaaagtagaaagccttttttttttttgagacaggatctcattctgtcatgcaggctggagtgcggtggtgcaacacagctggctgcagtctccgcctcccaggctcaggtgatcctcccacctcagcctttcaagtagctgggactacacgcgtgcattaccacacctagctaatttttgtcttttttgtagagatggagttttgccatgttgctcaggctggtttcaaactcctgggctcaagcacatgctgggatgacaggtgtgagccactgtgcccggcttcaagagtacaaagactttatatgtaaaagcaaaagtgaacgcttgcaagttttacgtttttggtagcttacttttgccaattacttactttaattaaaatgatacagacattttggttaaagaaaaataaagtgaataggcaacaaaactggatgagcacaaatttaaatgtcaatttctaagatctctacttccaaaaggacaataaggcaccctacaactggggctttttaaaagatgaaagagtgaagctgtatttcaggttacatttccaagttcaactatttaatcaccagttatctttcctttcgttaatctaaaaaaaaagtttggcttgttcagaccacacctgaagtacgcacctgatatttggtgacggaggaactgacaggtatcttgggtcaggagatgaggatggcttagctagtatggacttgggcaccatcacagaagtcaagacaggcttcggcacatcctgtctggcttccaccatgtgggtgctgtctgggcgggatgctgcggaggccacggctgtgcatgaactgcttggagcggtcctggggtcccggccggacactgtgacggtggtgaccaccccgctcccacaggaggctgggcagggggacaggtcttccagcggggagggctcgggatggccatctcctggaggcccagggaaatacgttctgtccacatttggatgagaagcactttctaggcctggctcagaggcaacttcaggcacagcctccggcatcacctcatcagctgaatccggagctgggtcaggtgcagagctgtcatgctttgattttaagtcttctttcttaacagaagctgacaatttttgttttttcggagctggctcatcttctgcggagggaacctggcctgaagaaggcgaggaaaggctctgtgagaaacccagccggcacactggtgtttctcacacaaagccgaaagcaatactctaaaggcagggcaggaaatcattctggcccttctgcgtgtttaagcttacgtgcggttgcttttaggaggttcagtgatttttaacaaaatcaagtttagtctcagctccaaggctccatcccctgcactgtgctcacctgtgcaaattttacagttgagatcgaagaggtgtgcgcggtgctgactggtggtgtctttcaacatgctgctgaagacgtcgagaagcggcgctgtgctcttctcagggacagcacgtgctgactcttgctgttcctaaaaaagaaaaagaaaaaaaagtgaggtcgtttcttctccaaactcagctccaaattaaccacacacaagaaaagcagtctcatgggattgagacccacgggggagaaaaaaggaccatctaatacaaggactgaggaatgccacaatgacatacacctgctgtaagctcaggtcctgcccaataatttaagataacctcaaaacatttgggatggattagtctattctcggtgaacacaaaatctcccaaatgcttacctctgaatccgacactggcggagagtcctccagatcggggatggcctcctgcctgggggccgtcttcttgctttcattgtgcagtttagttctggactccatcacctgaaatgaaaaagacgaaacagagcttaggccttgttttctaggaggaaagcatcgcttatgcagccgtctatgaatttatttctattaagctcgagtcctgggtgcctccgcaggtacccctcagcactcacagatctcgctggcctctctttccacgtggaaagctctttagatacaagttcttctggcttcagtctcacaagtttcgccaaagagatttcctcacgcagaacacgatggaagagtccctataaacaagtatttttcatttactcaaataatattcctatatctgtcaatacagagagcttctggaaaacacagctgcccagaagtttagcgggcacaggacaaaggccctcagggcccacttgcgtgtggcactgggcagagccctccctgcagggtgtgacctaactccccaaacggccttatgagagtgcgccccaggatatccctgctgtgagcaaatgggagcccagagagcacaggtaataaggttcaacagtgggtttcacggcctgtgctgcactggctctgctaaaaaaaaaacaacacacaacacctcaggaaaaacaattatgtacacaaggtggacacaagtcaaaaaggtagcgtcaggaacaaaggaaggaagaaatcatttctgtttagggctgttcaatggtgagatgcaaagtcagggtatttcattatcctaaaattctaaacagggaggagcctggaggccgatggagagagaacaccacaaggctgtcagcccggcggcctatccctcccagctggagtttctgtcctcgtcgcatggcccatgctgcagtgaggaaggactgatcccactacctgggcgtgagcagcccctgctccaagtggtgagaactcaagcagcccaaaccatcaggctcactcggctgatgaggaatatgagaaaataaggtggaaaaggctgtctgaggccggaatacggacaccctcatacactgggatgaagaactggactttattttggagcccagtgaagcgactggcttgtacctttacagcaatgtttacaggagactaatgtggtgataaaaggtggacttcagggaagccaggaagcggacgcgaccctagttaaggcagggaagggaaggggtttccaggacgctcaacgccagtgcaacaatacgtgggcggcagaaggatcacagaggagaaagaaacgtcttagctttcctggaaaggacacgaacatctcaaaatattggttgatccctttagcacccagcgaacagaacaggaatactccaatgcaccgacaccaggcacacacctgatttttagggtccttcaggttgaacatgatgctgcgatatttactcttgtagcgattatctgtaacttgaaacaagttaaacatctccttctcaatatggagggcaatttttcctacttcgttttctgtcatgattaagtcatcgctgtcattgactctgaacagaataaaaaaaaggaactacataagacacttgtgtatattaaactttttgaacagtgaggcaatcctgcagccacactctaatgaaagcccttccattttaatgggtaagaaatcaagcagaacagcccaccttttccacaaaatctcttttaaggagcgtctgatattttgccgaatttgtgaatttggctgcgatggtgcagcactcatagccccaaggcgtcctggggctggcgaggccattggaacagaaggtaccactggcttccttacggctcccaccaaagcagcggagccagggaacttcttggaggcagccgttgccgctgcaggtgccggtccggcctgcctggcagctgaagcaccactcgatggggtagcggagagccatggcctcttggggatggtgcccttgaaacctgagggtggctttttaatggctggtgtggctgctgccacattagcaaaagaagacttctttggcacgaggtttctaggtgcaggctgcttgcccaccgcggagcctggaggggctgttttctttgaggctgccatggctgccgctttctcctcggacctcctgtcttccttcgtggctacaaagaagaacacaggcgctgagtaagggaggacaccacagggtgctgtcacctgactctaaaaagcagacttacccttaaacctgtaagtgcccacctggcattactgaataggatacacatagagaaaaggatttgtaaaatgttagtgttcagaggagtgtaagggaggaccgccagcagcatttatgacggtgactacattttatttcagaaagaagaatgctttattattctatcttttaccttcaaccagcaaactctagttattaaaggcttgacttgcgcactagctaagcttcaaagctgaaggacaatttcctatcatcactttttaaaaggcagatttacagcagcactatcattatgaattcaagtgcaaactgtttgtaaacttcagtgaaaaagaccgtttagaagcgtaaaacaggctctcttagcccggtgggtggggtttacacatctcacttcgttgtccttccagactggagtccattggaggcgatgccattaataaaaatatggaaagctggcatacacctgaaccacaggaagagcagccacacctttacgtgaagagtgagaagctgagaacgcagcaatgctgttacaggaatgcgtccattcacagccctcaggctgtaattccattaagtgaagtatgaatccaaacaaggattataattaaaagctcaaagacatcaaaccccctcaacttgcacaaaaagctttctatgtcagtagagaatcaatcaccttataaccccatgtgagatcgtcagagcccaaaggccctcgagcaggggacagacggcgtgccaggggacagatggccaggggacagggctcgttgaggtgcaccgcatgccggggcagggatccagctagtggagcagagtgaaacgcctggggaatagggggcccccatgagggccccaggatggcagaggccatctcagctctacaggcaagtgcctgggagctacctcgggtgatcaagtcaacaaggcacctcctgaggaaaggcttttccaacgatcggtacagcagcaagcctccaaaactcccaaaggcctaaatgggagaatgtgacagatgctcccaagagcgcttcagttctacccagggactgaaaatcaaaccgcactcctcccccgtcgtcttactgaccgctttcaataaatgaggtaagtctgaaagctcaggaaagagccaagactctacaaataaggcctgattcaacagcctgccccagcttggtcctgcaggatatcccgcatgtgctgccaggcttggccacgttggcagcgggtgccagccctccccagcagccagtccatcaagcagcagcctcagggctgcaagtcttcccaacttcccagataagtacaactccttccatttttacaaaacttgcaacagtactacatggatccaaaaagcggtgtcactgttaacagataccccaactttcaaacaatggtgtcactgttaacagatattcgccccgactttcaagatttccatgtgttctttcctaaccatcattttaatggtaactaagtaaaggcaaatcctgtattttcatcttaggacccttctaacctcatggccggcccctgcctaccccttgctagatgtggtccagccacaggaccccctccttggcaacactgccaagccctgtctcctcacccacaaccgcaccccaaaacactcattcctgttggagctggatcttaaaagcgcactataaaaaatggcaacgtctaacacgacaggaacaaaggtgacagctagtttttatctgtccaggaaactttgcttttaattccacatgtactatgtcatcagatcaggtctatacaccccaggagtcactaccttagtgtttgaaaatctgtttttaacaactcagtttaactcattagacttagctcacaggtctgcagcatcttgcctgcagggttgcaataggtcagtcaggttaaataaaaatcagtggaggccctttttcttgggggaagcagcgagggggtggggtgaggatggaatgaaaaggcccagcaggcctagggcgctggaggcacaccggcaggaggctgacaccaggcaggcaccaggaaccaagccccggtctccagaggcggcagacagacacctgccgggaagccaaccgtgattcaaactgaaacctcaaaccaattcagtgactgcactagaaaccttggagtgttttaatatcacgtttaaagaactctaaaaaagctggctgaaagcatttccagaaacctcggcaaaatgccttggctgtgacacacagaacacctgtgtgctgtgacctgaacggtatctttaatgatgtttaacgctcaccttgttgcaagttagggttacatgctaccttcaaaaccatcaactccatttctccagatcgtaagtgttggaatgaggcgtccatggccacactcagatttctgctcgtgtaactacactattgtctccctcacttagggaaaacccgagttgagagatgagttttagggcactcccagtacatgggtttaaaaccacccattacccaagagtgggggcagcagattaacgtaatttattttaaaagcaggaaatagctttccttaaccattgctattttagaaaattaactgctccctttctaaaggcaacctttgtcatccctcatctgtgctttaaagagcatggaaatgggcagtcaggtgagtgaacggcagaatgttccaagccgggcctctgggagcagtgtcctacaacacgcagaaagccccattcctgctctgaacggacatgttctatccagcaactgttccagggacccgagcacacacccattccactccaggtgggacagcatggctggtgctcaacttgggtcagctgctgctgaaatggggacagaaactttttagtggagctaaaattcaatttgcaagttcatccaaatttgctttgaactattacgttgtgtataacttcagagaagggcaagcagcaactccaggcaacccaggaaaaaaccccactgcagaaacacagggctctgtcagggtacgagcctcccctacacgctgctgggccccctgggggcagcagtggtggtgacctggtcacaccgcacagcactgatgcctgagagccaggggtcccctgcccctccccacacctctctgccccttggtcgcagtgctgtctcctttagctcccacattctgggggcctgcccaggccactggcccagatgaaactgttgctgccgggtctgggtttcagccaactgcagaatgaagcaggtcgtcgtcgtgcacagggatcagcagcacactctaattggccaatttcccccaaagcagaaggctggctggcttgggtgctacagcgcctctggccactgggtggcaccagggcctgagcagagacggggaggagaaaatcaggcccccactggaggatggtgctactccgctcctctctgcagaacccatccaattgccccagtggaagttttagcaggacagggattaaaatatggggcaagagaccaagtctgctcagttctggactgtccagaggcccccatgtagcaaccttatgtgctggatggctccccacagggaaaggaactggttataaaaatcactaaaataaacaccacacgccctcacgtaggtgttgacaatgaagtggcctgccctgtcgcggtactgctggctggtttagggaagctggggcactcagacctccactggtctcccacggtgtcctgaatcctgcctatcaccatccgctacagctctaagggctgtttctatgctatgcacctgaaaacagactcaacagtcagtgaaggaactgtggaagtaaattctgttcactgtgacgtcaggcctatttgcagccctcagtgaggcgtgtgtacaacaatgcagtttcctgctttacctgtttcttcactccaagattgcccctagtgggaacaatcaaggtggcagcggcaagagaaaatgttctgcttttgctcctctcaacatgctagaatgtgttcacatgaattcgccttttataagtagttactagtttgctttcatgttgcggggaaacagttacttcccaaatacagcaggcagactacatcgcagacgctcctcagaggagaccatcactacagccaggacgcccttgcagggtccacagctagactgccgtgttttggaatactcaaagctttccttggtcagttttcttactaatacccgctacttgagtgccttccaacttaatggagaggtgtgtaattctccctaagaaactcgtgtgatgagggccacgtggacagatggacgttccactcaactgcaatttcagttgtgcccagctgcacatggtgtgtgcctggctgccaagcccatttgggagcagagctgctgctcttcccaagatctcccacacgagtaatttaacctttatctaagttgtttactacttaaaccaacatgttaggggcatgttaaaattagtccacaaccctcccctgtaatccctccagtcctaaagggccatactcagtataaagcccctagctgacagcaccaagcaggtcagttgaggataaagccagttaccttaagctcttcttgccgaactcttccaggtttgcggcaaatgaaagttgccgcaaccttcatttaaataagtagcaaaaattcttgtcaatattctaagttacttctctaacttttagaagctaagaatataactatgtgtatgttgatgtgttaacagaaaaaaaaaaaaaaaaacctagtattattttacaactttatacaaatctacctgaaacttgtgtaccacattggaggaattgtagcaggcgtcttcagagctgacctctgcactctgtgacaccgagaatgccgaggaggctttcccgagtattcatctttagactatgagtagatccacagctccgaaaggtcctatgaaggtcactgaagaggtggtgaattcagggggaccgatcctgctggaaacttccatccctgcaccccacctgcccaaggtggctgaagcataagcacaaaggggcacctgagggatggacaggggcaccacgggacggtgctgatgtgggacttcaccgtgcagggtcacggttacggaggtgtgaaacctttccctgatgtaattttctcaatggcaggctgctttttaagtttataaaaagtaaaacacttaaaaataacaaaagaatgtcattactgacagccaagaaacttccagttatatggataacgtaaaaaaacaactatcaagctatattctttctcagaacaaattctgatttttctaattgggaggaagagattggtggacacgtagagtctgatgactcccagtctcgttttattgccgctgacaactctggaggagacagataaaaaaagagctcacgcgaccagtgaaacaagccaccctcctctcccggctttaaattcctgcaaaacactcttaggttctagaatccccccatgtattttttattaatgaaaactgagactgggtcctcttaggatttcagtgaaatgtgcttctggagcccacaccatgagttatccttgtgaacggtgttctccgtccatttcaccccaccagggccatctctgtggcagcacgtgggaacaagaggcagtgcttccacctgggcaccatgcttaacacagcatctggatttgggtttacaaactggcaacgttttccattttaattccaacggttagatgaaacgaactgtagaatctgctttgcagtcaaaatctgttcagatcctcagtgtttaagtcacttaatgagccatttagggagacaaaatactagaaattgcacctatcaaataccatctcaaaattttgagaattccatctcaaaattctagtcagtcaggtacatctcagaaaaacatttccaactgacttcatgcctcgacaataatgggaggtgaacagtggaaataaagagaaaaaaatggaataagaatttataaaaccacaaaagaaacatcatgatctttgagagaagttatgtgcaccaaatgtttacgtaagctaaataaactgtatatataagaaacaatttttaaaaacaaatgggaggaacaaggtgaggctgtgaaggacctactgatatcttagcagggggcacagcctccttctagcaatggcagagtgtctgtgcacaccaggcctcacctgttggacaggaacccccaggtcaaccgagtgccatgggaaggacaggagggtgcctaggtgcactgtggggagcagcagcggtagctccaccacgtgggtcttctgatggtatgtgtggtgaggcaagtgtgagtcagctcatgggacagacccacaccagcctctcacttccaaactcaccccctaccagggagggcgagctccgtggccagccagggaggcagggcaggggcctcaaaggcatacagtggtggcaggctccccagtacttgttgagcctacaaaagtgcagaggtgtttaggggagaggcagagacatggtagctgctgtcaccaatgtctctaactctgctccaatcaatcaccttttgggaagacaacatttacgggataacaaaacgagcagaagctactagctcaaaagtgtgtcgtccccattcccatcctatacaaattctggaaatccaccaattttaacttgaggtgatgtgttgggaaggttaacaggcaatttcccccacctcctgtccctggagcaaatcagcttcccagaggagctgatgtgtggcaaagaagggaagagggagaagaggtcagagtaccccgctatgggcagaagagcagcctcctggtcgacctctccccgctcacagtgcaggaggcaggcaggaagcaataacccagggctgagagcccctcatttccccatcttcccaccaatgctccctccccacaatgtacacggactcttccaactccacatgtggagtctctggcagcttttcaattttggttgacacagatggaaattaaccaaactgaaattatcacccacttatctgaactgaggctataaccgcagtttttcttttcttcactgttatgtgtctaaaaccaatgtacagctaaattttagtacagcattaaaaatccctctctgcattcacaggtgggtgacactttaagcccattagctctgtagaactgctctatcgtagaggtgctagaatctgatgaacatttgagacatttgctagcataaaattctcagctcaaacaatgtaaggtatcgagattcattataatgcagcaattgcatgattcattttatgtgcggctcaatttcttaggtctaggctgtttacatgatcaaaacgagggacatatttttcttcttttatgaagctactcatactcaataactgcatatttttagccaagcgctgtggctcacatctgcaattccagcactctgggaaggccgagttgggcagatcacatgaggccaggagttcaagaccagcctgaccaacatggtgaaaccccgtctctactaaaaatacaaaaattagccaggcatggtggcacgggcctgtaatcccagctacttgggaggctgaggtaggagaatcatttgaacccggaggtggagcttgcagtgagccgagatcatgccactgcactccagcctgggtgacagagcaagactcttgtctcaaaaaaaaaaaaaaaaaaaaaaaaaaagtgtcttttttgtaaggcacaccagacctagcataggtctgcttgcctgcatgagtgccttcccttagggaatctgctcaaagtctgacgacgggaaagtggggcactctgtgatcatctttgaattgagactatttaacctttcggtgctttttaaaaaaagcacaaaatgcactatagacagaaggcattaaagactgaattgaaaatagttttatagcagaaaactgagaaacaagaaaacattaaaattgcaccacagaatctgaggtttcaaagatctgtttgaaatatcttcatttcattaatttgaaatttggggcaggatatgatcttaagagtctaaacattcaagagacgagggcaagaaagccagtcacatgtagaataccaagtccaaggcacgcgtcctgcggtcaggacagtgttctaggtgtgaactcacttaccgtggggcctatgaagcaggagtgtgtggccttcgaagttcgaatgtgttcatgtgggtgtgtagcgtgtgaatcggacatggaaaaaaaaaaatcccctatctgcccagtcaaaaataaatgtacacctgaaaatcagatgcaacactaacttgcaaagattcccacaacataaaaaagaagtgatgctttcatgtgctggccgtggacaatgtggaaaaactgaagcgtatacagcgctgttgtcagaacaactcatgtgcagacaggggtggatgtggcgtgccgggcagtgtggctatgcaatcagactgggatgaagagaatacgaatacttaccagagcctgagagtgaaaacagagattaaagaatcaatcattaaggtgaacgttcaccagtgaggtttacagctttggaaaacagtgacaggaagtcctgacagactagggatggacacagggcagcaggaggcatcctggacatgggctctgcttcccgctgatggtgcagccggtgtctgtgatcagcttaacacaaagctgcaactcccagtcctggacaggcccaggggatggctatccagaaagaacgggaggggtccaggaggccaacccctaggtgatacatacatttatacaacagtgacggcgagggagcagcagtcttttctggctttactgcattgtaattgtgatcgctcgcccacgacggcgtgctgctctcacaagctgcttccttcccgagtgcttcactccgcgcagggaccaccactgccttcttcactgtggtctcttttttttctggagctggtctcttgtgcacagaagagattttaatacctgcctggataatcagtaaaaccccaaatcattaaaaaggtaagaaatcataccttcacttcatttcactgagagatgaaggcggggacccaatgtcttcctgaggccatctgaagaccctgcacccatcctgcgcctgcttggcagcagttcaacacacttgcgtattcggtgggcccgcggtgggcccgcagtttccccgtgcaaaactgagaacttcaaccacttgtgctccgtgaagggcggctggcacagagtcacctgcaaccctgatgaggtgccaagttgccaagatgacaggagcagcagccactggacaggctgccaagatgacaggaggagtgcggcaatgaaccaaatgagccaaatgagaggaaaggcctgcgcgcgaggctgtgcccaacgccgagggttcaaaaggaccagccttaaaaattaagtcattcaaaggctaaataatcatttgaaaataatcaagaaaactccctgaacagtgctagttgcgctttgctggtcacaaacataaccggggcagtgacacagccaccgccgcctgagcctcacaagggccttcaagtctaagacaagagtttgcgatctctaaacattccaaataacacggagttctttccaaataacacggagtacaaacatgagacaactctgagagccgggtcttaaatgaagaccacagccttgccccgaacccgcctcccactcctacctgcctgcaagtctacgctctacaaactccaccgggtggttaccaactcttctcacaagacagcagggtgtgtcctgaagtcttatgccccccgtacactgccattgtcagcatttgctttactgcacttgtgttaattaacccctcagctaacgggcagagaagggaaaactggtgggaaggtggaagacaaaggtcaaggcgacaccacgtgtgcgcccccctacacctgccacccccacacggtctacaaaccaacagttctgcgacaaacgctctcacgcctgtgcgtccactgcctgggcggctggtcctggtccactcacctgagcaccgcatttcggaagactgggcttctctggcttcatcttcatcttttctttaggctttggcttctgttctttacctgagcttagaaacttcattgtcgctgcggcgtgtttgaggatacagtcattactgcagtacaccgagtcgggctgcgccacgtgacagcacccggggccaatacattttgaggcaccaggcgcctctatcacctgcagaacaaaacagatgacttcaaacaatgtacttgccaattttaagcagttaagtgtgtgttttgtaaaatcaccatttatagtaccaaggccacagtttcaaaatgagatactaacagtacttttaatatgaataaacattttgttgattcaagctatgaaaaagccaggtaaggcattcacactgtcactgcccgtcatgccctgcagggggcaggagtgtgaggagacccctggactgccgccctctgctctgtgcacccctctcgagggtgggcggggcccacgggacctcacatccacgatgaggctccgctagaggacccacatgcagggcttcttcagatgtaattaaggatctaactgggatgactgcaagtcaaatgggtccggctaaatcaggtaaaaacccttaaaaaaggaactgggtctttcatgaagagagaagacttcatagctggttttgaagtaagcttccctgctttgagaggattagctgtggctaggatctgagggcaaggctgccaagtaaaatacagtatgccaatgaaatcggaatgtcagataaacaatgagtaatttttcagtgtaagtatgccccccaaattgcatgaaacatacttttttttttgtttgagacagggtctcgctctgttgcccaggccggagagcagtggcacaatcatagctcactgcagccttgatgtcctgggctcaagtgatcctcccaccccagcctccccagtagctgggactacaggcacataccaccacgcccagctcattatttatttttttgtagagatgggggtctcactacgttgcccaggctggtctcgaactcttggcctcaagtgatcctcccatcttgacttctcaaagtgctgggatgacaggtgtgagccacagcacccggccagacacacttatacagtaaaaaacagcgtgagggcttctggaagggaatcccctgccaagcctctggagaccacagcccccgctgcaccgtgactgcagtcctgtgagacctgagcagcaggtccaggcttcccatggaaatggaggcataaatgtgagctccttcaagccaggactgcagtaactcatcgtgcagcaggaggaaactcacgcaccacaaacagcttgaccactgctgtttacaaagtctgtctcgatgatcaggcctcaacacacacgaacatgtccctcacacatacttaagcgaaaccttatttctcaaattaaatatttaacataatcagttttcctccacagaatctaagttttattgagaatacaatttaggtttgtgcagggtattgtcaagcacaatgacaattaaaaaaagatgttgggcgtggtggtgtgtgcttgtagtcccagctacttgggaggctaaggtgggaggatcactcaagcccaggagatcgaggctgcagtgagctgggactgtgccaccgaactccagcctgggcaacagagcgaagcctcaactgcacaaaaaacagaatcaatatatttaaaaaataaagacataaagccaatgacttttctcatgaattcccatctccattcatctctgaatgcccagatgtggcctctgatagcagcgcagcatgagccttcagcccctcctgcctccaagggcacgctcccaggtgcacggcccagccttcggacatcctcaccttgcagctaatgcagtgcaagagtgtgaaggcagagatgcttctagacacagcaatttccaatacctgccagaggacaggcagctgggtggggacaggcccgggaccctggagggaccagagtgaaaacacgccaagtcacacctgccctgtggggactggaatggagactgcaaacacaagacagcagcagaagctgacagcatgtgggaaatgtcataaacatcagggggagagaattaagtgtcaacacagctgcaagacagagaaaccactctcaacacaagcaccccgaggagccagcaccagaaccacgaggcagctggagacagcaggtgacacaggagcaccgccactcccatcgttcagaaacaattcctttctgctaatgcatacaaagcatgtaagcaacacccaaatcctcaaagatgggctgatttcaacaattaagtcattaatagtagaggaggtagacagggtaagaataaaaatagaaaggcctcacccaggtggagtgaggcaggaacccgggagaggcaccgccccacatgggtgcagcacccgtcctgggaggaatttctatctagagcgagactgaaaccagtgaggccgactgctgaatgctcgtctcagcggacaaacacttacaggctggaagatcttgagtttcttcttgccacttggatttgcagctttctcaattctaccctttatcccttggtcttcgctagacttctgctctattgttcctatacttgtacaatcggtgccatcagcatctccaggtctccatttagcttcctgctgatctgccgtttctgaatgagtctcatcctgcacttgcagaatggtgcagtttgggcagatatagtcttccccattcctttccaaaagcctccctcgagcctcagaaatgcccacacaatcgccatgaaaccattcttcacagcggtcacagcaaatcataaacctgaaattataaaataacggtattagcaatgggacgtgagtgacaagcacttttcaacacattaataagacaattggttttaacttcatgaaaaaatgcaaatatacagaaaagtagagattaagaacgtcctcatgcctttcctttgattttaacattcaaccaaatttacttcaccgttttttaagagtagcgcattttaggagcaaactctaaggcattccaccacagatacctcagcaagtctccccccaaaactgcgacaatgcctttatcccagcgccaagccaacaggctgcctatcaccgtctgacacccagtcctagcagagatcttttgagctgccccaatgtttgcactaggacacttgcggtctgcacatgcccctctgctatgtctcccaaggggcagtctagaggagcagtctcagacagaccccggagtgacggacacattctcctccatgccgtctacacagagccactggctgcacgtggctcacgtgactggggtggggcgctattcacctcctcacttgactggaaacagccatgtgtggccagtggctaccagagtggagaggtggctctaggaagtccttagccactcttatgtgtttcttttttgacaacttgttcatcttttccaacaaatcgctcatccagcccagctttgtaaccctttaaaatgaaaacaaatggaaaattctgtttgcaaccctgggatttctgtgggtgcccacacatgacccacctgttgttgtgaggctggcggcaaatgcaatacagggcgttggggtcgtaaccctcacattcaggcttcggtcggcccaagtctccaggctcctcatctttgatgtcctgagccgcctttccctccaacttactctctctgtcatctttcccagcctgggacacaaccccctgatcgttctcgggctcctgcttactgggcaggacgccctccacagtgtcactggcctcggagcccacagtctcggcgggaccctcctcccggcgcttcttccgcaggcgactctggatccctttcaggggcctctcagtgggctcctgttcccgcttcctgcgaaggcgattctgaagctctttcaaggtcaggccatcgctgtcactatcggaggtgtcatcgtggtcatcccctcctttcaccttttcagaagaggctggtcgttccttcacagctgtggaagcagactgggggccgcttctggtctcagaagcgctttccacgctgccctcggaggctgtctcggcgtctgtggcggggcaggacgtgggctcaccagaatcctccagggagacaggcatgctcctcctgccgcggcgccgcgcaatggtcaggaactgctccacgcgctcagtgcgcttgggctgcctcccactgcgccgcagggacaggcccagctgctgctgtgggggtggcggctccagtgggtcagcctccgcgtcccctgcgccctctcgcttggcgatagtggtccttcgaaaaccccatgttttcctgaactctttgctggtgggtttgatggccttaggtgcctcctcattgctcgggtcgcctttgtcgtccatacctagcggtaaagtgtaagcacatagtgaccaactgaccacagaacaaaaggtgacattgccgccaaacacgcgcagcaggggccacctccctacaaacagtggagctctacataaagcaagtccttctgaccagtgtttcctaatgtgtgctatgtgagatgattcaagatgatttgtaaagataattttaatatagttaaacaactaacgtttagacaaaaatacagctaacaaatcaaatgtacaatttcatcatttaactgctcaggacaaggcttcacaagccagacagtagggacaaataggaaatattggacagtatagcagggtaaggatgtgagtaaggacgtgagcaaggacgcgagcagctcggaggtggcacgagctccccagcacctccgcaggcagatgggctgctctgaccacaagcacagtgaacaagacgctgtgccagtttgggtgtggcctgcaaagggacccaagtctgttctggacttttgcaagtatgggctggccaccaccatgctgaaaagaggatatgaagaagctgagtcccgactttcagctccccaaccaggggctggggccaggaaggatgctatcactatctgggaccctccataccagccctgctgccaagtgaatgaccctcacgggcacaatgtgagagaactgcctaactcctgacccaacagattgtgtggtatgaaataaaccttgttttagtctactgagctttggagatattgttagcagcaagacaactgggacacttagaaaacatggtcaaggcgatcactttaaggtatatttctttttttttttttttgagacggagtcttgctctgtccccaggctggagttagccactgtgccaggccagtatatttttttttctgtattatttttcactttcattctaatacattactaaagaatcttatttatgaaacttttactcttgttgaaatgacaaaaatctgaaaaagacagtagatactttgagaattcttttccaagctgtccaagctttaattacatttcaatgctaatgatgactctgattttatgccatgttccatcctgggggaaggactggcataaaatgaaagccttaaaaaatatacaaaatggggccgggcctggtggctcaagcccataatcccagcacttcgggaggccgaggcaggcagaccacttgaggttaggagttcgagaccagcctggccaacatggtgaaaccccatctctattaaaaatacaaaaattagctgggcatggtggcaggcgcctgtaatcccagatacttgggaggctgaggcaggagaattgcttgaatccaggaggtggaggttgcagtaagccgagatcgcaccactgcactccagcctgggcgagcaagactcagtctcaaaaaaaagaaaaagaacgaaaatacaaaatggaaaattacttgcaacctgtaacctgtgttgttctttttgcttccctctaaatgctgtcacttctcattttcctgtccagctaaagatgctgcctggccgtggcctccacgctctgtaaacatgacccacaccccccagggcactccacggaagccttggagataagggacacatcacttctatgctcacctgaagtgaccccattgttaaaggacacagctcaactcaatcagggcaccagcagcgactccaagtcagggtgcaaactctggaggctgctgtgtgaggggggcactagagatggtggtaaacagaaaggggggcttccttcaccagccaggtgaccccaggcaagtcacaaggaaccgctctgatccaggaggcaatgctgacctcaaagattaagggcaaagcagagaatgctgcttacaaatatatatggtagagcaattattaaaccacatcagttaaaatggtttattcgttctcattggaaattttacatttagaagaagttttctgcttgtgcaagccaaaatatttgcaagaaatatgactgtcatctcaaaagagggtcaagctctcgttttcatgcaacacttggagtttctagtaaagatgtagtctgaggggctcgcactagcctttgcccagaagggcacaaagttgcagtcgcctctgcctctgggggcctatgaagctccaacccagctgaaaagggctgctgcatccatgctggtagctttctacaggaagagctctagtttataaaactgggttctcattaaagagagaacaggctatttgcacatgacctatgcaaaacctctcaaatatttagatcatctctagattacatcatagaaacagttgctgtactacactgttttataacatttttattattttttattgtcagattattatttattgtttgtcccccaaatatttccaatctgcagctggttgaatccacagatgcagaatctgctgctatagagactgctgatacaaatggctgaatgtatttcaaatgaatacgaatactacattctactatcagtttctttacaaatgccactttataaatagcaaatacagacttattaagttaaaattttgttgctactaacagtgttgataccttacctgctccaacactgaaagcttggacacttttccctgaaatcctaaatacaaccaaaaaccctggcagacgaaacctctgggtccaagcagacagccaggctcacaacaacactgttgtcagccactgttcacgagtaacaggcttcgtattttcaacaactcagattatctagaggctgttcccgtggagtaagctcctaaaagaaaataagaaaatattttacatatcttaagtaaactacgtatcgacaacaattaaaagggagtaccgaacttctcaagtaacctattatttgagtgatactgtgtgacccacaaagacagcttgggggttgaaaaccagcacgcaagcagtgtccttaaggacctctacccaggacagcagatgctaccaacccccaagagaaaggggccggggcagcgcaggaaggagtggagtcccaggcttgccccagggaggcaggcagaggcccagccagaccagggccagagaggagtcgccaagcatcagcttcttttccatttggagcctatgtccgagatggaccccactcaataaaatccaccacaaaacagaggaacaagaacaaaaagtgaaaaggctgaacatcgaaattatataagaatgtaataattgaaaattcttaataatgtatctgaattattttaattaaaaacaagaaaaattttagaatactaatgtttgtgacgtactaaaatcaacacgatacagttcaccacgtgtgtttaagaaacaattctcttgtatcctctctcaaccagtcacatcacaacactcaaaggttccaggtgccgagtttctagctaggtccttgccccaaagccgacacttccaaactgagccccagctctcacctcttcctcagcctcaagaccaactgccttccctctgtggtctccctggcaacctcagaacaaagggacaaacattccaactcccctccttttaaagggacagtgacaactgggcatagtgtttcgcatctgtgatcccagctgcttgggaggactgcttgagcccaggagttcaacaccagcccaggcaacgtgtcaccatgtagacaccccgtctctacaaaaaataaaaataagacaggcattccctctgataagccaaacggcatcgtcatagtcaccatctcttcaatgtggtaaaactatcatcctcaaaacaattacttcaagaattcagaaacgactgctcagaaaacactggaaataaacttttatattttgcaacactgagcatttaatttattttactttactttttaaagagttggcatcttgctttgttgcccaggctggagtgcagtggcccaatcatggctcactacagtctcaaactccggggctcaagtgatcctcctggcttagcctcatgagcaactgggactacagatgcgtgccactatgcccagctaatttttgaaaaaaattcttttagagacagggttttgctatgttatccaggctggtcttgaactgctggcctcaagcaatcctcctgcctcagcctccagagttttggggagtacatgaacgagccaccatgcccagccaacactgaacatttataaaagcaaagaaattaagaagttctcgggaacgaaaactgatttttaaaaattcaatttatgttaatctgcgaataaacacgctactagatttgagttctgagtaatcagaaaaatgtagttatttctgttaagtagaattcaatgaaggatataccttcggaaaagatcagatcactttatatttacaaaactgatttcataatgtcttcaacagagaaaatttactataacatttcagtcagcttgtaaaataaaaacatatgtatatcaaggcacaagcaaaaaaacctgttctaacacaactttttgtgtgtataattagtgtgtaattctacacactacacagcccatcacagggggaatgtgttcataaaactgcaaccatattgtatcagtaacaacttttccccagaaagaaaaatgtgggtatccttgaagctgggaagtgaacaaactacaggttaaaacagaatgtaccaaatttaatatttccacatttctaagcacatttttttccccagctgaaaactgcttcattttctattgactagaagcagctgatgagcggcgattcaagcagaggacacacactgacttccaaatgcttgaatggcggctctcaaaccttttgtctcaagacacttttacaagttgagaacaccaaagagcttttgtttatgtggaatgtattgctattttcaaaattctaagtatgtattaaaaataaacctattaatacattaatagtatctttaaatgaaagttatttctaaaacaaacaaaaatgaacaggaagagtggccctgttgtacatttttgcaaatttctggcataaccgaagacagctccatgttcatgtctacttctgccctcaatctgttcccatagagtgtttcagctaaaacatgtcatcaaaatcttgcctcacacagataggtctttagaatggagtattgtaaccatcttcacataactggatgttcactgatactacaccaactctcgccaaggagcagtttcataaaagttagctgaaacagaatttgcagcctttgtcaaggaacttctccctttctttcatgaaaactgactgctgtgttcactctgaacacgtccttgcactctggacccatgtgcatgctgttcacctggatgacacgggttcaagtaacagacagattctcaatgtccacacatctcatcggatagcataaaacaaacattttttttcctgttgcccaggatggagtgcagtggtgcaatcaaggatcactgcagcctcagcacctcccccacccacaccaccgccaggctcaaagcggtcttcccacctcaccctccccagtagctgggactacaggtgcatgccaccatgcccaggtaatttttgcatttttttttgtagagacagggtcttactatgttgcccaagctggtctcaaactcctgggatcaagtgatctacccacctccgccttccaaagtgctgggattacaagtgtgagtcacctcacctggccgataatgtcgggtccaatctccaagaagactttaattactagaaagccatcaggtttacaatggcagatacaagttttctaaaattccaattttcaccccaaagctcaaattttatccttagcaacaaatactgttcgttttttctttgagacatcactcgttttggacaaaacgcctgccacatgctgagtctgaaaactgtcctccgtctgttgttctgtcagggacagacagcgtttccgagaccactcggctcccagctcaatcccctagggctgtgcgtggacagtaccacgtggggatgcagcagaagctttatatataacttgacatttaatcacagcgaaagtaaaaaagatgtatgtttgcgggttccgaaaaaaattaatatttactgcatcatcagggacattatttgggaaaattggcatattctaaacattcggtgcccatgcacggtgctgaagagggctccaatctgccctgtgccaccgatgcaaatgtcaaactcaccagaaaaggcctgtactattagactattattatgcagaagtcatctttacctcttagccccagaaagggcttcaaggacttccccctcaggagtccatgaaacacaaagaactgtggcaacatgccatttctaccagtttaggagtacactggatatgtgcaaagcagtaatacatacctatgcttcagacatcagaagagactttaaacatttccttccacaagggttctgtaactacctgttaatcttccctcagattccccaactcaccaaaacagtaagcagccaaaagtgaaatttcttaaaaaccaaataaaaatatcttcccaaaaggtcagctctgttactttaaaaagcctaactgcaactattacaatgcatgggtttgcaaccactgcaaatctgtatgctcaacttttactactctaaaatctgcttgaagtcattaactcaagcgtgcccacttccaggttgtggtacagctgcatgatcagggctcactgcagcctctacctcataggttcaaacgatccttctgcctcaacctgagtagctgggacaccactggcgtgagccacagtgcccagctcccacctaaagattttcagttccaaaaacttgagactagtttctgagtaattaatctccaagacactttaaaatatgacatacaaccataattaagtttctattttcataacatcgcacctccaggaaaagagctctgacttctaagcaaaaagataaaacaaaaatgcatagtttacctcacctagtggcaaacattctgtttcttcaaacctcacattcccctgaaacaatattcaaaacaattttaacccgccagtcagaaattataatgctacaataaaacctcactattctaaacttcattattttcgctaattctgacagggtaggccaaagtttacatttatttatattttgcctattaagggtctcctggctcatcaatctgtttattatgcagatgaggagcaactgagaagacactaggtaaaagatctttaaactaccacaaatgaaggaaagattacccaatgaaagactcttgatagctcagttttcattaatgcgacagtcactaggagaatatgcctagaaacttcagatgacatccccaaatgcgacgtgttctccagccaccagcagcagccgttcatgtaccatgatggcccactcaaagctccaccagcttgcggcaggaaacactgtgctgcactcaccaaacaggaaagagatttgggcccacaaggaactgaagaagcccaactttcatttactttagtatctatgcagaatctgactcaattgcatagattacatttaaatccttcagacggcaaattcaaagttttgctgcttaccaaataataccgtcattacaaaaattattctgggccgggtgcggtggctcatgcctgcacttcgggaggctgaggcaggtggatcacctgaggtcaggagtttgagaccagcctggccaacatggtgaaatccccatctctactaaaaacacaaaaattagcagggcttggtggcaggtgcctgtagtcccagctacttgggaggctgaggcaggagaatcacttaaacccgggaagcggaggttgcagtgagctgagatcgtgccactgtactccagcctgggcaacaagagcaaaactccctctcaaagaagaaaaaaaaaaagcagcaagggtgccacaacacagtatgtttctcacaaagaaaatgtagagaaaaatccagaaacaacctattgttgttttacatttcttgggtatttgtgtttttatagatacgcggagacaaaaagcaaaacttgttactgaaaaacctgctgaggactaatgctttggccagcccccggctacagccgggccgccaagctccccatgtgagcttgcaacaatcctgccatttccctctatctacttcctagtgcaaaacacaggctggtgaccttggtgggcaactcaggtgggaaatttcaactctccaaatgaatgccaggaaccagaaacagtcacataaaatcatttatcgaggtgaaggagaagtgaggtttattgttctctatttaatggctggacataaagtctcctaaaccactacctttgatggactcctcttgtctcagtaaaaaagaaagtatggtttcaaacacttaagatacggtcccaattctacataccaggattcctgttgctcttaataaaagattaccacttgggccctggtgaggaccacaatgcacaggttcttatccccatgaagaaatccacctcatgccgcaagtgtggcagtgtgagctccccgggtaccatgtgagtggggtgcgctgcgggaggtcatcccagcagggtactgtgggggctgcttcccctcaagggcatctgtttattacaggtttaaatcactgttcctttatgttctcctcggtccacacccttagagacctgcataattccatggccccaagcacagcctactcttgcctccccccaacccccgattttcactgctgcaaaggattcagcaaggggctgtgtagggcactttgagggagaggtgtgtactggaacagctttaccggtgacagcgcatcagattgattccacacttgccccaaggggcaagcacatggttgagccactaaaaattgttcaaagacacagcttatcttcctaaaagtaatcaatttccccaagtgtttagagctattttacaactcttagagaagtggttctcaaagcgtggtccaggggtccttttgggaggcccccggatcaaagcagtctgcacaacaccaacattccatgctgtttccacagccactctgagtatatgctagagcatttcagaagctgaacggagacactaagtttgaattcggaaggagaatccagaagctgtcagttaagccaaacagatttgtgaaaacaaaaccatctttctcattgttttcgtcattgaaaacaggttccactaaatggtttacttatgttaatatataatggtttacaattttactttatttatttgagatggagtctcgctctcacttaggctggagtggagtggcacgatctcagctcactgcaacctccgcctcctgggttcaagggattctcctgcctcagcctcccgagtagctgggattacaggcgtgtgccaccatgccgagttattttttttgtgtctttagtagagaaagggtttcaccatgttggccaggctggtcttgaactcctgacctcaggtgatccgcccaccttggcctcccaaagtgctaggattacaggcatgagccaccgtgcccggctggtttccaattttaaatagaaggcacttcagcatttaaatgactcatttttaaatgtcaaacatggtgactatcaatagatataacaaaagctctttggggtcttccctgctttttaggagtgtaaagcagtcctgggtcctgccagtctggtaaccgctgacacagcagcgccttccactgctggagcctgaaaggctgctccccgaggccattccggttcagtcaggatcctagtggcagtgacaggtactgctttagcattcactttttccagacaccctgtctactctcattcagtttcatgtgattactgaccaggcagggattgccaagtgagatgatggccaccctaagttcaggtggagagaatggggtttcttctttaaaaacccttctctcacaagaatttgcttctcaaattggagctgcagccaattttttttttttttttttggagacagggtctctgtcgcccaggctggagggcaatggagcgactgatcacggctcactgcagcctcaatctccctgggctcaggttatccttctacctcagcctcctgagtaactgggactacaagcatgcactacaatgcccagctattgtgtgtgtgtgtatatccacaatatatatatactatatatatccactacatatacccgctatatatatatccacaatatatatacacactatatatatatccacaatatatatacactatatatgtccaaaatatatatacactatatatgtccacaatatatatacacactatacatatgtccacaatatatatacactatatatatatccacacaatatatatccacacgatatatatacacacaatatatatatacacacactatatacactatatacacactatatatacacactatatatatacacacacacacacacatatatacatatatacacacacacacacacaaacaatgcccggctcttttatatgtatgtgtgtgtgtgtgtatatatatatgtacatatatatacacacacacacatatatatatatacacacacacacatatatatacacacacacacaggtgtctacctggcctgtgtctccagggtcttgggagcatctctggggcctactcccctcagtgcaggttcagcattcccagtcctgacagctgcagccagcagtgcccacccccacccagacatttataaccaggacaagccctcagttaagcagatggggggctcactcaagggggaacctgtctatgaatgcagggttcaaccccagctgcaaacgatagcgggggtgggggggtacagtgtaccaggcagtgtatctgtctaggaacgcgggggccacagggtatcaggcagtgcatctaaggcctgcactttcctgtctgtgaaatggggacggtaacgacctcacagcttcctacaaggttttctgaagcgacatcctgtgccaaatcatctgcggcaagtgtgcaacagacggtaggtgccacctaagaaagtgacacagcctgtgctggcgagggcttggagagaaaggccctcttaggcgagtctatttgtccgacatatttgccaacagccctttatgggcttggcacagggaagagagcgggtgacatactgttctcatggagggcagggagtgcttcacgatgacccaggagaaattaagtaggaagtacacactaacttatgagtgttttttttctcacaaaggtgacaaactgaacacaaactaacagaccagtttgaaaaatcaagaaacatctatatagtgaaattctttttgttgggggtggggggtggacagagtcttgctctgtcacccaggctggagagcagtagcagaaccacggctcactacagcctggaactcctggcttcaaggggtcctctggcctctggcctcagcctcccaaagtgctgggactacaggagcacatcagcatgcttggcctaattattattattttttttttgagacagagtctcactgtcgcccaggctggagtgcagtggtgcggtctcggctcactgcaacctcgacctcccaggttcaagcgattctcccacctcggcctcccaagtagctgggattacaggcacgtaccaccacacccagctaatttttgtatttttagttagagatggggtttcaccatattggccaggctggtcttgaactcctgacaagtgatccacccatcttggcctcccaaagtgctgggattccaggcacgacccaccatgcccggccgggaattctttaagggtgatgaatcatcacatgcacagccgtgagaaaaactccctggcacctgagtgagagccgcagacaagccggccagggcagtggccacagcctccaacgcatcccgttcactagtgcaaaacagctgtaacgtggagcttttctggacagcaccctttctagtgtctttactttctatttttacataatgtttaagtttcctgtatgtgtattacttttgtaatcaaacacattaaggtatcttcattttggaaaaaaagttgatttaccttattataaaggtatattaagtaccacttaaatgtctatatcagcatacgcaaaacaaaaccacggcatcaaaatttgatacccaaggagagaaatgcctcctttacaacttacacacgattacaaccgcctattaagttttatggacatggttacagaattcttattaaaatatgtacaattacctattcaacttcatataacaacttaacctcaaaattactactcaaaaaataaaatgaggcctagacaacacagactgtctcacagatgactgtgtacacgtacatgaaatgagcaaactggactttgttctttgacctcctctttcccaattagtacatttccattaactgttaattatagaacttttgtaatgcaattaacacacatcatttgatagtagtcataaaaaggctgatcttagtatccactgtaagggaccccgtcatttaaataagaaatgtaagtgagagactctgtttagagagaattttctagtggtcttctgagcctgccagagagatgagacctctcaggcaagggcacagtgcagggacccacagatagtagggagtcacctgttaaacactttcaatcttagctcttcaagagccaaataagccacttggtattatgggacaggcatataaaaaggaaaaacgtgtcttgtttacagagattccaaacaatgaagacgtggcacagcttaaaaataaacactgaagagaagcaccctactgggctccacagaactgaccttaagggaattatgaccctaaggctgtagaaaaactcacagtatcaacagcagaacctgccaacttcaccgcgaacaaaacgggagccaatgcccattccaatcatttcctccttacatgaagaaaccccagcaccctccaaggcccaaccgatgatccgcacgtcctagacaagcctttgcgaggctcacatatgcacatgcaacatgggctgggctgtctggtaaccatgggtacggctgggcagtcaatcacaaattatcttatttgtgccctgtcttctcaccacagcacaatgagctctgcttgacatagtctgaattcaatcaactactaataagggacagcctctggtggaaagcctgaaaaaattcaagatacgcgcttttccaaaacaagaggtatcttatgaaacttgctgaaacaagtctacaagaacagacatctcctccccatgtacacagcaagtaggaaaacaagtgtgcattaagcagggagtttcacaacagggctgtgtctgtcttcctgggtgacacttctgagatgtctatgccgtatttaaaatagtgaaatagtcacagacacacatacactaacagcaacccaaagggccactaaagagccctaggctccaggtaaacgagttggcaacacctgatttaaaggaaggagctggaataatctctcaagttccccagtgaacttgtctccaggactgggacaggggccaccttggtcactgctgtatccctcgtgctaacagtaagcaatgaatgctcatttaaaaaaagactgtatttactccttaaaaggcactgctaaggacctttctcagaactgtatttcaaccaagtcatatgtggccctacggaaaccatggaacacggggtatatagcaaagttatgtgaatataccgaaaagacgttcccatctgcctttccctcctctaagtccctgagtacactaggctcaaatctcattccatcagcagacagatgacacggatatcgaaggcccaggcacaagttaaagagtattttcaataactggtaacgcagtaagctactgctacctgtggcccaaactctaaacttatatattaaagtcctttatttagagcagaaaagccggccttgacctccactgtctcagaaccgcgagaaggagccccggacgccgcagcggaggcagcacgagcacccctcccgccgagcgcaagagcgggccctttcggcttccggggtcactggaaggcaaaatgtgtcacaaatacggccagtacaaaccaacgcaacaaactattccacaaaaaaactgaaaaccagcgcggggaggtaaggacacactcttcagaaaagcgaatccgggctcttcgcgcttcctgcagcgccagccgcccctgcagtgccggaatcccccgaaggcacgccagaagctaagccggccaccccgaccgcacccaaggcccgggaggaagcgccgaggtccccgagaatgcctagggaaaccagctgcgcttacaagccagctacgcagcccccgagccccgggccgcactcgcccaggccagccctgcgctcttccccgcgagcggccgccccgactcccaccctcggaaccgttccagccgcgaccaccgagtgctcgccagtcccctcgacctcacgcagcccaccagggccggcgtctgaggcccgcgccccaggccgcggcggctctgaccggccccgcccgctcgcccgcccgcccgcccgctccttcccttccgcggccgccatcttctcggcgggagcggcctgtgcgggatccgcggctctcgccagccgggctccgatgccggccccgccccgctcccgagggcggcccaagcggcggccggctcttctacccggcgcccgggacgccacttaccgcaggccgcaggcctctagggtctcgcagccatttccccgaacgccgcggagtgggcggacggccaccgagatggcgcggggctagagcggcgcccccgcgcggcgggcggaggacgagaccggccaccgagacgctgcggggctagagcggagcccgggctgcgaagcccggccccggactgcgcgcatgcgcccgtctttcatacctgcactccggacgcgcccttcgggtctgcactgacaatgacttgcttgcatcctttgtggacaccttatttccccgactccaagagtgaaagctggggcagtgcccttgcggggatccctcggaacagcccgggcagggcgcaggcggaacgtggatgctagccccgagggactgcactccgccaggatttcgctcttaagaccgataaacccttcaagtcggtggggatagaaagctcctgggctaaatttgtaagaggtgtaggggggcggggacaggggataaaagaagaaaaggcccaggttttctcttccagattgtgtttctcaaaacgcaggcccctgacggcctcggctgggaatggcagcgaggggcgaggtccaggtgtgggcggggtttctctccaacttgaagaccctacctgctgcctccccaccccaagctcggctccagaaaccaggagcgtgggggtgggggggagagaaaggagcacagcgaggaagggaggcgggcacgctggacctctaggccccagggaccttggcggtgtggtcccaaagctctgcctcctcccaccatgtcaatcctacactcagaactactgaccagtagctagaactcaaagaacgcatggacatgtttgcccacaggggttggagggaaagattagacacttactatcaagagaggggaaagtgaggtatggtagatgtcaaccttccatgtggattttcttcagttcgctcaatagtaactagagtgacactctatcacctgtctgtccccagatactgcaggaaagagactgggagggggcaggaggggcagctgttgcctcgaggcaccatgggcactggccacttgctccgagggcagggacctggggggggtggaggtggccccattacttgtttctgcttctgtgaacagtgatacgctacctggaagcatggaccatctagcctttggcgttggccctggccaagagtaaaaggggcccagagtgccgtaaagctgcccctaatacagaggcttctgcgatgcttccatggatgaaccaggggctttgaggcaggtgtgctttttaataataccgctgaagattacagggtctgctagtttctgaggcagacttagttttcttcaaaggaatacaacgcagcttgtttttgctggtgtggcccattaggaccacattaatagaatctggcagggatgggcttgacagtcttccatcttgagtgtgatctcaggttgcaaagagggctttttgctctcagacatggggtagtgggaagcttagaagacagacggggttgagaccacctttaacaagcagtgagatcttgggcaagctctctgttaaaggagggctcacatgctgaggcccaggtgaagaccacatgaggcctccctacaagaggctctctctaaatccaactggtatgggggaacctcagcccagtctctttagctgaggatctttaaaccagccacaatttgtttctgcaagacggtgagatttttaagagattttaactcttgggtacagtttcacgctgggcactcaggagagatagatggaaaggcactaagggaatagaaagagtggacaaggcggctcagggacaagagaaccaagaggaagaaaaaggcaggaaaacatgaggaaagggaaccctcactcagctcaccgcagtgctcagcgatacgcagaatgccttccttcctgcaagtccagaggatactggaacctgcctctcgttctcatctcccccgccccccagcagaagctggctcggctgtggaggcctggccagactatccactctggccttccccacctacaaggtgacgaagtcagctttatcccagcttacctgccgtcactattcctgggagctgccctccctggtgagaaaggcatttggagaatctacagtctgggtatttgaatttgaactccactagcaaaagaatactttttcctaaccgaatttattttaaaagtaaaacccaaaggaggaaacaaactcttcagttgtttcaataaattgttccttaaatatccccaattcacaaacaaaaccccacaagtagcaccgatttacaacaggatgtggcccagaaagcaggaagggggccaagagcgctccagcaggaagcttaataggtggtccatggagaaaaacacgatgggtgcatcacaaataggtgtaaacagtacacttttgtaatgtgtagacaccagtttctgcaacccccatgccacgcaaagtttcagggaaagtctttgaaagtacaatccggaaaactcagcaattcttaaaaaaaaatggctttccgctgttataagcctccttcctaagactcagggtccgcagcagaataccctgacccaaaataaaaatactatgacaaaaatactccaggaggcagccggctttacttcgtttaaagccggatttcgcttagtcccgtgaaagcgaaggagcaccagcgcttcctgattccgcacagttctctcggcagagacggcccgtcctctccaagaaccggaagccggacagcgtcaggacgttttattcttctcacctgggattcagagaggcagcggccaaggacagggcccccgccgaggccaccgggcagcgtccaggtctcggcctttgggaggggagcagcgggggaggggcacggggaggggcgagggcggggcgcgcctgggcctcggcgctgggctcctcctctgcccgctccgggggacacccacaggattcttgcagacctctgccgaggcaggatggaggcctgcagggatgcaccgcgggcccgcgacccgggcggccggaacatagttctttctggccggagatcggcccggtcgtgagtcgtgtctgtgccaggccccccacgctgtgctccagggcctcagtgcccggcgcgccgggggctgtatcgccagccacttggggcaggaaaaaggaatcacaaaatacaaccctctcctttacccaggaggagaacgtggattcccagaaaaaagaaaaagtgtatatatatatatatatgcctactgttttcttattgctaacaaaaacttcagccactgttttgttttttttttttgagaaactgatgaattttctttacttttacgttgtataaggccagctaactttaacagttaattttagataaatcaactcaccaatgctaaaaggtgtcacaatcaaatcgtccactacttcccctcaaagcaaacacgaaagcactgcctttggctcctttgaagaatactaaccagatctgccaggcgcggtggttcaagcctgttcccagcacttaggtaggccgaggtgggtggatcgcctgaggtcctgaggttaggagttcaagaccagcctgaccaacatggtgaaaccccatctctactaaaaatacaaaaattagccgggcgtggtggcaggcgcctgtaatcccagctactcgggaggctaaggtaggagaatcgcttgaacccgctgcactccagcctgggtgacagcgagactccgtctcaaagaaacaaacaaacaaaaaaaaaaaaaacacagatctttgtctaccaaagggcaaatgctacgtttgtgcatcactgagtaacagcactgccagaaaaggcaacttcacagaattcacccactcaatgaattccgctgaatgctgttttgagacaaccaacacagagggagagcatggacgatagtgggtaacataaggggaaccggcaagatggaaaagggccaggaaacaaaagaattcaaggaaaaacagaaacagaagttaaactttgtgttccaaccccaaagacctctagaaagctgtgggatgtgatggagctacacgttctatgcggcatatgagaatcataccaattttctgtcttttagacaaaagaataaatgtgaaataggaaaaagggagggaaatgagatgggaggagggcatcaccccctttaatgctgtaccaaattactatacaaactgaattgttgtaattagaattatggacagtgtcttatcatttgtatgttaccagaaacctgtgctatgacttttaactagaaaaacaacaagggatgatggatctttctttggtcacattagcctctgtaagttactcaagacagctgcaatgaactgacaacaatatccacaaacaaggcaaaaggaacttctcatggcagggaactgaatctggatgttattctcagttctgtcattttccagatacctttagaaagaatgagctgcagtttgtgttgttgttttccttgagacaaggtctcaccctgttgccaggctggagtgcagtagtgtgatcttggctgtctgcaacctctgcctcccaggctcaagcaaccctcctgcctcaccctcccgagtagctgggactacaggtgcatgccaccacaactggctagtttttgtattttttgtagagatggggtttcactatgttgcccaggctggtctcgaactccagggatccactcgcctctgcctcccaaagtgctgggattccgaaggcatgagccacagtgcctggcctaagctgcagtatttctatatcttctgctaaggagtgaacacattaatacagaaccatgctcatcactccttcctctgagaatgtttcatgtttctctaaggtgtctaagttttctctttgaggtcagtgaaaagtaaataaaaacaactttggaataaatcaatattttagttaagtatagggcaaaaaactatttcttttctgactggttttatctcaaccatctttaaaggaacacagcaaacaagccaaaaaaacgcttggacagattctgacagaataagagtaaagtggttgtacccaaataggacatttacccttacaggctcttcacaccacggaatagagacccgcgaaaaaggggaaacgaacccatagacgactgaattcctgcacctgctggcgagcaccaggaggaaggtgcagggatgtccatgaggtcagagacagccatcagttcacactgcattccagacgcaatgggccccggccccattcttgggccttctacctaacctcaatgccttgggagtatgggaccttaggggtaaggatagggctacaattgtgcaggctacaattaaagatttttttcttaaatgaaaacactttaagaagtgaaagagactccagcaaccttccagaatttgtccagatatgaataactatataaattaattcctgctcttgcttagttcacaaaaacaaaatggtaaaactgagaaagagtgtgtttggaggaaataccaacaacaacaacaaagactgaggtattagcagtttccaaaagacacccaaatgggaactggaggttttttcccttcagggaggtcttgctttgttgacctggctggtctcaaactcctggcctcaagggattcccctgtctcagcctccccaaagtgctgggattgtaggtgtgagccaccctgcctctttcattccaataggaaagtatttaaagagtaaatgtagggccaggcacggtggctcacgcctgtaatcctgacactttgggaggcccaggagagaggatcacttgagcccaggagttgaaggccagcctgggaaacataggaactcttatttctacttctacctgcccatcagacacgtgatcacaacagctgcatgcatacaaataacttaagacacagagagaactatccacatgtatgtgtgtatatttacatatattttttgttaatttttataaaaaagaaaagtcagatcccaaaccagtaactgtctatcaaatcctgaccagccaggttcaaactacataatcaaactcaaatgaaatagtacataaacaatgctttgaccatgtacattgctactcaaaatactctttggcctttcccactggtctgcaatggcaggactgtatcaccttccctcctaccacatttgtttcaggtaacagtatgctagatacggtttgtctcaacctcagcaggagttaaaggttttaaaaaaataaaaataaaaatcaagaaaagattattcttgctctcacccaaacaaacttacaaaatattcagtgctttctgatttagtggtataatctagaaagggaaataaaatcaggcaaaaagagggagggggaaggtcacctatatcaaacaatcaccagtgaagattctttacagggtctgggttcaccagacacatggtgtcagaatatgtgcagcaggccaggcgccatggctcatgcctgtattcccagcattttgggaggcccaggcaggtggatcacctgaggtctggagttcgagaccagcctgaccaacatgaagaaaccccatctctactaacaatacaaaattagccgggcgtggtggcgcatgtctgtaatcccagttactcaggaggctgaggcaggagaatcgcttaaaccggtaggcggaggttgcagtgagccaagatcgtgccattgcactccagcctgggcaacaagagtgaaattctgtctcaaacaaaaaaacaacaacaaaagaatatgtgcagcagactaaatagtaaaattcttccttacctctttccaacatctctaattgtttaaaatactgtgaaaagtgaagttcatgaaaattgaggtctgagtgtttcctacctacttctgctaaccattctaagcatcaacaactgatgggtttatcaattatcctgaaaagtaaggtggtttgatttgcccaatctctttgaaagcctgaagtctccagtatgtaggggtttgattttatgcttttgggttttgagagtaaaacaaaacatccatgggaataatgtggttttgaaacatggctgatatcctggtttttaaacattctatgatttgagtaaaggaagcactctatgcagtggttcacacctgtaatcccagcactctgggaggctgaggcaggaagactgcttgcacgcagaagtttgagaacagcctgggcaacatagtgagacctctcctctacaaaaaataaacaaaattagctgggtgtggtggcttccgcctgtagtcccagctactcaagaggctaacatgggaggattagctgggaggtgtaggttgcagtgagccattatcacaccattgcactccagcctgggcaaactgctctcccctttttaaaaactcattaatgttcttttaagattaatatacctttagcactcctctttctgttcatctctttcaatatgaaacaactcaagttcaaagccaccacctcagcttgcaagacactggaagctctgaacacctggttgcccctcagctgactgtaagggccaagcctttggtttctctcatccacatgcccacctctgtcataggaaagctcaggcagttgatgaatccagcaggctgaagtccttgtcactgtcccagatgccaacccgtgtggccctgcaccctctcctgtcccgggacccacctacctctttcctgctctcctgcactcttggtgagcctccatgctggtggcttcagggctctggcccaggctctcctcctctccctccacccatcccttctccacagagacttcatgcacacctggctgtagttgcctttatctctgcctggatctgggcaccatcattcacctgctcccctggcatctccacgtgaatgcctcaaatgcacttcaaaacctacctaacacatgcaaaatgagcttaggacttctgacctccctactacatacttccaggctcttctctggcgttccctatccagaggatggtcccaccaccctataaattcataggccagaagctgagaaattatccttgacccccctccctgctcctcagtctcacctgctgctgcagcgttttgtggcatctagctcactgctcacttctcagtacataagtgcatggccctaatggcttctgaacaccttcaacatactacgctgtcttcacctcacccctgctcaccacactccaatgtttcccattcccatcacatctctcaacttcttgctctctcaccaaaaaccatcaaatggggagttttggcaccttcaccctggacttccctgccgcctggaaactgctaacatagcttctcgaaactggacaccctgtggcttcagggagcgcctttgaagcccctggttcttgtcagaccccccggccactttcttgctacccttcataggcagcttcttccttagtgaatacagcttgcagctctgcattctggacttgatccactccttgtctccatgggcttcctctgaatactgtacccatcaactctcaactctagccctgctcttccccttgagctttagatgtgtcccacaggcacctccaattgaatgaggcccacggtgaactcaccacctttccctcgttgttgcacctccttcttcttcatgatcattctcagttggtgccaccacctcatcagctgggctactcacccgcatcactctggtcttccttcttagctcccacaaattgtcagtcaccaaggactgctcatttccatcctgactgaaggtctctttccatttttgctagtattgcttccagttaagatcctcataatcattcactcatttattccttcgtcactcaacaaataaatatttatggagctcctattacgatttagccataatcaactcacatgaagcttaccattttatgctgaatcatgacatcccatcagacagcaaccacacggaccgtgtgctaagagctacgaagagctaagttaggattctgtgcaagcataaaggaaaggcactcaatccagctttgttagggaagacttccccgagaaagccacgtctctactgaggaggtgagcaggagttagcctagggaaggctgttagctagggcccagactgagagcacagcgataacaaagcttgttgacatgagaaaacctccaatcagctgggatggctggagcagagagtaagatcaggagtgcagacttatagctgcgctaactttacacaggcaactggggagtccccaagggatgttagaaggatagagtcaatgagtgatggcttttggagagatcaccctgtctgctatgtgagaggtagtgacaggacttctggagctcaacaggagttacggagacatcctggcaatccaaaaagcaaagatgatggcttccacgttatggtggaagaggctgggaaacaacacaaaggagccagtttctagagaggattaaggagggggctcgagcaggacttggtaaccggttggctgttgggaggaggagcattaacctgtgacccacaggcaggcactgagacagcctctttggactggaatgttaaggaatgtcgccttaaggcgctagcactcaagctttctgctcgtgcatccccttgcacactttctccttgacgttcaggctgggcatggtggctgacgcctgtaaacccagcactcccagaggccgaggcgggaggatggcttgagcccaggagatcgagaccagcctgggcaagaaggcaagaccccgtctctaaaaaactttaaaaaataaaaataggccggatgcggtggctcatgactgtaatccgagcaccttgggaggccgaggtgggtgatcatttgaggtcaggagttcgagaccagcctagccaacatggtgaaaccccacccgtactaaaaatacaaaataagtagccgggcgtggtggcgggtgcctgtagttccagctactcgggaggctgaggcaggagaatcacttgaacccaggaggcggaggttgcagtgagtcgagatcatgacagtgcactccagcctgggcaacaaagtgagactccttctcaaaaaatagaataaaataaaatcaaaataggccgggagcggtggctcacgcctgtaatcccagcactttgggagtccgaggcgggcggatcacgaggtcaagacactgagaccagcctgaccaacaaggggaaaccccgtctctactaaaaatacaaaaattagctgggcgtggtggtgcgcccctgtggtcccagctactcgggaggctgaggcaggagaatcgcttgaacccgggaggcggaggttgcagtgagccgagatggcgccactgcgctccagcctgggcgagagtgagacttcgtctcaaaataaataactaaataaagaccaataactgtttcccatagggttatgtagttgcaaatgaaaaaattactggcatgtactgcctctgcatatgaagcataattttgtcaagaccttatacctgcagatttagctctttcgattaacggaaaatgtccaaaatcagtctcctccaacctatttgccgaactggacttactgtcgctgagtagaccgaccgacatagcttacacgttgttcagctcgcttgtaagcaaacacacgaaaccacctcacccctgacttcagaaagaagccgtcccgtgaattcctcacagatgaaatcaggagctgcccctcaaggactctatttcttccttcggctctatcaaatattttaaggtacttcccagcaacggaaacatgggaccctgcaatgacagacttcgcattcctcctgagcggacaggcaataagcaagtaaacgcgcaaatacccaagtgcggcctcaacccgcgctcctgccgggagggtctccagtcaccgagtaaccccggccctgccccgcgccgccgccgggactccgccccgcaagcaagtggggtctcctttgtcccgcgcgccctggccgcgtcccgcccttcggcgtagcccatgggaggcgccctgagggcagggcccttctgattccccacctggcctcgagtgaggacgcgctcaacaacatctcgagtaaagcgggggaactcgcttcaacgcgcagacagcacagctctcgcccagcccggtctcgggtcagccgtctctccctggacctcagggacactagccctggaaggccgccggtcgggaggggactccctccccgtctgaggggcggccgcggacacccggcgcctttcccccgccccaccccgtgcggcctcacgcaaacgacaggaaaaaagctgggaccttcgcctccgactcagtgtagacgtcgccatcccggttccagatttccgcgctccaacgcctccgcagcagccatcttgccagagggccgacgccttttgactctggcgccaacccgtagtgcgtggtcgccgcgaggggagttctgcgcaagtacggaagctgaggttccgcgcttccgggaggccgtccgccccgccccctcgcgggggcgcttcattggtcatcggctcgcgctctcgcgctctcttgctgtcgcgagaggtgctgaggggcggcctccggtgcgcctgccctcccgctccccgcccccgcccccgcccccgcctccgccgcggcccccacctctgcctccttctactcgggcgccccggcggccgccacctctccccagcccaggagaggctgcggagccgcagccgcccagaccgcgcagcgcgggaggcaggttccgcacggtaagatggcggcggcgggcccgggcggccgggccgagcgtctcccggggccgggccgggcgggcaggcgggatgtggccggggtgcgcgccgcccccgctctgggggccttggaagcgccggcgctggcaggtgcggaattggggcgcgcagtgagtccaggcccggacggccgccccgcgccggtgcccagggggcagtcagggctcagcctccaggcgcgcggcctcaggcgctggtgttctggggcggtcccggccagcctgaggggcggcggtagctgtctctgtggaggagcgacgtccgtaacgaagtctttttaataaaatctgctgctttaaagcagaaaccgagcgggtgaggatgtaaagtgtggcatggaaagtaggagtcttcagcacacgggtgttttcttctgctgaatctttttatgctggagtttgagactaccgagttcttcctgctaacaggactggccagttctacaaagttgttgcttttcatgggcgcacgtaactgcccggagtggaagcgctgtgagtgccgatcaccgaatgggccgagagaaaaggtgccttttcctagggagctcttaacgttggtcctagggccgggcgcggtggcggaggtcgaagtgggcggatcacttgagcccgcgagttcgagaccagccgtggcaacagcgagactcccttctctgctaaaaataaaaaaattagccaggcagagtggtgcgctcctgttgtcccagttactctggaggctgaggtgggaggatcgcttgagcccaggaggtcgaggctgcggtgagccatgatcgcgccactgccctccagcctgggcgacagagcgaggctctgtctcaaaaaaaaaagaaaaagaaaatgagtccttaagttaccattaattgtcgtgaataaaaagttggtctcagtgagttttgcagttgacaacgaaagatgggtgttcgtgtgtgacagcgactcctggtttctcctccactttacctgccgctccacatcaagttttcttctgctggtgccactttctctgctttaccttcaaggttggcatcctccaagtaatggcgattctcattccctatctacgctcttcctatggtctttgctgaattcttggctttaaatatccctgtgccccagcaccgccccccccgccccttatttcactaattcatgttttcagctctgagctcaggatctgtaattcagacacctgcttgatttctccagacgcatgtctaatagtcacgtcaaacttgccctgcttctcaaacctgttcttcttccagtccttcctccttatttgtggccccatcttgcagggcctctcatgcttgaaacctgtgaccatcttctattcttccctctcttttgtccggtaatctgtctagcagcagccattgactctggccaaagcatcttgatctcaccttgctctccatctcttctgccgatgttctctctcgcttgggtgtctccctaagggactggctgctcagatctcaccaccctgcattcatcccattttcagccaagagaccaaagttttttaatttattgaaacactttagcagtacttcgtataaagtagtatgtgtaacgtatgtatcagtggcaaaagagaaagacagagtggacggtggcgtgcccctgcctgtctcaggtatccacccattctcccaaagccggaacagctgcctctggggcttcagccatttgcccctcccacaggtaaccccctcctgagtgtcagctttcatgcccttatttaaaaaaaaacaaacaaaataggtttgccacgtacatatttgttgctaaagcacatgtcatgtattttgtcttgttgttcctgataaaactcacggcagatttggcctctcctgcaactctctttttcttttcttttttttctttttttttttttttgagacggagtctcgctctgtcgcccaggctggagtgcagtggcaccatctcggctcactagaagctccacctcccgggttcacgccattctcctacctcagcctcccgagtagctgggattacaggcatctgccaccatgcccggcaaattttttttttttttttgagacggagtcttgttctgtcgcccaggctggagtgcagtggcatgatctcggctcactgcaatctccgcctcccgggttcacgccattctcctgcctcagcctctggagtagctgggactacaggcgcccgccaccgagcacggctaattttttgtatttttagtagagacggggtttcaccgtgttagccaggatggtctggatctcctgaccttgtgatccgcccgcctcggcctcccaaagtgctgggattacaggcgtgagccaccgcgcccggccgcaactctcttttttcattcagcattgttttatgagagtcatccaggtgactttgtgtcatgttcatttattttaactgctttatgaaattctcttgtgtgaatacatgaccacagtcccttctcagcaatgctaaaaatctaaacatctctgaaaccacagtttttggttttgtttttaacctatttggtggccaaaacctcaccaggtaaagtttaatagcctctaccacttagtatagatacctaacacatttcagtgaagaaataacgtctgatgatggggagtgcccccaaaccccagtgaggctgttacatggtaaattgtgccaaataatcgttgtacattgaagaattctgaattccaaaacccatctgcccaagggttttaaacatgcagttctgtgcgccacagtcccttggtccacgctgctgttgaatgaacgctcaggtgggtggcttccacattcctgccgctttgaacggtgcttctgtgaacagcgttgtctgtgtttggtgcatcctggtgagtttttctagaatataaatgtattaaaagtagaattgctgggttgtgaggagcacacatgttcagctttgtaaggagtaccagattgtttttgtagcacagtccgttctcctgataccagagtagaaaaagttgaagtgaacttattctttgctaagcattggcattctcagtctggtgggtgtcccacggcagcgttgtctttccgtacatgctcagtgtgggattctccggctcacagctcttccagcgctgccctctgcccttggaggagcatctaaacccctccctcagctgttatttttttcctgtagaaataaatcagaatgagttatgcagaaaaacccgatgaaatcacgaaagatgagtggatggaaaagctcaataacttgcatgtccagagagcagacatgaaccgcctcatcatgaactacctggtcacaggtaatggcttacagtgaggatgctgttgcatgaatgtgattctccctttttgaacacataaggagtgctgtagcactgaggtttgatgacgtagttatttgtgttcagacattatgaaaacacaatgctaacctggtaagtttggaagttatcatgtgaaagccttttctgaagatgagatttttccaggtctctgagacctaacacaaacccatttttcagcctttgacagttttacagttactcaaaataattgagactgttgtgaagtaagtatattgaaagcctaaatagttgatctcttctggccagtctgcaaaaatatgctggcctgtttctggaaagtatgcccaactcagaggatgggaatggggaagagcagaagcgtgcagagggaaataacagtcaggctgttcttgatgtcaactggaggaagggcagtgctgtatatggcaagaaaatagatgtttttaaaagacatgacatgaaaaatctccctcctgttagtccccagttccttctcccaaattaatctctgtgaaacttttttgggccaagcatggtggctcatgcttatagtcccagcactttgagagacagaggaagattgttcgcgcctaggaattccagaccagcctgggcaacatagtgagaccttgtctctacaaaaaaaaaatgttaattagctggatgtggtggcttgtgcctgtagtcccagctacttgggaggctgaggtgggaggatcacttaagcccggaaggcggaggttgcagtgagccaagattgtgccactgcactccagcctgggagagtgagtgggaccccatctcaaaaaaaatatttttggaaggtgaagaggaaatttaggcctataattatgtcaggggcaggggaaggggcacacatgctggctttgaaaaattgtagacactcttaagaggtgggagtcaacaggccactgcaggtatagctgaccatggagggcccctgtgctgtggaggctgagccagtgtgacttgcctaacctggcaccagagctgcggctgctggcgtctggacctattatctgtcctctcaaaggagcccacaccaacacactgggccagcagccattctgacctctttggctaatgggttagagtttttggatgggataacaaggaatgaagtatactcttctcattttctatatgtattttgagagcataacttgtaaattataaagatattaataccgagttcctgagaaagtgtggttcacatcagaggttattaattgaggcaattggagtttctggagatacaaagtctttgccttaattccttgctaactttcctagcagtgaagatggtttttctattcagagggctttaaggaagcagcggagaagtttcgaatggaatctggaatcgaacctagtgtggatctggaaacacttgatgaacgaatcaagatccgggagatgatactgaaaggtcagattcaggaggccatcgccttgatcaacagcctccacccagagctcttggacacaaaccggtatctttacttccatttgcaggtatgtttcaggagagagtagtctggtttgtgaatacttgataagttaaagttatttgcaatgattgagaaataactaggctaatttgctttaataatgttatttcaatgcatgtgagggggagaggtttgagtttgctcttttatgtagttcagaagcggttttttgttttaaaaatgcaaatttgataactcagagatgcaagaaaagtcttccctctgtgatgtacttttgattgggacctggtaccacctgccctaagtccctggcctgggtgtgtgggggtcaagcttgtctgtctctgcctccagcaacagcatttgatcgagctgatccgccagcgggagacagaggcggcgctggagtttgcacagactcagctggcggagcagggcgaggagagccgagagtgcctcacagagatggagcgtaccctggcactgctggcctttgacagtcccgaggagtcgcccttcggagacctcctccacaccatgcagaggcagaaggtggggcctgccagagggaagctttcttccattccccatgtgctctgagggggcttcgtgacaacgccaagtgtgtggctttgctgtgtggactgagagacaggtggcttctgtgcctgggatgctaagtggttccttcatggcttttttttttttttttggaggtgaagtcttgttctgtcgcccaggctggagtgcagtgacgagatctctgctcactgcaacccccgcctcctgtgttcaagcgattctcctgcctctgcctcccaagtagctgggactacaggagtgtgccaccacgcccagctaagttttgtatttttagtggagatggggtttcaccatattggccaggctggtcttgaacccctgacctcaggtgatccagtctcccaaagtactgggattacaggtgtgagccatcatgctcagcctctctctggcttttaatcttttatcttgtcaaactagggacaacggacttggtgatcgttacacagtattcacaccctttgctggtgtcttatatttatctgaaccttctttctgtttatgtcccaagtatttctcatttaaaatcctgtcttctgaaacttttctctcctcgctgctatgtttttgtctggcagaacatgacagctcctcgccttcccagacccaggtccctcttcccccgggtcctctcccgggggctctgtcctccctacgctgtcttggaaggatggcctgtcctagagtccacttgagatgttttcttgaggcttgtgaggagggtgctggtatgtcctgctacgctggtcttacctctctcccagtcccctcagcactttgttcaaggcttgctcatggcacttaactgccatcgaggttgcatgtgacgtttaacaaccagactgtgagcttccccaggcaaggactatgtatttcatgtcctgagagtgtctcgcagttaagagcttaatgtttgtttaaactgcctctttttaatagactctgctggtgctctgcgtgtatggtggtttttatcagatgtatttatattctaggtgtggagtgaagttaaccaagctgtgctagattatgaaaatcgcgagtcaacacccaaactggcaaaattactgaaactactactttgggctcagaacgagctggaccagaagaaagtaaaatatcccaaaatgacagacctcagcaagggtgtgattgaggagcccaagtagcgcctgcgcttgcgtggtggatccaacaccagccctgcgtcgtgggacttgcctcagatcagcctgcgactgcaagattcttactgcagtagagaactctttttctcccttgtacttttttttgacctggcatctttttatagggaaaaatggcctttgtaggcagtggaaaacttgcaaggaaagctgccgtctctttggcagtctgatgcagagcctgcactctggcactcgctgaagaatctggaaggttgcggtttgctcttccagtgttcgggggcctctggctgctgaaggattcggtctaccacggagggctgtgctgttaggctgcatcccactcaaaatacaggaaaagcacgaatcatgattctgctttctgttagcttaggcagacattgggccttcacctacaagtttttccttacccctgtggtttttgtgtttttttttttttctttttccataggaaagaatatataaatttgtaaatcctaattcaaagatggctcatgtgtgagggcattgagtttgatttgttttccctttggtctgggttgtgtggcttttgggggatgcgtgtgagggggctatgtgttttttaattttttaaatatatattttggtgctgtgtgtggtaagagacttgttcctagtggatcaatgaaccatctcttctgggcagttttgttgaaaataaaggtttctctttgatttcaagaatgaccaaaatggcctctaaaagatgttaatcatctcaaatgaccttttgtctttggggcgttcttccccctgtgatagcggcagtggctttttctggtacctgcagctggaaaggccacttggccctgtgctgagtgagcggccttcattagagcgaggcagcccttggccggtggggacgcagagccccagcaggtggtgcacgactgttggcggaaggaacgcgtgttcatcctcagtgatctgccctccagcatctcggcagcatctcatcctccatcgtcagctggctctgccgatgtcctgcttctgttcactcacagaactgtcccctgctccgtggtgggcaggagggaagtggtgcagggctgcgtgcattgcctgcgagtcgggacagttgatgggcacatggccttgtagctctgggcacagatgtgtttggattcattgcagcggaccaccgggcactgttgaccccactgagcagtgctaagtgttggtttagtggatgttcgtggaattgctgacccatccaagggcgtcctttggagccagtggagcctgccggcgcatctgaggggcagaatgctgctagcacttgaatctgggatctcgccttattctcaagtagcaaggcatctcgacaagcatggtctaggtctggtggccagcttgccagtacctgagccggtcgggtcatctgcctctgagggaccgtcctcaccgagctcctgcatcccttgagtgttgatcaggaggcgtccacagcattgttctcgcctctgaatgatgcttctttctgtgttggagcctggcgaagttgtgttttcaagccctctacttctctttccagtgggtaggagcttttggcagtgtttactttacctagatggcttatataatccagtaagagatgcaaagataaaattgctgcggttgttacagaagcatggcggcctccagactgacccattggttgccctttagattttgtaaggatgcggtgctggggaggtggtgcttccctaccccctagaaatgctgccttccaactaccactctcccagatgtgacccttgcgattatttcctctgaggtttgaggatgaagataagttggagggaaagagagtaactaataggggatgaaatatagcagaagctagaagaaagcggtgaggtgagagagatgcatctgcacgttttcttcaacagcaccaggtgattcagcatattcctaattacctttcactattcgtgtatataagatcgtttacttgcataatatatcatcaatttgacatattcttaaaactagagggtgtgagaagcacagcaataggaagtctctccacaaactaggggaacacaaatggggtcattcacgtgcctggactgtcactatgtggctgtcacgtgaagtgctggtgttgatttccatttcagccagtgggtagctgataagccagtgccagcatccagcatgagcagatgtcggggagactgggaagtctccagcgttactgctctccttcccttcatgataagccagtgccagcatccagcgtgagcagacgtcggggagactgggaagtctccgatgttactgcctgccttcctttcgtgtgaggggctgcacttgcttttcttgtgatctgttagtggacgaggtcttccaaggaagtgctttgcacactttctttgctcctttttacagtctttgtctttgcagcaagcaaatgaaattaagccactttgggataatgaacattcagtataattctactttgtctcattttggatctcactgttgtctttataaaaatggcacattttacaaagtagtttattcttattatactttctgctggagagtgccttgaaataaaatgtgagagtattctggtactctgtgttccagatgcatgaaattgggtgaggaataacccctagtctggaatctttgtgaagcatagggttattgcaaggcaaatgggaactaacacatcttgccatttgaatcagggtctccagtttctagaaaaggcagacactggttgggaccaaagtctccatggcacatgactgaagactggtggtcgtgtgtgtgcggagtccacggaagcctcggggaggtggagctgctccttccattccgtcaggacgtgatctgaaaacatgtagagaagatgagttgaggacagcttttctaaggcaatgtgatgtctttgctttcttatttctctttctctgcgttgttagttttgaagagtggaggagctaggggctccagaaagaatcttacacatgtgttgaagacattgatgtcatagggagcggggagctgcattcccttctgggctgttactgctaaatctcagtatgaacagaccaggcggaaagcttggtggccaagcagtctgtgtgcttccccgctgatggagaacgttgcgttgttcacaatagggcctcatgggtgtagccgcatggcagacccatggctggcgcagctgcctgttgccgtctgtcttcagtaactgctgctctgttaactgttctattctgatactacgcgtgttgttttttacaacaggtatgtttttgtttcagaaatatgtattgcttttctcatattttttgcaaattgtattgtcaacatgggtcatttaaagtcctgtatgaaccataacctgctgtggtacctttgtacatgtttgattctgtattctttattccagtgtggcatatgtgcccctctgtatcttttgagaagtgcggaataggttgcttctaccacctgttcttaatgtaacagtaaaagttttcacatttttctcagaactgttatctggaagctctcttttttcctaagggtattttaataacaaatactgatgcatttgtattgaaagttgatatcttggaatggaaggacagaagaaagctcgcctcttggaactgtagttggctctcctctcactctgacagtgctgccccttttagtttgtaaatctgtacttggtgtgtttaatttgaaacctatcggctgctctcttgactggggcacttaatgtttcataaactaatttccttggtgtgaaggaagtagaacttttgagctacccactgcatgattttaaactgattttaatagcctaagtaattactctttttttttttttttttttgcttaatgaaattttccaaacatattaaaaacagagggaatacgccagcacatcccagtatccaccagtcagcctgacacccaccaccacctgccagagccccaggcaggagataactacaggtgtctgattctgggtggctaccatgctttcagggccatgagcgtcttcatgagtggaaggcagttgtagggttcttggaaaggactcagactgaccccttcaagggcctgaggtgaaattcagaaactgcccatgcagagaagctgagcagcgggcatcatggagcgaggcgttgagagcttgcatgtttgttgggtatcagagaacagggaaggcctctcctcacctgctgctcctccctatgtggcagtggcatgtcacagtgttcttgatgttcacacacctgtgccagtccattagcctcacgggtcagaaggcagcacggtagttcttagtggaggtgggcatcaccaggaatgcttcagtgtgagctcccacactacagtctggaggctcacaccatccttgcacacatggccttcctgtcttagatattctgccttattttggaatgccatctttgcttgtggtttttcacttctgttaaagtagaacatggggtttgaatgggcctttggtgtaactagctatggcaagaatcttttaagagatgtgctctttggagatacaatgtcctgagcttgtttgccttttccagaagccacaaaatggctttgaagataaacaggcccatgctacagagccaccggcacaaggcacctggtgtgcaggagctgaggtgcagcctgtggttaattgataataatcatgtccccacatctgcacagtgggggctgtttctctcatttcacaccccagtatccaccagtcagcctggtgcatgtgtgcggggaatatttaaagggaatgtgacgttctgatttgtctgtaacatttcagtgtcacctagttcaaggccaggtttacgggtccaaattgtccatagtacagaagaccatttatcaggtgaagcccgtaaagccataggcacagctataaccaaaagaattcatgaaaggagtaacaactgaaggtgagtgggtttcctcatgtttgtaaatgcaggtcacgttgcaggctcttccgccagctgtccgtccatgcaaggcagttggtcaccccgcaggctcacttcggagatgaagagtgctgggtgcagcagcgcctcctgtccttgggtctctgtgtatttgaggtggaattgatgagcttgggaaccagggagaagcggtggagctgctgttgccttgagctgcccgtgtcaggcaaggtctccgcctggctgtgacttctgcttcctggagacacatctgtaggcgttcctcacacaaacaaggttttctccctcttgtggatcacggtgtgtgactgacagctttggtaattttcccagctggctttgaaagtgaagcaggctgacccgtcaccaagaattctctgccatggagggtcatggaagaacgggaagaggtgctggcggtcacagcagcccagggttcgtctgtgctcgtttatagatttgtgtgcccatccagtcctcactgggccctcccagttttagaaatgttgaacactagtgcttgtaagattcgaacaatgagtttaccagctctgagaaaaatgaactgctccagaaccttcaagaatgtttctctgtatcacgcccacatcacaccgaatccatttgtcgtcattgcagagttcatctttctggttttgagcaccatctcacacagttctttgtctttttccagtctgctgttgactgggttagctcagcccgaaaggtgcccccacctttgaggcagttcccgcacgtgatgtccagtaccgcggtcttccctcttgctgctgcctgtcagtcatggcagaggaaagtgtcatctgtcagtctccttttcatggactcctcatcttgagaattgtagttgggctggaaggttgcagggctaagtggggtgcagggaggagccccaggcccagggctggcttgtcttggtttacaagaagctgtgcggggtctcctggggcgtctgtggggggtgtggatgcagaggctgagcaacgggcgccatacgtagtgaggtgtggatttgctttaggaaaatctctagcatcgtctccctatagcagcacttgaaataaacaagaagttaggtgggccaggcccaacaagagggaggcacgcagccttccagaagcagaggccagtgggtgctggctgtgactgccctgtccgcaaggtcaccctgtgtccttgaaaacccaggtgttgactgtctattgtccctacataatttttcaccttaggcctcaaagatgcttgggtgcggggcagctctcagaatccaccagaagcgtggagagcctccatctggccactaccagcacccagctttataatgtccctgtgagatggccccttcacccacccagccatccctgcatggcccgtttcttcagctcatccagccttcactcaggtgtccaggggtgcctcctcagcccaacctatttgaagtaacaccccttccctacccctttcactactttgatttttgtctacctgccccagaacatcagctccaggaggaaggggactttgggtaaccagatggcaaatgtctgctgcagcatgatcacagatctcggtaggaaatcaccatcacagagtgaatggaagcgaatcacctcaaagagggtgctgttgacagcgatacgtttagcaacagtttccaaacttcctggctatgggctagggctgtttggggcaataaacctctctctgccaccatcttttcacctaccctacgtcaggatggatgaaagtatgaccttgcttttcagggtgcccgtgtctttctgttcagagggccctgggagcaggccctgcagtgcagtgggttgggctgttggagacctgagggctagggggagggagggggtaaatgtgggtctgttctaagtgcaaggccctgccttagacgtgtctccctcggcccctgggtggtggctgctgcgtggaggatggactgaggtgggccctagtggaggtgggggcaacgcctgaggagcaggccctgccgcctcctggggaaaggctgcatggttgaggccttcccctgctggcttcatccttggcatggcagcaggagcacacagagtgggggccccaccccgtcacccctgcccccgagcccagaacctggcctgtgatgggtcctcaggacaccttttgtccaggaacccaggggccaatgacaaccttcacaggcatctgctgagaagacatgggccagcgctggatttgtccagctctcccaggcttggtccaagggctcaggagtggacccatccctgccccgaaagatccattttaaaaatcagtgaccctgtacttttactctctttgcacttggttaagactttatccctgattttatttgatcggtaaggcagggactgccatcattccccattttatagacagaggacagacggccccatggctccgtgtcgtgtccaagggatgggctggcacctcttggaccaggcttaccaccagggcccttctctgaagccccagtctgaccggcctgctgctgggaatccccctctgcccccacactaacctctgctggggctgagccagggcgcgtcggacagtcagggcgacccagccagggcgaccgttggccccgctcctatggggcagcagggaccgacgtcagcagggtggggcgggcacccgagtggtatgccccgccctgccccgcctgcccgccctggtggccgtctgggggcgacaagtcctgagagaaccagacggaagcgcgctgggactgacacgtggacttgggcggtgctgcccgggtgggtcagcctgggctgggaggcagccccgggacacagctgtgcccacgccgtctgagcaccccaagcccgatgcagccacccccagacgaggcccgcagggacatggccggggacacccagtggtccaggtgtggcgggggtgaggggagggggggtgggagcggtggagatggggccgtggggagggagctgagatactgccacgtgggacgatgctaggtggggagggctgagctgggcgggctcctctggctgtggggccccctgtgttccttgtgggaggtggaaggaagtgagtgccctgtccttcctccctgccatgagattccaggaccggacctggcaagtgccctatcccagccagtgttcctggggctcttccaggcagggctatgttccccaggccaggggcattgtcctggacagtcaggaggcatacccctcgccaggtggaaccaccctgtgtatgcatgaccctgacaagcaggcgccaggacagtcaggaggccaggtagggggcacgggctggagcctgcagctggacggggttggggggggtcctgccaccacgtgccagctgtgtgctgaggacgagctccccgctggcttcagctctcggagcatttggtggtggggagaagcagggcctgggcaggtcgcctggccaccagcactgctgcctgtaggaggctccctgggcaggtgacgcctcagaaaccgggcgagatggtgaccgcgggccattggtcagctggggagggcctctgccagggagctcctgagagcagcccccacactgctgaaccccttggctctgggtcttgggctgaggccttaagtggctggaccctgggcctagactcaggccctgtgggttccagagcagtctcctgcctgcactgagtccccagggtacctaccctgaccatggcaaggtaatggcaccttctggccccaccagttcccagctgtatgagggctgaggaccctagaagtgctgggaagagttgtaggaaggcccaaaggggcagtgccaccatcggatgttggcacccagatgaagggagcgctggctgcatgggaaaagctggcagcccagatcacagccctgtcaggcgccaattagaggggagggctgccctcagcgggccctgccccttgctctcttcctcttcccccacccacgttcatccaggcctgccgggcagggccagctccccagggattcagggcctcctcactggcggctggtttgagtggctccgccttcactacgtccctcccaggctcgatgtttaaaaaggagcccttgccgcagccttcactacgtccctcccaggctcgatgtttaaaaaggagcccttgccgcagccttcactacgtccctcccaggctcgatgtttaaaaaggagcccttgccacagctcttcaacttcctttgcaggcccttattgggtagcgccaaggattctggaggggcctgtgggtcaaggctgccacacgcacgccttttcctagcccgccctcctgcagccacatcacaaaggctgggccaggcgagaacagagctggagggcggcacccacactctccggtttgctgctcgcctggcccggccccgcacagttcccttttctgaatggaggggccatgtgaccacctgtttgctcagccgtggatgctgcttctgcacaggggccgtttgctctagaaagttcacaggaagcaggctgctgggctcagggagtgcagagtggtgggaggaagctgttcaagctgcccaaagctttccggttcttggcacaccccccgtcccccgcgcccccagcaggatggaggattcccagcctggggtcctagtcaggcctcaggtagccgactgtctgggccatcctctccagcctgacatccttgtctccccggcagctgtggagggtgcccctgtgcccacctggccagcaccacctgcccagctcagagaaggggctgtggctgccgcctgccacgtagggcagattgcttgcctggaagggctgttcttgacttcctccttccaaggaggccctggagtggctctgtgttctcagtcctgtgctggcctcaatgggggtgaggatcagtgcaactgagctttctgctgtttctagctagcggccaggcagtgcggggcaggtgccacctggacacaggtcccccacctccccccctttctttttcaagacagagtctctctctgttgcccaggctagagtgcagtggtgcaatctcggctcactgcaacctcgacctcctgggctcaagcgatcctcctacttcagcctcccagctgggaccacaggtgcacaccaccacactcagctaattgttgtttttttttctttttttttttgagatggagtctcgctaggtggagtctcactctgtcgcccaggctggagttcagtagtttgatctcggttcactgcaacctctgcctcccaggttcaagcgattctcctgcctcagcctcccaagtagctgggattacaggcacccgccactacgcctggctaatttttacatttttagtagagatggggtttcaccatgtgggcgaggctggtctcgaactcctgaccttgtgatcctcccgcctcagcctccccaagtgctgggattacaggcgtgagccaccatgcccggccctggctaatttttaaagtttttttttgttttgttttgtttttttttgtagagctgaggatgtccccatgtttcccaggctgctcttgaactcttgggctcaagtgatctgcccacctcggcctcctaaagtgctaggattacaggcataagccaccgtacctggctctaaagctcctttttaaaggcacctttggactgtgtggcttttagtggaaagttaagggtgggggcccccatgtcccttctgcaagcctcgtgtgttaagtcaatgaaaactgtttacagagagcctggggctaggtaaacaacagggctgcgggtatcaaccacgccaggacagggcgtggaggccagggctgtactgggttaggcagcctggcagtgaggactgtgtccttctgtggtaacccagggagcagccagatatggggcaagccagttgtccccagagtggaacctggctgcaaatgacgctggcgaaaccacactcactgccaagttccaggacagacagcacttcctcccacacaactttctccaaactccaggggttaatggttggccctgccgtggggaggggctggagccaggatagcctctggcagagcaggaggtgtcagaggacgcagctctgggctgctggagtgacctgttcttgcctctgagatctcgcccggcctccctcaccaggattgggagtgtgagctggccggcctggctctgtgacctcgggcatggtcagtgcccgacttggtggtcttttctcccgtgggaagcgtctaggcgcagacttgcagagagtgccgagaaggccgtatacctgcccctctgtccacagcacaccgtcatccactcactcatctggggcaggttcttgggagcacacacccggggtgcagccagctccccgcaggggcagacaggaccttttgggaagggtggggtgagactctccagtgtccgactcctctgccacccatctcctggtcaccctctcccctgttctctttgaggggaacaagcagggcccggcccaggcaccttttgtggggatgagtcgttgctgtgacctgcccgagtgctggccactcagttgctcccaggagccactgtgcctcatttctggctgcctgtgttctcccaggggtcagcagataggtgcgattaggtgtttgaatgcttgccaagttgccctccatcaaagctgtccccattcacagtccatgtcccccagccctgagggaggtctctgagtgatgaactcgaagcagcagggccgtggggcctccccagggcctgaccatctcctgtcccacaggcccgagtgccaggcatggacggggacgctgctgctgggcacatgccttctgtactgcgcccgctccagcatgcccatctgcaccgtctccatgagccaggacttcggctggaacaagaaggaggccggcatcgtgctcagcagcttcttctggggctactgcctgacacaggttgtgggcggccacctcggggatcggtaactgcccatcttccccatctcctggctggtgggggccgccccactggggcctccaggggcgagtgggctggctgtgctgctgcacgcagaggatgcgactcctggggaaggagcttggtggacacagaggatgcgactcctggggaaggagcttcgtggacacagaggatgcgactcctggggaaggagcttggtggataaatctgggcagaagacccccccagaggaagatgggagctgggaggggagaggccaggcttggcaaggccccagggccctgcaggcagaggaggcaggccgctcccctggagtacctggtctcctcacgaggcagctctggggtcatgagcaggccctgtagaggcagacaggccaggcccagctctgagcacccactcaagggctgccctgagtcagggtggtgccccttggtcctgcacagccacatcctcacctccctctgtcttccctccaggattgggggtgagaaggtcatcctgctgtcagcctctgcctggggctccatcacggccgtcaccccactgctcgcccacctgagcagtgcccacctggccttcatgaccttctcacgcatcctcatgggcttgctccaaggtaaggggagctcaggcggctccctcacgctctctggcaccaggtggggagacaaggggggtgtgcacggatgtgtgtgcaggtgcatgcgtgcatgcaggtggtgtacaagtgtgtgtgtatgggcatgcccgcgtgcatgcgtgcacctgtgtgtgtgtgcgtgtgtaagtgtgtgtatggcatgcccgcgtgcatgcgtgcacctgtgtgtgtgtgcgtgtgcaagtgtgtgtgtatgggcatgcccgcgtgcatgcgtgcacctgtgcgtgtgcgtgtgcaagtgtgtgtatgggcatgcccgcgtgcatgcgtgcacctgtgtgtgtgtgcgtgtgcaagtgcatatgtccctgcagacacgtgtatgcaagcaatgtgcatgtatgtttgtgcttgtgcgtgtgcgtacgtatgtgtgcatgcacatgtgtgagcatgcacttgtgcgtgcaggtggtatgcatgcgtgtgcatgcctgtatgcatgtgtatgtgtgtgtgcgttcctgtatccatgtgtatgtgcgtatgcgtgcccatatgcgtgtgtacgtgcgtgagtgtgcccgtatgagggtgtacgtgtggccatgtgtgtgccttctgtaggtgcacactctgcagtgatacacaggatcacagggggcacctgtgtagtgaacttgcccctgcccctgaattttgtcaccaaacgccttagttcagtggtggattccagctgcaagggacctgctgtgggactctgggttttgtgcattttggtcacacgtatgctgatgatgcctccgatactagggccttggagcgccttaactgtcaggagaacaaggtgggtgggggggccaagggggctttgaggggcccctacttggctggggtcccctggagaaacagccaggcctccagcctgcaggggcctgctggccccaacccagcctgcctggccaccccacccatcagcagttccctgcctgggccactcctcccccagtgtcctgggccatccagaccccccactcaggactccccctaccttcctgagccggcatcaggttcagagcgctggccatggctcccctagaacctctgccctccctctcctccaagtccagagactttggggagttcactcccaggcctcgttctcctccctctccacaccctcactccccaaggttatggcctggaaggtgctgcctgggactgtctccataacagaggaagggggtctgcccaggagagaggccactctcatggtcacggggtgtcacatgagaacaagggcccagtgcatggcccaccctcagaagagggtgcagcgagtgcaactgaggacttaggattgtgtgtttactgtgaggccccatcccagagccagcccctccagcatcaccgcctccccaggcactgcccaggtcccactgcaggagctggaggaggaggggaggaatgaacgaatcggcaaccacctggaggggaggacaggcctggcggggggtgggggccctcatctttgtttactggagggtcttcggggtgagggaggagggtcccaaggctgaagctgtgaggaaaacagtggtgctgcctcggactgggctgaccaatgcctctaagtgtcgctgagaagaccctcggccctggggcaggcggctgtcctcgtgggcagctctggggacccagcaggcagccagaccccgtaggctcgctgccgctccagctgcgcttcctctgcggggcccagcttgttgtgctacgatgacttggcacctgaggcacattctgttttctagaaaccttcaaagtctggcacgtctcaatgtcagatgtcatcctgtgcccatgagcctactctgggggtctggggggcagcaatggcggctgcgtggtaacggtgggcaccacctgcggctggctttgccgtgtttgtgcacgctgtcttcgggcagagcagagacgccaggtgtcccaagacctgtggctcttgctgcggggcatcggacttctggagggagccccaggagctccgccaggcggcccccagcctccctcgagggagcgagggaacgggccctgcctctgagccgtgagcctatgagtgagcgctctgcggttaaaagttacaggcgctggccaggcaggcgcttcctgtgtgtggccgtctgtttgacgatgcccccctgcagggtagcatcagcgccctgtagacacggcccgtgggtttgggggacaagctcctgttgtcaccgtggctccgcggtgcctcccctcgcagagtccctccaggtcaggctcagagccctctggatgtggaggagctgcatggggtggtaaggtggtttccaaacttctaaagcggctgagaacacttggtccaaaagaaatcctgggaggaagctcagtttataaaacagggaagggcagctttcttgggggaagtatgtgtctgtgcacgcatgcggcaggtgtctgtgcacgcaggtgtgcatcttcatgcgtatgcgtgtatctgcatcagtgtgagcacaatgcagcactgccaagaagtgtgccggtgaacacgtgcgtgtgcaggcgcatgtgtgtgtgttggtgcgaggactctagagcacagctggaggccggtggtgagagtgtgcacatgtgcatgtgcgtgttcgcggggtgggagggctagcttggaagcaggggtgtttccctcagccgtgcgggtggcacgaccctgagcgagcctcacccaaaaggagtctgtttcctcagtggcaccaaaagccctgccctgctggtccctcgggtggggaggtgagctagagggacaggtggacgtcctctggaatcacagcccaaacctgagcagataggccgggaggagcctccctggatggaccctgagagaccctccctccacttgttgcaggggtttacttccctgccctgaccagcctgctgtcgcagaaggtgcgggagagtgagcgagccttcacctacagcatcgtgggcgccggctcccagtttgggtaagtcctggcctaagacggggcccaggagaggccaccaggtgagccccttgccgagtggcccctggtctgcgtgggggatgggccacatgggcttgcagggccaccatggtgaggtgggtcccgcaggcgccttttgggctctgtagcccgaggctgtgctctgcaggtaccagccccgggcaccgcgcttgctttgtgcatatttctgcctttctggagtggctggcaggtgatgaggctgggacttggggacatgggttggaggagtggccacatcatctcattttctttcatctgtgctaacgatgccagatgccgtccccaccatccgctggcccccaccctcgacaggagagtctgtgagcgcaggagcgtctgggccagggtgggcctatcagctggctggagggcggcttgtcctcagggtgggcctatcagctggctggagggcggcttgtcctcacggtgggcctatcagctggctggagggcggcttgtcctcagggtgggcctatcagctggctggagggcggcttgtcctcagggtgggcctatcagctggctggagggcggcttgtcctcagggtgggcctatcagctggctggagggcggcttgtcctcagggtgggcctatcagctggctggagggcggcttgtcctcagggtgggcctatcagctggctggagggcggcttgtcctcagggtgggcctatcagctggctggagggcggcttgtcctcagggtgggcctatcagctggctggagggcggcttgtcctcatccacgatgcggcaaccccgtgcccctcagtcctccctccctgcgcccgctccttggggagctccagaccctctagcgatgctggcggcctggatcgaggccaggccaggggtgggaggccttcccggtggttgtagcagggtggattggtgcaggagctgaccggggcttcccaatcactgggctcaggccctcgtgttactgttgctgaggttcagaggggcggaggcggcccctgtaggtggggccgggagcaggcccaggcaggcctagagtgaccagattcatcaagtaaaaacagactgcccagaggaatgtgaatttcacataaaccggaggggatatacttctactaaagaatgaatcctcacttctccgaaacccggtttcattgagtgtcttgcggtttttctgcacccaggtggggagcagagacagggtcaagtgtgggctgggctgggcagggagagtgctaccccagcccgccctggtgcccaaggccaagtcttgctaccccaggagctgtgtccaccccgcagaggctccgcgggaggaaggaggccccatctggatgccaggccccgctttggggctctctctcttcctccttttgccatgatgttaactattccccctggtgccagtggaggggcctcagcagcagatgggggctgggccgccagccaggttgcacccagaagggagcctctgaggggctatttgggacaatgaagtcatggggacgggatgggggttgttggatttggccgtcatggtatttttgcatccagaagtctttttgaattttgtcctcaatgatgtttgaagcacaaaaaccgtgcggagcttcactgtggtatatgctcatcaccgtctcctcctcggtgccgtttttagttgaaaaggatccacatgacaaattgtaggccaattggaaggcctagaagcaagatgtgaaaaacaatgtgagttccacagcagccgcccgactgggacacatgcgtggctggtcccaggttcgccccagccctgtgtgcccggagtctcccctgagtacccgaagtccttaacaaaacaggccaggacggtggcttctgagctgctcctctggaggcgatgaaaacaccctcttctccaggggctcagcctgcaccagggtggggtttctgagaggcccctcctcacccgaggggtgccgctgaggggcctggccacactccccctgtctttgcaggacgctgctgaccggggcggtgggctccctgctcctggaatggtacggctggcagagcatcttctatttctccggcggcctcaccttgctttgggtgtggtacgtgtacaggtacctgctgagtgaaaaaggtaacgcaggccgggcgggctagtcccgggcgcccacagctgcccagtgcctcctcccctggtggcagccgctgagcagcctggagcaggagcccggagacgatggctttgacctcccaaagaatccgccagtgaggaaaagcgctcgggtgctgagctgtcagcggctccgccacccaattcgatctggaaggttccatctagggctaaggcagacacccaggaagacctgctgggcacaggtcaaggcagggtgcaggagcagccgagtctttgggtggccagggggctctggaggaggccgtgtggagggtcgttcagaacgcggttctcaaaggtgatgctgcctgttaggtgtctggtaggggaggccaagggaggctggcgcccatgtgcaacctgaggcatggacgaggcctgctgacccctctggaaccacccccaaatccccaatcctttggcaacgggtggcgcctcccgccctgatagccatcagtttgaaaccgttgctccctcagatctcatcctggccttgggtgtcctggcccaaagccggccggtgtccaggcacaacagagtcccctggagacggctcttccggaagcctgctgtctggtgagctgggacctgtgccaccccttggagcagcggcagggccggtgaccatgggggtgtgaacctggccggacctgacagcccttgagccagcagggcctagggctcagagaagtgggactctggcccccaggggacgcctctcggggtgggtcccacaggcccggccagctcgtgcggcaccagagtcacggtccaccattgggccccgcagggcagccgtcgtctcccagctctctgcagcctgctccttcttcatcctcctctcctggctgcccaccttcttcgaggagaccttccccgacgccaaggtgagtcgggggctcccgcagggtgaaggagcgcccagaaggcacgaggcttgagctgcaccaggcactgtgggtccttggcctgcagatggtggaaccctcggctcctcctggactctgagggtcctggcactgccaggctcttcctctggagaggaccccgtccatgctcggggcaggtttctgtgtttgaggctggaaatgatgcgggcgctcggtgccttcctgctgcggctgcagccctcccagccctcatcgtgacctgctggcccacagaacccgacttcagagcctgaggaggccggtgcagaagccgggatgtggacagaggggtcacctgcggtcagcacggttccttctctgaggctgtcttgctgccctgccgggtggtggtcaagagctgcacattcccaggagcagggctggccctgccggagagctttcctgggcagtggtgggcacgggggcgctgtccagcctgagtatcctcttccagatggccagatgccggccctggccccctctaaggccaaactcccccctgcagggctggatcttcaacgtggttccttggttggtggcgattccggccagtctattcagcgggtttctctctgatcatctcatcaatcagggtgagccccagggaggggaccggggctggaagccacaccctggttcacctcgctttcgaggggcaggatgctcccatcctggggctgcagcttcagcacacggagagctgggacagaggggcacttctttccaggctcggcctcctccttaaagggtggggttagactgtggtggagggtctggtctcacggtgactgtggagctcacccctgggggctggatgcagcccctgaccctccaggaaggcacctggaggggtcagaggttacaagcatccttgaacctttggaagagcttctgtctttgttccatgtgctccagacccacgctgggatgagccccgagcgggctgcgtgtttcttcccctagtgcagtgtccgctgcacagacacgtacaggcggatgcacacgcgtgcccacatgctctctccacacgtgtgcctattcttagaatgttcgtgtttttcctaattgcaaaaggaatacacactcgttgtggaaaagctagaaaatctggagcagcagaggaagtggggccgctcgcctgtttccgcctctgtaactgctgtgtggctgttctgtgtttctgcccaaacccacgccttgggaaccttccaaaggcgcacatgcggcctcgcggctgcaccccacatgcgtgtgtgcacacgtttttgcctgcagcacgggatagctgtcttgagccccaagcctcttcctcccctgctgcccctctgcagccattcgggatgggaccccctctggggtgtcagcacgaaagggctaacgggagccccttccttggcctccccctgtaggttacagagccatcacggtgcggaagctcatgcaggtaggagaatcattccggtcgttctctctggatatccctgctttgttcagggtctcccaggaactcagggttgtgtccccaagtcacctgatatctgggaccaggcaaatgccaggcctctccatgtgtccagcactggggcccagaaggggctgtttagacagctgttggggggaaggctggggtcagcatcctgtgcccctctgggcccaggcctgagcttgcccacgtcgaatagggcctctcccttggagcggggctgattcttgcggagactcctcccagacctcctctagggggcctggtctgagagaagtttgtggtcgcagccaacctgaccgttgtgcggtgcgcccaggggggctttcgggcagctgagtcaggagagggccctgctgcaggcgggctgggtgcctctccgtcacggtggcgctttcctgcagggcatgggccttggcctctccagcgtctttgctctgtgcctgggccacacctccagcttctgtgagtctgtggtctttgcatcagcctccatcggcctccagaccttcaaccacaggtgagggccgactgctccatccaccagagcgccgtgctgcccgcacggccgaggcccgcacatgtgaagagggagctctgtccgcctctctcagtctcttcctcacacttcacccccttcccaagctgctgggcagtgactgcactgaagacccagtagttctttaggaaccagcaattcacttcagtgagcagcacgtgcgcgtgatttgtgcgaacatgctttccccacagcactttactctaaggagtcgcttcctgcactgggtcctccatgaagacgggcagctggggctcgggttggcatggtgtgcagggctgcagtgctctggccagtgggtggttggggctcgggttggcgtggtgtgcagggctgcagtgctctggccagtgggtggttggggctcgggttggcatggtgtgcagggctgcagtgctctggccagtgggtggttggggctcgggttggcgtggtgtgcagggctgcagtgctctggccagtgggtggttggggctcgggttggcatggtgtgcagggctgcagtgctctggccagtgggtggttggggctcgggttggcgtggtgtgcagggctgcagtgctctggccagtgggtggttggggctcgggttggcgtggtgtgcagggctgcagtgctctggccagggagcaggcctgagcgtgtcccagcccctcccgtggctccacgagaccttgcttccccgcttcccctgtgacaaccctgggccaccagctcggtggtggccagggccactcaccaccctctttcctccccacagtggcatttctgttaacatccaggacttggccccgtcctgcgccggctttctgtttggtgaggaccttgccttaccccagctttgcccctccctgggcctccgggtgggtgagccatgggggatcccggagggcttttgctgaccatccatattctctctcgctctggcctcttcacaggtgtggccaacacagccggggccttggcaggtgaggggcgggcctctgtgcccaggagttcccctgtctgtggggtttgaggccaccgaggtgctgcagggtggggttgtgcctcccttcagagggggtccgggtgtcagaggagggcacagaccccagagcaggcccaggagaggaggatggggctgccttccaggttccactggactttgctgacggcaggtggctcatgagtcgccatctgccctgactcacagatatgttcccatcctggtagcccagggtccccgggacacctcctggccccgctgagtgccatggatgatgggggtccttcttcagctcagcctcgcctgggccggcctgtggctcccattttcctttcagcgggacaaaggggacttgttaccaggccattttctggatggcctgtgagatctctgcccctccaagaccctccaagtctgagcctgacccacagctgggacactgaattcagccctgggaaccatgggggctcctatcaggcgctagacccccagcccttcccctggcactaccttgggaaccagggtggggtgtggggcctgggctgcccgggagcactcagcccgcctggccctctcttgggcaggtgtcgtgggtgtgtgtctaggcggctacttgatggagaccacgggctcctggacttgcctgttcaaccttgtggccatcatcagcaacctggggctgtgcaccttcctggtgtttggacaggctcagagggtggacctgagctctacccatgaggacctctagctcccaaccccacagcctctccaaggacccaggcgccagcagccccaggacacaggggactcagtgtgtgggacttggtcactccatgtcagacacacgagcagagaggaacacaaaccactgtggagcctgaagctccttaagaagagtccacaacagctggtgggagggtggggtgggcctgggtccagaccaggctcgctgctctctgggcctcagtttccccacctgccagcgggctcggccctgtcctcctcacaggctggtgtggccgtcagggtgggtggggttattgttagtaggcgcagcctcattcccaccacgatctgttccgcgtggttcccgccaaacctccctcggtcgccgtgttctccgcaagcctcctgcagcgcccgcctgccaatgtgaggctggcaccaggctgcagcctccccaatcccagcccactttgctgtgtctctggcgggctgtcctccttggtgggagctgtcctgcacactgtaggatgcttaaaggtatccctggcctccacccacccctagccagcagctcccagtcagacaacagccagaaatgtctccagactctgcccagcctccccaggtagccaccctcgagacacgacctcagagtctctgtgtctcctagaagcctgacagagacccccagggcagtgggtgggtggcgggctagagacccttgcctgtgtccgggaccctggcgccgctctcccctcctgtggatccctccgcactaacagtgttctcagtgggcagacgcctgggcaccccttgggccctgcccagcatggccatggcgcaggctctcgaacccgcatggctttcccaggcctggtgattctgctctccagggacggttggcaccttcctcgggggcgggccccacgcaccccagaacacacagacccacctttctggcgttctttctacctcccttttcgttgcctgaggagctggtggtttcatgagttaatgatacatcttgcaaggtgtacacatagagaaaaaaacctaaaaatgtggaaaagcacgccaaagccttatttaaataataactattaaactattcaaaaagaagactgttattttatttaacacctttgttttttaagaatgaacacgtgttaaagactttctgtaactaatttcatgaggaaacgagtgacacgttggaatcaggtcaaaggagaatcccaggaacggactcctaggccgggagtgttgaaatgagcatgccagcagagccaggctgggtttcggggttcctttgccgccaggggtcctgcgtgtccacagatgacagcgatgtaccctgctatcagctgtccacccagctttcccaagatgtggggcccccatggagtcagacagcccagctgtgctgtggaaagacaaagtggagttttgcacttgagcacaaatgttcccctacaatctctccagtttcggtcagcccaaccctgtggcaccatgggtacagcctagagcatcacccccacagaggcttcgggacggtcctgctggactgctggacgctgctgtggggtcttggggcaggaggggcttccagaagcctggcagttgctgtctggaggccaggaagccaagcccaggaagcccacctgcggctgagttcagaggtggggcctgtgcgttgtgaatgaattgctgtctctctcctcctcatcttgcactaaatctacataacttaaaatttaccattttagccatttttaagtgcacggttctgtggcattaggtacattcgcattgtgcagccaccgccaccctccgccttcagaactttctcatcttcccaaaccgaagctctgtgctcattaaaggctagctccccgttgctctcccccagccccggcaaccccattccactttgtgtctcgaccgtaagtgtggctgctctgggaccagtgccagtgggcgcacgctgggtttgcctacgtctggcttacttcactcagcagagtgtccttcggttttatcagttttgtcacaagtgtcagcatttttctcatttttaaggctgaataaaatattgtgtggataagccatgttttgtgtatctgttcacccattgatggacctgtgaacacgagtgtgcaattagcaccttttatttttattttatttattttttggagacagaggctcgctgtctcccccaggctggagtgcagtggcttgatctgggctcactgcaacctccacctctcgggttcaagcgattcttctgcctcagcctcccaagtagctgggattacaggtggctgccaccaagcccggctaatttttgtatttttagtagagatggggtttcaccatgttggccaggctggtctcgaactcccgacctcaggtgatccacctgcctcggcctcccaaagtagtgggattgcaggcatgagccaccacgcccggccccggccctacttttttttttttcttggagacagggtctttctccgtcacctaggctggaatgcagtggcacaatcacagatcactgcagcctcaacttccctgactccagtcgatcctcccacctcagcctcccgagcagctggaaccacaggtgcacaccaccatgcccagctctcactgtgttgcccaggctggccttgaactcctgggctcaagtgatctgtcaccatggcttcccagagtgttgggattacaggcatgaaccacggtgcccaaccagtcagcaccgtctaaaatccacagccagctgtaaaatctctgagagcaaggaggcagcccctcccagggaactggagtggagaacccagaagggatacaggactaggtgggcagtgcggccgccccttgggctgcacagtcctgcaggaccaacattcctaggccctctggattctgtggagtttctgtcacttccttgcagagtgggggctggggaggccgtcatgtgggatgtgggggcgcaggcccaggcacggcaggcaggcccacccccttccctcccagcagcttctgggtgccacctccccggcctttcctcaggcagatgttggagcccgagtcagggagactgtgggtggtctgcttgttctccagctccagcagaggggatggtggggtctgcatgttgttgtctgctgcagacaggcccagatgccatctgcaccccgtggggcagctctgcaggatcgtggtgcaggagctgtgggagcccaaccccctggccccccagtctggaataaggtgcaccgcgggatggagctcctcagccgcagagtgagcgctgatggcagagcatgctcgtccattcgcccgtgtgctggctccttcttccaggagctgttcggccatagctgctgactgcctctgccaggtcagctccaggcttgggtggcagtcctgacacggctggggcgcaggggccgggacgtgggcgggaatgagagggaacctgcctgggaaggctggggaggagcgtccaggccccgtggtcatttgcggaggtagcgagtggcagggcctgcttgggtggattctgagcctggaggcctctatgcaggccagcacagacagcctcgggcaggagactcccagccgcacacaggctcctggtcctccagctcggtgcccgccctcctgggaccttgctagaaggcagaacgtgctgtcagtgccacgtcagacccggctcccaaagcccccccacctcagatcctgatgctggcccacgaggagctcccatttctgggtctggattttcagaacccccccaacaaaccactctgctgctaggttggagccctgcgggcagccgaaagccaggaggaggcagcagggcccacggcacctctcatcagcgcccttgtgccctggaagcaggggctctggccagctggggctgtgtgtgggagcatgtgtgtctgtgtgtgtatttatgagttgtgtgaccctgtgtttgaatgtgtgtaggagtgtgtctgtgtgtgtatgagttgtgtgaccctgtgtttgaatgtgtgtaggagcgtgtgtgtctgtgtgtgtatttgagttgtgtgaccctgtgtttgaatgtgtgtgggagcgtgtgtgtctgtgtatttatgagttgtgtgaccctatgtttgaatgtgtgtgggagcgggtgtgtgtgtgtatttatgagttgtgtgaccctgtgtttgtgtgtgggagcatgtgtgtctgtgtgtgtatttatgagttgtgtgaccctgtgtttgagtgtgtgtgggagaatgtgtgtctgtgtatttatgagttgagtgaccctgtgtttgaatgtgtgtgggagtgtgtgtgtctgtgtatttatgagttgtgtgaccgtttgtgtgtggaagcatgtgtgtctgtgtgtgtatttatgagttgtatgaccttgtgtttgagtgtgtgggagcgtgtagtgtctgtgtgtttatgagttgtgtgaccctgtgtttgagtgtgtgtgggagcatgcgtctgtgtgtgtatttatgagttgtgtgaccctgtgtttgaatgtgtgtgggagcgtgtgtgtctgtgtatttgagttgtgtgaccctgtgtttgagtgtgtgtgggagaatgtgtgtgtgtgtgtatgagttgtgtgaccctgtgtttgagtgtgtgtgggaggatgtgtgtctgtgtatttatgagttgtgtgaccctgtgtttgaatgtgtgtgggagcgtgtgtgtctgtatttgagttgtgtgaccctgtgtttgagtgtgtgtgggagaatatgtgtgtgtgtgtatgagctgtgtgaccctgtgtttgagtgtgggtgcgcatgcacgtgtgtgcacgcatccgagtgtgcatgtgcctgagtgtgcgagttgccgcatgtgcgtgtgcgtgtgaatatgcacgtctgtgtgttcacgtctgagtgtgcacacaacctcaggacctggccgtggcggtcattcgctgtcgggccgacagagggtgccgtcggacagggctgtgccggctctctgagctcccagcaaagctgtctcctgcttgggactcagcgtgggggaggagccggccgctctgctgtgagagaagggaacgggttgcgagggagacctacgaggtggaggaacagcgtgggggatggcagggggcaaagtgacgtccagtttggggtgggaggagggagagtgtgaggcccaggagcgggacgcgggggagggggccgggcgtgggcaccggatcttctcaggactggtgggtgtgcctcaggggcctgatggcctgatggacggagggcaagaacccttccaccatccgctccgtccccagcctggggcaccacggcgcgtccttcccccgggtgcgcagcgtgtcctgcctcccccttaaaggacaaggggcagaatcctggcccagggcagagctccaggctctcctcgccgcccctccccatggtccagcacgcccccatgcccttcccctcaaagaccacagggcccagcagggcagggccgggctgcagtgtggacagacggctcgggtaggagttctgtggcgggggctgcagtcccggccccatccaggacaatcatcgtctaaggagcggctccgggtccgcgggcttggggaggctgggcgaggcacagggctgtgggcacgggatcaccgaggacaccagctcaggaacacgggctggggcggggtcacatgcgggcggtgccagctctggtggtccgggcgctgcagtgcccaccgagctctacgcttgctctttcccacgggactttgcatgaagatttcgagtccctgtgacggggagtcctgttggaaatatttactattgtgatgaccggtccggagaagctgggaaacacagaggcctgtggaggggagaaccagtttcccggcgcgctgcagttgagccgtggctgcccctgccagcctcgcagcccacaagccctagaggccccatcctggtcacttcccggcttctccccaagcccactgccctgagtcctcccgccccaccccccgcatgtccctccagggctggggctgtgcctgcccgagctccctgacccccaggtcctgtccccaggcccggaccgccccacgccagcctccccagggctctcctactcacctcccctcctggtaagaggcacttatctgtcatttcttttcttttcttttcttttttgagatggagtctcactctgtcgcccaggctggagtgcagcggtgcgatctcggctcactgcaagctccacctctctggttcctgccattctcctgcctcagcctcccgagtagctgggactacaggcacccgccaccacgcctggctaattttttgtatttttagtagagacggggtttcaccatgttagccaggatggtctccatctcctgaccttgtgatccgcccacctcggcctcccaaagtgctgggatta[450 bp omitted]tattcagcgtcgccggctgctggcgcggagccgaggtctgtgttccgacgtgcccagcagggggcctgtccgagggggagcgacggtgaggaagctatttattgaaatagcttcattaattagtaattaacagcagggtaatgactatgtcacacatcgtaattcagtggatgcccttcatgtgttatgaggcctttaattaaaggacgtgcattttaattaaaggggtgcttggccctttggcctttgcaatacaaaagacgctctcaactttcaaagaagctgacagggaggctgtgctcgtgcatggagtgggggctgccgggggtgtccaccctcagggcacgcctcgccttccagcccagctctggctggtcctccttggagtccattggacaacctggtggccatgtggggtacaggaggggccctgggccagacagccatggatggggaggccgaggtccctgtgaccccccttggggtccaagcactcttctctgcccccgcaacttatctatctgtgggttggaaatatagtgtctgagaggcaccagggacacttgtctcccacactggtttgccaaaattctagggtcttcccatcccagcactgcctgggcacctttgtgcccatcgtgggagggtgccctgctgaggctgttttaaaactggcacccacattctttccctcaagagatggagcctgtgtcccctccccttgaatctgggggtggggacttgtgactgcttctgaagctaaaatgtgatttctgcagcttctgcctggatatcctgggcactcactcttgggacccggccaccatgctgtgaggaagctgaatcaccccacgcaggagccacctggagaggccagacatgcacctagggtggggggagggggtgtctgagctggttggaggagggaaggctgttcactgagagagcagacccaggagccccagtggcagaaggggcccggcagggagtgctgggcagggagcgcccatgtgcccacccgagtgccagtgccagccagctgctgcccggagagccccggccctctgtagctatctggcctctgctcatggctgttgctcagagagaatctgaccagcactgacttcacctccgcccaccccctgaggcggcagctggacctcagcgttgcttcaggaagaagtcctcagccaatagtgtccatgccaaggacaaatctgagaggccactaaaaatgccagagacatgcaggataaaatacagcctgtcccattaaattattgatgcctttaacattaattaccatcctccaaacctgcagtggctcacatcttccctccttcctccggcttggagaaccttcagctagagctcaggctggaaatgtattttactgttttccctgtgcctctgtcatgcaggggtcttggaggtgcactcccaccccagcacaggtgccacaggactgcctctggtgcccttgacccacccacaccagctccacacccacacctccccccaaccttcccccagcaggcgcaggactgcctctggggcccctgactcacccacaccagcctctgtgatgtgggggtcttgggggtgtgctcccaccccagcacaggtgccacaggactgcctctggtgtcctcgacccacccacaccagctccacacccacacctgtccccgaaccttcccccagcaggcacaggactgcctctggggcccccgacccacccacaccagccccacacccacatctgcccccaaccttcccccagcagagaggctccaggtctttctggccccttctccccttgccatctatttttatggctgcctataggaacgttttccatgaatggaatctggaactcccacacagacaggcctggtgctggggtgggtctgacggtgtcgtgtgagttacctctgctgccctagcggggtcctgtgacagggcagcctaaacaacaagaatgagttttctcagcggggcacagtggctggaatcccagcactttgggaggccaaggcaggaggattgcttgaacccaggagtttgagaccagcctgggcaacatggcaagaccttgtctctacaaaaaggaaaaagaaatattagccgggtgtgggtgtacgagcctgtaatctcagctaccccagaggctggggtggaaggatggcttaagcccaggaggtcaaggctgccatgagctatggttgcaccactgccctccagcctgggcgacagagcaagaccctgtctcaacaaacaaaaacaaacaaacaaaagaaatgggctctctctcagctctggagcccagaagaccgagatcaagaccaggactggttcctccggaggccactctcctccctgtgtccttctggtcatccctctgtgtatgtctgtgaccaaatttcctcttctgatccagccagactggattaagaccaaccccagtgacctcagtttgcctttcttacctctttaaagaccctaactctaaatgaggctgcacctgaggtgggagttagggcttctgcacaggaaggggagggacacagttcagcccagcacagcgaggctccattcccgcctgccctggacccagggtctaccaagcagcgaggctacccgagagcatacgacagcctggcgctgccctgacctccttggggactgaggggtggtggcgacagacggctcacagctgagtccctctcctgggtctcacgctagcaagttgacgactggtcagcatgggggacaaccccgaagccacgggggctccagagcacctgtgggccgcagaagcttctgtcggggctgcatcgcaccccaactcctcccccgccctgccttgccccccagccccaggaccctccgtcggcaaatctccatctccatcaagtttgtgggggcccagcctaaggcgagaccccaagccccttgctgggagggctcccagcagaccctccctattaataaggaaaaaaagccaaaccgagttgagaggaccacggcagatgacatgttcggccacaatgccacaggactcagtccagccaggaggaagctggggacagatggagccctagggatgggcccaggcaggaggtgctactgcaggggatgcgggtctgtggcgagaggggtgacacaggctccagagcctggaaagcagggcccggagggtcagcccacagaaagcagggcctggagtgtcagccccacagaacactcacaagcttggaggcgccagccgcgctgctctgatggctgcgccctgtgtgcaacggtaagctgtgcctgcaacatggactgttattacgtgtcattataaacagaatagaaacccccacctgatgccacgcccacacccactagaatagctggcactgtggccacgcccaatagaatggctggcacggtggccacgcccactagattggctggcactgtggccacgcccactagaatggctggaactgtgacccacgggaggatcaggagggaccgaggctgtggaggggtcctaagagcctgcctggtgtcggggagctgctgatgcccctgttaaagtggagcacgtggaactggcccccgaaccgtccccaccaccctgctggggcggccggtccctgagtgggtacgaggccagggtggggtctcacagctcccgtgggccatctcccctcctggcgcacttcctctttctggttttaggatgtcaccttgatagacgtcacagaaaccgcataccgttatctgagaaagtaaaacacacgagtgagcccaggcatcctctggggtttggtcagtatccttcgagctgctgggcgtctgtgcaccgcgggttcccctgggccccctaatgggaagcgttctcctgccgggtcgtagggtctcctgtcaagggcagcggctgtcccacccccatctccctctgctgagacacctctgctcggcaccccgctccctgggcctcgccagggacacatagcagggggctgtgagccccagaggccaagaaaactgctccctgcttccagccccagacaccacctcgcctgtcccaggtggctgagagtgggatctgggattggctacttcctttgggcatctccctgccattcatacccaggccatcctccttccttcctcccccagggccaggatggtcccaggcaaggatgagaggattgctcacccgagcaaggcccgaagcctttcctgaagctcatttgggcaattggaggctggaggtccccccgcccagcccaggaagactcagcctccgccccctccatggcccctgagtctcagttctgcttcggcagctcctcctgtccccaagcgtcctctgttcccgcagcctgagccagcatggggaagctggagacaagccctgagcagccgggcccctcctcctcagggacccctccggagctgggcacgggcagcacttcctcaccccgttgtcctggggggccgagcttggtggatggcagtgcccagggacggggggaccctcggaggccggggtgtttcctgtggacactcagtgtgggcttctcacggggcctgaggggttttcagcgaaggagttgcctccgccctttaggctgtttacgtgctccccgtgccaccattttctccccaaatagacaatctggctacaggctcgggaaggcaccggcgcggctgaccgctgcccccacgctgaccctaggacggtctgtctctgtgtttttgccagcatcccatggagcggatggttttaggagggactttcttggacattcccttgctaagccagggaactcaaggatcagcggtcacgtacccagttttcaaacattttccatttctacgtttaattggaggaaatgattttaccaacattaacttttttatgtggaaaactacgaacaagacttggccactgtcaaaatttgccaattatcacgccccatctctcttgggcgccttcagtttcctggctgggtttgaagctctagctgatgtcaagtggaggttattcttccattggcctttagtgggtgacaaaggtgaccctgagctcaacagcaccacgcgggccccaggcaaaagcagtcgaaaacctggatcacgaatgtttggggcgcaaacagctgagccagggtctcccaataagagctgagaacacatactggctcctgtgcccgaccgaagctcgatgccctggctggtcctcccctcatcgtgcgagggccaaggacgtggctctgtctggctgggccctctctgccccctctgccaggagggctgaggtgatagcagctctgcccagagtggagtttcctgcccctcccactgcaatacaaagctcatgatggtcttggattttgcatattgatcagtccatacagagcagtgaccgtgggcagcaagtggctcaggctcgtcttgtccctgggcaagctggggcctgggagaggacagacagatgctcaacactccagcacgcagagcccctcagcacagctcaggctccttcattagcatccctgcctgccgtgcagacccacccagggtcacaggctcctgtccctagtcatctccaggattggcctaattggcggcttttcggcagctctcagagagaagggtgaggcgctgcggccatcccctcgtgggcggagagctgccgtctcagccagcgttgggggggaccctgcaggggaggcgaggagacaggactgcctgccagccctgcccaaccctgccggctggtcgctgtctagagctggcaaggaaactcggtttgtttgcagaaaaacgaagagaggagaatagcccctgaactcatgcagcccacggttgccagatttgactgggtcctttcagtccagcggccccaggcagggacaggtggcttccctgccagtcctggtctgaaccccacgggcgagggtcctgcagtcccaaccctgcatctcaggctcaagtgcggcccccctcgctgcccagctcggtggctgtgcctgctcacggggaggccctctctgcgcacaaaccaccggtgtctgtcccggacagaatcagtcccatcttcctttgctcaccagcacgattcaaagggggctgaagaataaatgttttcctaagttttagctgacattcaatttcaatgactttttaaacaaagtagctgttaaacgtgcaatgttttatggtttcctgatgtctgacaggtgtttttgcccatgtgggaagcagatgctaatcgcattctccctaatagctcataaataataagcactgagtgttccctttgtgcgccgtgctgccagtggccaatttgttcttcagaagtggccacgctgcctgtcaatcagctctcgcccgaggcactttttggtgattagaagccccttggagagcgagaactccaaattagttttaaataaaaaataagaatattcatgctgctgaacatctaaaggtaaaggagacaacacagtccaaacctgcggcctaggtccggcatcgctggtggaggggccgcgcgcccagacccaccggggtccccggggacggggacgcggacggggtgcagacggcaccacacagagaggcacggggtgggggtgacaggcacggagccgcttggcgggaggggctcaggcagcctcctgtcggctgaaacgcgcggccacacgagagctcggctgcgttccgggactggcgtaattggcaggctccaggcaagagcgctcatgctgactggcgcctttgctgggacttgaaagcaggggaggggatgtgcctgtctccttgagaggagaacaaatgttccctttgaagaagtttgcgatgagcggggccagtgtcagaggagatggcttctggggtggcgggcggtggcggcaggtggcgctggccctgcccctcccccctctcccctcccccccttcccccctccccccagcaacctccgtgggtctctcctttggggcagtctcagctgggtgggcgccgctgccacccgcgtcctcaaagtcactcttgctgttgtcccttctgtgcatcagagtggggccgtgtgcgcccttctggggttcctgctggactcccctcggccccaggctctgtccgtggtgcagggaggtcccgccatccacccaggctcagaaaatagcatgaatcagctcatgcagtggggaagtgggaccctgggctaggggaagccaggggcagtgtcctcagggtagagaggccatgaagagctggggagggcaggcagggcttctggaccagtatgggcaaaggcccggtgggttcgggggcggtggtttaacgcctctctgtgagaacccaggatgggcgagggctccaaaggtgagttggctacacagaaccctccagaatcttttgaccctcactgtgctccttccgacgctgagggtgacccactctgagacctcggggctgtctccctccttgccagcgtagagcctgtggaccatgggtgcaggtgtggggcctcagggtccagtaggccagggagcggccagggagcggccagaccaagacctgctggggggcagtgagcaggctcttggtgggacagactgggggaccgtgactccacttgggctggggacagcagagggctctgggcattgggagaagggggcaggctgagagaggggcaacaggaggcagcaggaacaggctgggcccatctgaggctggcgaggccttgagtgcagggaccctggaaggcaacgggcagtgcccagctctggcctcctccagaagtgccccgacagcaccagctgccccaacccctccccacctctctccacttcctcccaggggtttccttccagcgaccacagctgccaggccacaagcttggggaggatccccatctctccagaccccacccggttctccacactgagggtgccctgccctgtgccttccctgtgctcacaggctctgggggtccctgacggccctgggactgggcgtccttctctgctggatgccagagctgtgagcccaaggggccaggagtgcaggctgccctcaggatctggcatgagaagcctccgggttctcaggcctgggggcaagtcctgggactgagcaccgtctccactggcctaagctgtgggcagtggggagggaacatggaggaggtcacatgtttaagtctgaaaacaaatgatgtcctcccacttcaccctgcctggcccccacagcccacggccactgcccccaggaccatttcacagctataattcttgtccttcctggctttccaactaatgcattgtgattaggctatgcattaattaataggcaaagacaaatccatttcatggtgcatgcattctcgagttggcttccggaggctctgcaggagggactgaagcctggccgggggaggtgccggtggctgagcctgctcccagtcgatggctgaggacccggccgcacctcgatggctcacacggtcagggaacccgggttgtccctggaagggggaatagggaagctgtggaacccatgggtggccttaaaggtggctgcgaagaggatgggggatggtggtgcctcctcacctgccctcacagaggactgagggccctgccccaaaactgcaggcctgtggcctccgtggcgggcacacaggacagggtttccatcacagagatttaagctgccctcatcactcccatccccttcctacaatggcatcccccgcgctcagggcaaagagcagacccctccctgtccccagtacaggccccgacctccattccagccagggcacctggcaccgccctccccaatcttagtccccctcccccacccacacaccctttcccctcccctgagcaccctcattgctgcctcagggccctgcatgtgctgttcccctgcctggatgcccacccccaagggtcacctcctccaggaagccttccttcttctcaggctgagttggctggttactgctgtgcctgctcttgactggggattctaccggggcgaggccaggctgctcttatccatcgtcatgtcctcagtgggcacacagagacctgtgaccatcagtcagtgtgacagggttaaggctgctaccatcgacatcagtgccatctcttctttgtgattgtctttgtaaagaatgtgccaaaatacacataacagaaaacttaccatttcaaccactttttttttttttttttgaggcaggcccaggctggagtgcagtggtgcaatcacagctcaccgcagccttgacctcccaggttcaagcaatcctcccgcctcagcctcccgagcagctgaattacaggcccgcaccaccacgcccggcaaattcagccattgttaagtgtgcttttcagtggcattaaggacattcacaatgttgtgcaaccatcaccaccatgtacttccagaatcttttcaatttgtcaaaacacaccttgtacctgtaagccatcactcccaaaccccgcccccagcccctggcaaccaccaatcgacttgttgtctccgtggctttgcaatttctgacatttcatgaaagtggaatcacaagtgccctccgtgtccggcctcttccacagagcgttgagttttcaaggttcgtccctgttgtagcaggaatccgtgcttcacttaggctgcaagggcgtaccatggcatggaggcacctatgggtggacggcgtttcgctggtctgtcctgggctgagggctgagggctggacacccccacctggctcccgtgtcctgttgaagaggtgtcgaatcttcgccgctctcgagatgcacgtgtgcagctttggccgatcccctgttttcagctgcaactgtctcccgaagtcacagattcccccttggtctttggtgtgcggggagggctacaaatcctccccaagaatgcccaccctgcccccgactggggcagattctggttatccataggaggcccctcctgccaggacagggcgcatcctctccgcctcctgacctccctgccctgtcctgggctggagcagccaagccctgagctggcgaagcaactcgagctctttgcatatgcgtggccgcccgagtctccagctagcccccctgccatactactaaatattttagcaaataaaaattttttaaacgtgcggccagatgtccaggttgacaaagtgcttaaggcgtttgactgataaaaagctggaacccttggtaaatggggatttaaaacaagccctgaggcaagtgtgtgatattaaaaacatcctgggctcttttgtgcagggcccgggtgcacagaggcttgaaggcgagcgtccatctgtcgccgccgtgtgtcctgacactcaacaaagctggatcttggagcggtggctgctcagcagcaggcctgggtggctgggcgcacgctcaccacaaaggaggtgccatcaatattcatgagctgggcctgcgtggctgggtttacagagaggacgaggcagccacaggccagacacctctccgtggcactggttctgggccttggctggcagggaggaacaagttctgcctccagagtccctgtgagcctccgagaaacaggccaggactctacagaggccacagttctggaatggatgaggggtagagatcagcccaggctccatgcgaagccagaggctccccagactgagaggaagcgagggagagagaaggccctggaaggatgagaggccctgggagggaggcccaggcccacacaggcaccctttgcaaacaaaaaaagcagaaaagctgagaacaatgagggagaacacctgtcagaatccgtgaaaagcctgacctcagctgtttttaatgcagaggttgattttcacacaatgcttgccaagtgggtggaggccccaggggactgatgggagtccaggacaggggacatcatcgacacacagagacgctggtcctttgtggtctgacctgtccatccatcacactctgatttgctgatttcagccagtatcaccagggcttcgcgcagggtctacagcgctctcctgaggccctccccaatcatcttatgccatcctgacacggaccacatggaggactggtgccttaagaggcggggcccgggcgggctggggaggactccagcgtctggaaaaggcctggcctcaagggagtcctggccccggcttccccggcatctgagcatctgagaaaggccactgcacgtggttctcaggctgccgcaaggactccggggacacatttagctccagggcctggcgcctgaaccagggtccagtctggacctgggagctggctgacatgggtgaggccaccccagttcctcgcccgtcttggtcccagagtccttctgagaggacccgctgcccacactcgtctggggtggatggaggcaagtgtctccttcctgatgttagaacacgaaacctgacaggtgcttggacctgggggtgaggtggcccctgctcaggtgaggtgctcaggagaggcaggcaccaggcagtccctcggggccccacaaccacagtctttcatgcaaacttgttgatcttgacacctgcttggcccagctctgtcaaagtccctctccctggtttctgcccaggcaggctaggggacaccacaggtcatctcttcacaggagctggcgctgtgggaggtgagaccttccaacctgcgtccagccctctgctggaccttgtcaggcctgaggacacctctcctaggcctagaaatgacctacagtgaggaaacctggggagaggggccggggagcaagagcaggcacttcgggctctgaggatgaggtgggatggaggagagcctggggctgtgcagcagggcaagtggtattgtgcagctgggcagtgggacagaacaggtggactggggtgcaggtggactggggtacagtgggaagggggcataggtgggcagagggtgcaggtggtcagtggtgcaggtgggcactgttcaggtgggcagagtgctggtgggtaggggtgcaggtgtgcagggggtgcaggtgggcggggatgcagatgggtgggagtgtagatgggcagaggtgtaggtgggtgcagtacaggtgggaaaagggtgatggggcagagggtgcaggtgggcagagggtgcaggtgggcgggggtgcgggtgggcgggggtgtgggtgggcagagggtgtgggtgggcaaagagtgcgggtggactagggtgcaggtgggcaggggtgcagttgggcagggggtacaggtggctggagtctgacatgggggtgatgtaggcatgggggtgcagtggcctgtgggtgtaattctccactctgccctttattcaaatgcaaatgtccagccctgtgagttcagagccttggaactaggaaactgattttaacaggggaaaatgtgaccctagaacaggactatcctcctgaacactgtgccagttggtgtctgcgaactccgccctgttgtgcattctcacttctaagaggttgtccacccctcctgggtgtctgtgggcctcatctgctgagcccaggggtggcaggagccacgtcttcaccgtcatttcacagaccaggatacggaggctcacagtagtcagcggcttgcctggtctctcgggcattggttcaggctctggcccctgccttgcagggatgccccagtctcctatcccagcctgcaccctcctgggggccacgccagcatggtggggcgagagggttctgcagagagagcctgggggcacgtttgggatcttagccctctagtgcccttccattttctactggggcaaggagcgtgaggctccagcatcccctccagaacgttcttgtggaagctccgctttgtttcagaacaatggaagcttaacataaatatgcagaggaaatgtgacgtcacagtttttattgggacctggaatcactcctgtgatagagtcattacctgggttaagctcattaagttaattaacgtgagcgttattattgctgataaaagatagtctcaggggattggtagagccagcgtagcatgcaggggtgggcacaggggggatggggatgggggactcagcagagacagctgggggacccggggacccctgctaaagctgcaaaacacaatcacattctcacacccgggctgcccccaccctgaggacacgggtgaacacggagctcgggggacacgaccatccagcgtcatgaaagccaggcgtgcgagccaactacttgtacctgcaggacaggaacagtgaggatagagcgatgggcacagacctcaccccgaggacagaggtcattgtcaccaaagacccccgagagaggacggcgattggtcttgaagggtcgatgatggacattccttcgtatgtggcccctcttttgggatgttcgcttctaactccagagctcggagactcatctgaaggttgaatttagaccccatcattatttttacatgtgtggaaggatctttgggtggttttctttatattttatattattttattttattctattttatttttttgaaactgagtctccctttgttgcccaggctggagtgcagtgacaccatctcatctcactgcaacctccacctctcaggttcaagtgattctcttgcctcagcctcctgagtagctgggactacaggtgtgcgccaccacgcctagctactttttgtattttttagtagagacggggtttcaccatgttggccaggctggtctccaactcccggtctcaagttatcctcctacctgggcctcccaaagtgctgggattacaggcatgagccactgtacccagccttggtggttttctttaaatccttgtcagtgaactatctgagtgtggtggttttaaaatgtcccccatttttgtggacaatcctccctcaaaagcaggttttcttaagtgtgagccagacttagcaactggcttctcatgaataaaatgtggtggaaggggccgggtgcggtggctcatgcctgtaatcccagcactttgggaggccaaggtgggaagatcaccggaggtcaggagttggagaccagcttggccaacatggtgaaaccttgtctctactaaaaattcaaaaatattagttggacatggtggcgcatgcctgtaatccccgctacttgggaggctgagacaggagaatcacttgaacctgggaggcggaggttgcagtgagccgagatcgcaccactgcactccagcctgggtgacagagcgagactccatctcaaaaaaaaaaaaagaaaaacaaagaagtggtggaagggacagtgtgacttccaaggtgaggcgctgcccgctttgggagtccacgtggcgaggaacagaggccgcctgcctgcagccgcggaaaccctcctagaagtggatccttcagatgagccatggccagcccctcgacagcaacctcctgggaaaaacgtccagctaagccacaccccaactggaagtgggtccttcagatgaccggagccacggccagcacctcaacagcaacctcctgtgaaaaccacccagctaagctgcaccccaattcctgttcctccaatactgtggtcagaggggctcaaagcagaatgagtccatcttgagtagggagtgggtaaaatgaggctcagacctgctgtgctgcactcccaggggtgaggcattcggagtcacaggatgagattggaggtcggcaggactggtatcacaagatgcaggtcataaagaccctgctggtaaacaggatgtggtagagatgccggccaaaacgaccaaaaccaagacggtgagaagagtggcctctgctcacccgccctgctcattacacactaattataataggttagcggctaaaagacgctcctgctagtgccatggcagtttacagatgccacggcaacatcaggaagttacgctatatggtccaaaaaggggaggaaccctcagttctgggaattgcccacccctttcccagagaactcatcaataatccaccccttgcttagcatataatcaagaaatacgtgtaagtgaccttagtcagcagcccatgcggtggctctgcctatggagtccccgttcttttgttcttttactttcctaatttactttcactttatggactcgccgcaaattctttcttgcatgagacccaaaaaccctttcttggggtctggatcgggacccctttccctgctcgtcttctctgcatcagcccagaccccacacctgtttcctggcgtggacatggaggactgaggccatcctcccagccactgacacacgccccttctggggtggcccggctggcattgccttctcctaacgttcccggggtggcccggctggcattgccttctcctaacgttcccggggtggcccggctggcattgccttctcctaacgttcccggggtggcccggctggcattgccttctcctaacgttcccggggtggcccggctggcattgccttctcctaacgttcccggggtggcccggctggcattgccttctcctaacgttcccggggtggcccggctggcattgccttctcctaatgttcccggggtggcccggctggcattgccttctcctaacgttcccggggtggcccggctggcattgccttctcctaacgttcccggggtggcccggctggcattgccttctcctaacgttcccggggtggcccggctggcattgccttctcctaacgttcctggggtggcccggctggcattgccttctcctaacgttcctggggtggcctccaaggtgcttgtgactttcaggagagcccagcaaggccaccctccgtgctccttggtctgagcatcctgaggtggagggtgcatgaccttctgttcaagaatgcaaatgcctggaccaggagagcgtcggtgtgtgccagagagccgcctccctgcatactttccaccccaggcaggggctgcctctatggggccagccgggagacttgcctgcagctgccttgggccctgagttccggctcctccgaaagcagcaggaggccctgggtctccttcacccgccaccaccccatctgcaagacgggaacgagagcctggcttcgtggcttgcactgcggagtgcttaggacctgacccacccaatctccacagctcttcacagcctgtgaacgtggtaaaacgcgtgattaggttaagggtcccagcggggagtgcgccggcttgtgggcacttagtacctgagcccacccaacctccaacaactccacaacggcggttcctgagctgggctatagagcgatcagtccctcacccacctcatctccaacacctccacggtaggggctcctgagccaggctgctgagcactcagtacctgatccacccaatatccaacacctccacagtgggggctcccgtgccgggctgcagaggcccacaggaccacacaagggtctctgtgcccaatttctgggcaccctggctggctgacctgtggggtgggggcagctttgctgccatgcacacttgatggaatttcatactgacagctcgcccaccctctcctctcattcctctgggagaaaaaaacttacacgaaagatgtgaacaggcccaagtggaaaggaaagccaccaccccaggaggatgccaaagggcgtgggggcacacgtccacgccgcagcccaagtttaggatttttcacggcaggtgctgctttcatcttctggaactgctaccgtgaagtaccacaaactgggcagcttaaaacaagagaaactgatcccctcatggtcccggaggccagaagccccaaatcaaggtgtgggcagggcatgagtcctcctagggggattctccttgcctctttctgcgtctggtggtggccgtcaatcccagctcccagcactgcaagctgctggcaaaggccaggaagtcagagatggaacctgagctgctgctcagaggagccgggctcagtcacacacacgatgcagacagttcccagatcgactaaggaagcaagtagccagaagcactgtttgcaacaggctgtcattctgctttttagggaagggatatttactcagatacacactgtctctgtaggcagatgagaaaccagccactgcgcggcttctgaggaaggtgcttgtccaggaggcaggaggacagggaggcccgattcccagagctgcatctctacggaaaccgtcctctaccactgggaacattcttaacagaagaaaatacccgcagtggcctgagtggtagcccccaagaaggtaggtccacaccctaatcttcagagcctgtaaatgtggtaaaacacataattaggttaactgtcccaagaaaaggggcttatcctggatcatcagaggggcccctgatgccattacctgtggcatggtctggctctgtgtccccactcaaatctcatgttgaattgtgatcctgagtgttggaggtggagcttggtgggaggtggttggaccatgggggtggcttctaatggcttctaaccatccctgagtgctgtctcatgatagaattctcacgagatctggtggtttgaaagtgcccccacgccccactctctcttcctcctgcaccagccaggtaggacgccctggcttcccctacaccttccgccatgactgtaagtttcctgaggcttccccagccacgcttcctgtacagctcggggaatcatagccaattaaacctcttttctgtataaacttcccagtctcaggtagttctttatagcaatgtgggaactactaatacaacatacatccttttttttttttttttttttttttttttgagacagggtcttgctctgttgcccaggctggaatgcagtggctccatcgtagctcacttgctgcagccgaacacccccgggctcaggcgatcctcctacctcagtctcctgagtagctgggaccacaggtgtgtaacaccacacctggcctgcatgcatccttagaagagagaggcaggggagtttggggacgaacgcacacagaggagaaggtgatgtgaagacagatggggccatgtcacctgtgtgcacagcagtgctccgactcatgctctggcctgcccgtgctgagggacagaacccacagggaaacccatgcctctcccatgagatagaaactggccatctcctctccaaatggagattggacagactgtgttccacggacgggagcgagggcagcagcagctaaaccaggcctgtctccacctcccacacaggcagcagtctccaggtggaagtgtggaagtgtgtgctcctgggtgtgtgtgcagacgtgtgcacacgtgtatggatgtgaccgtcgggtactgggatgaaggggccaagagggatggaggaagaggagggcgctaagaagtgggtctgtcgtgggcctagcttgctgtgctgcttgactggggtgtgaggtacacccctcccctccccaggcatggctggcttcaccgtgcgtgacctgagcagctgcccagggccctgtgatgagaagggacctctgcttggtttaattctccgaagttgccatattgaaatctttaacagttttggaacaagggccccatattttcattttgtgctgggactgcaaattctgtagccagtcctgcccccaggaaactcactggaaaggtgtttacagcatcctttggaggaagggccgcagggcagggtcagccctggaactttggtggcatttaataactgcaaccacatttaaggtgctggcagctgcaggattttacctggttagtgtggcgggggaggctgggagcaggggagcctgggaggcaggcagaggctgggaggcaggggaggctgggagcagaggaggctgggaggcaggggaggctgggaggcagggaggctgggaggcaggggaggcttggaggtggggaggctgggagcatgagaggctgggaggcaggagaggctgggagcaggggaggctgggaggcaggggaggcttggaggcaggggaggctgggaggcaggggaggctgggaggcaggggaggctgggaggcaggggagggtgggaggcaggggaggctgggaggcggggaggcttggaggtggggaggctgggagcaggagaggctgggaggcaggggaggctgggaggcaggagaggctgggaggcaggagaggctgggagcaggagaggctgggaggcaggggaggctgggaggcaggagaggctgggagcaggagaggctgggaggcaggggaggctgggaggcaggggaggctgggaggcaggggagggtggccagatgtagcaagtaaggacacaggatgcccccagttaactttgagtttcagataactagaaatacatttgtagggtaaatatgccccatgcaatacttgggacctagtcactgtttttgaatctggcaccccagctgggcgtgttcggccaggtgggcagggaatcccaggggtttccaggtgggctttgtccgtgggcaccgagtggggggcctttgcctgtagtagaccctgggggccagaccgccgcttctgtgcggagctgcctgtcctcctcccgctgaggttctgaggcaggagtgcagccccaggcaggctcctggtccagaggcatccagggaccacgtcatccctggaattttggttgcatttaataactgtaatgtgcagaggagcgggtcagcgtttcagattagcgcccagcacgtaacgagggcagctgcttctgtccatctggaacttgctctggtctctctcggccaaggctcagcccacaggcctcgcccaccgacgcctgctggtctccatttaatgagcgattttggattaaaatgggagtcaacaacagggcacaatctacattaagtctcggcaaaatgaaaattgcgaagattgacttagggtgttacggggaatatataatcatagctcatccataacatcccacagtgcccgacagataactgagctgcctagagggggattaggaacgcgggcttgtggagacagccccgctgtctgggcctggcctgggaggtggctgggagcaatgcaccaggctccgtttggggtgctgacgtcctgacatcatgacttcccctggtggaagcaccctaaacctggcttgtctattaaaggcctgtccatcaaggcgtgaaagagaaaaaagttgagacgagatctgagtaggaaaacccacccgccatgttccaccttctagagacaaaggacggtaaagcgtgtctctggccgagcctgttccatctcaggagctgctagtctggtcctttctcatttgctggttcgttgcaagatcgcgtgggcctttcgtgactggtttatattctgcagtgtttgtagtcagggctggggacgtctccaggttaatgccaagtgacaggcagcgtagcggcagccctgcgggctgagctcacaggggcctccctggcgtcccctccagaccattgctgctgtttcaatccgtcagtcctgcaagggcctgagcccccagctgccccaggcctttccacaccacgcagccttcccttcgcccgtgcgtgcctggccaactcattccccttgcctgtctccaccctgtcaacccggcgcccggtgtgctgtgctgtggctggaatctggagaagtgtttctggaactgtgggagacagctgggctgcttccgaagggctgccaagcacgcatcgcactgcggattctccgtgtgccgcagaactgcaggcaggatcttgacacaggtccatggatctttccagcaagattaaggccgggccgatcacttcattccccaaacgtctctttcacatccagaggctcacgcagggctcctcctgcaaaaatcaaggcggtatacgactttcagagcttcagtgagggcccctgtggggcagcagaataagaatgacagcaactcccggcctggcccactccaggatttacagaaacacctcctgcagctcctcaaccccccagtgcagccacgttagtgctgacagtctagggcacagggagggaaggaagacagacttgaaggccccagtccggtgactccgtttatgagacattctggaaaaggcagaactcaggacagaacacaggccaggggtcacaggggcacagggcagggaccacagcaggacctgtggggtgatgcagtgttctctgtctcgactgtggtgggggccgtgtggccgtggtgtttcagaagggtgaatgtcaccgtacatacattacacctcaatttacgagacaaacgatcaaatcatagcaaagtcctggacatggagagtgacgctggctgcactacactacatgtccttcatgtcaccgaactatacacttagaaatggttaccacggtgagctccacgtttcctccactgcaggctcttcaggcagagaactggccgcacctgccccttccggctgccgctctctagtgaagggctgtggtgcctgtgtcacccccatgtggcgtggagccgcgtgactcaggtccagctggaggctgctgcgtctgtgggactgcagctgaccctgatgcagtgaccatgcgggcctggagtggggaggcccccccttaatcctcaggacgcagctcaatgacggtcactccccagcagagaaggtggccggatgggcgaggggagcgggggcccagcctgcaggtgcagacctcagctggccacctggcgtggagtttgccaaggacagggacacagtgccgaggtcggagcccgggcggagacctcaccctcagcctgtggggcagtgtgtctggaccacagcagggccctggacacgcccctccctccccagcacaccagcctctgagcgcgtctgttcatttgtaattattttggaaacacctgttcaactacatgatgggggcaaggcgtggggagcgtcctctttccacaacacattttgttgctgcaggctgtacagaggctgcttagtgacactgcatcctggagagtccatctgtcccctgtcccctcctctgtccccacagctgcaatcccacacaatatcaattagccacagcatcaccaccacctgtgcgggagacgggtccctcactgataaccagcaggtctgggggagccatgtctcctcaaagttaccttttaagcctcattaagcagaaagtcagagctgacttgctacacccatgctcactgaaaggtgctgaccgttggccgggcgcagtggctctcgcccaccttctggaacagccatgaggcaggggtgaccccaccctgggtgaggctcaggagtttctcctgggctgacacccattttctccgagccacagccacgaaggctcaggcgtttctcctgggctgacacccattttctccgagccacagccacgagatgctctttggtctcgggccacatctctacactgcgtcttggggcgatgctcacagtgggcacagctgtggtctcaggggctgatagtaaagttttattttcttttactttatttttaatttttttttgagatgaagtcttgctttgtcacccaggctggagtgcagtggcacgatctcggcttaccgcaaccaccgcctccctggttcaagcgactctcctgcctcagcctccagagtagctgggatatgggtgcacactatgcccggctaatttttttcttgtatttttagtagagactaggtttcgccatgttggccaggctggtctcgaattcctgacctcaggtgatctgcctgccttggcctcccaaagtgctgggattacaggtgtgagccactgcgcccagcctgacagtcaagttttaaatctgagctttggtgctttggaaagagtaaccttctcccccagcctcggtttctccttctgaaaaaatggtcaatggtcaatggaatcccacaggcctgttgtctcaagtccacagcctccatttcaaaaggctctgaaaatggaaatgttaaaaaaaacactcatttgatagcaaagcctgccctggagggacctgaggccgggtgtggtcttcgccttgcatgcctgcggtgggagtcctcgatttcaggaggaaacagccgcagcccctaactctggcccctccctgccctggccctgttgtgactcagtctcactccagtttccctccctggggggagaaagcctgaagggaaccatggccgaaggacccccacactgaggacaggccgtcatcctccctggcgctcccttctccttgccctcctgtgtctgggttcagggaggctacacgtgcctctggctgtgacgtctgcgagtggggtgtgccctggatgccatgcagccttcctgctgggcaatgaggaagcgctggcctgcccccggctttccctccctctctatgctcacccctccgacgcgcacaggagaagcacggggaagccgggtgcactcagagttggggacagcccgggaacctcccacgctccaactctctcttctccttccagaaagggttacagggcctgacctctgggacacccaactcatcgtgtttgccagggctttccagggtttaagaaagacagaaagggctgtgtcctgggaattggaatggtggctcacgtctcacctcggtgaaacacacaaggcaaactcgacagaaagggaaggagggccccagagatctctcagggctggaggtggagggacgtgggggcagcagggctgtcctggcaggtcagagttgtgctgtaacaggacgaaggcgagggggctggaaacccacacagaaagagagctgtatgcagcatcgcaccacaaacatgctcatatatgcatacacatgcacgcaccccacatgcatgcatacacaccacacatatgcatacaaatgcacacccccgtgtatgcacacacatgccaaacacatgcgcacatcccccacatgcatgcacacacaccccacatatgcacacaccccacatgcatgtacaccccccacatatgcacacatatgcacacaccacacatatgcaccccccatgcatgcacacacaccacacatatccacacacatgcacaccccccacacacatacacacaaaccacacaaatgcacacacacgcacacacaccacatatggacacatgcacacacacatcatatatgcacgtgtccacacaggcacaccacatggacacacacatatagcacacacaaacacaagtttgggtaacacacttgggcagagataatttttgcccccatctgatgtctgcctgtctcaagactagggtgacgacaggcgctcagttgccccaccagggccagtctttcctttccagacccgccaggccttccccaagccggacgaaaccagcacctacctgggctgggggaggtgaccaggggcttgagacctgctatacatttgggatatttttaaaagcatgggttgatggttaggggagcagagctacccagacaagagggggtgcactgcagaagcaccccatcttctgcagagagccttgaaggaggaggaggagtggggaggggaaggggagagggaagaggggagggcgagcctagtgcttttccttctgttagtgccctggaagctgctaaggtagaaggcaggagagcagacggctttggatgcatctgctcattctggacacaccgctgatgctaccaccctgagggcggatccagggtaaaagcaggggagtgctcgtctcttcccggcagcaggtgaagacgcttattttggaaacccagattcctgaatgtgaaatcaacatcttcccgtttgtctatggtgcttggaatgaaagcgagggcttcaccgacttctcagctcagggccgtggggactctctccagcaggtgtcactgacttctcggctcagggccgtggggacactctccggcaggtgggatggttctgctcaggggcttggttggtgtggggtctggaggagaataagcttctcccctccgtttcttccaccagcagcatgggcctgttggcattcactggttcatagtcggtgggtttctgaatcccagtccctaaagctgtgggtgtgttcatgtactgaacacccttgtgacgagtctctcaccggtttgcattacgtggacccaccgggacgcaatgccccaggagtctgctgggctgtggaggatggttttatttccgtgcatgaaatgcagagacggtttgaccctgtaactttggtaactttggtgtcatccgtggtcggaaagcaggaagtgctgggggccagaagcagctccagacgccgagagcacacagaggctgtggatgacggcgacaaaaatgcatcctgtcagatgccttgtggccatcagacagcatcgtgggtcctgtctgtgtctcggggtttgcggccacagatctggactggtggaggcctcattaggacagcaagggccgtccacgtgcacggggagattggccccccgtcagggccaatcaggggttcccgggacagcaactgactgtgggctcattacttttaacaaaacccagcttggaggcaaaacgaggctggctaggaagaggtgcagacattttctgaggagcactttagccaagatcatggtcctgtccccaggggccccgggtggggcaggcatgcatggtggcgctgtgtgtctcgggcaacagagaccattggcaggctcgtgcgcactctgcgctgtttccgaccaccatggcccccagaaacgcacagccacagaggccgcttgcctgcaagggtggctctcggaggatgcccacagatgcctgggcaaagacacaccagggaaggacagagacaggagaggccacggcggtgtgcggtgtgctcagagacccccttccatgcatgcccctcagaggggctcctcctcttacgttaacttcaaggataattctgaccgtctttccattcagctactacacaacagcttttatacatttatgtgagtaaagatgcctcaggcacgtcagactggaaataatacagcataaatcactttttacagcaaataaaacagttgaatcaaaggtgactttgctaactgtttgaaccttttctgcgttcggggtagcacaggttttgtccctttgggattaaatttgcaaatgcatatcaacttcctaattttatgaaacagactttggttggagtattggaacacagtatccagggttatgagttcaaagaggtaattgttggagaaataatttaatacatcacaaatcctctatttctatctcttcaaatgggatgccaaaagcgattaaagactaaaaacataccacaaacaaattcacattagaaaattgctgtaatcattctctgctggattaaccagggtttaggagcctctggtggctggttccatcaggaagtcttttggagagcgatggtgaaaccagagtggcttgggggttggagacggtttgtgcatttcacccatcctcttaggagaacggtgtttgtcctttacgaagaggtgcctcttcttctcctgttcccatcctgcaagggaaacagacacgcgcatttggtaaagtaagcgtctgtaaagcaagcggctgggcattgacttaaccataaggtaaaacaaagttccccaatgagtctagtgacagctgcgcacatgaaaacaaatcccattgttgggatgaaattatcagctaaaaggagctgctggaagccagcgtgcctggtcaaccagggtctgcccatgaactgctgtgggccggatggacccagtggcaccagacaggccctagggtggaggtgaagctggggcagttttgccctgacataggaggccgagcgcctgttactgaaaaccggggatgcagttgtaggtgagtgaatttcttaactgggggaagcaaagctctttgtaacatataccaggcaccagcggaaccaaaagtgctcgggccacagtgcctcacccaggggtgggaaagtccttggcagcttggtttcaggcaggaaagtgcgtgttaagggctgccttgtctgaggtacgctgaccacagggcatccaaacgcgtggagatgcaggagaagtgtctgtctctttaagaaatgaaaggccaggcacggtggctcacgcctataatcccagcactttgggaggccgaggtgggtggatcatgaggtcaggggttcgagaccagcctgaccaacatggtgaaaccccgtctctactaaaaatacaaaaaaattagctgggcgtggtggcgggcgcctgtaatctcagctactcaggatgctgaggcaggagaattgcttgaacctgggaggtggaggttgcagtgagccgagatcgcgccactgcactccagcctgggcgatagagcaagactctgtctcaaaaaaaaaaaaaaaagaaaagaaaaaagaaaaaaggagaggccttgtgaaccccacatttgttttctaacctgctgggccctctatttttacccagcaagctggagagtccctggggagcaaggaagcaggcatggccatcagtgcatgaagacaagagtgggacctaggtcaggcaacctgcatctcctgaccgcacgagggacccttacagagccactgggctcggagaagcctgccccaagctcccacaaactaagcttcacaaaactcgtttccaaagagaggccaagccatcaagagaatgggtcttggccagacgtggtggttcacgcctgtaatcccagcactttgggaggctgaggcaagtggatcactcaggagttcaagaccagcctgggcaacataggaaaacaccgtctctacgaaaaacaaattagctgagcgtggtggcgctcgtctataatctcagttactcaggaggctgaggcagaagaacagcttgaacccaggaggcagaagttgcagcgagcagatatcgcaccactgcacttcagcctgggcaacggagtgagactccgtctcaaaaaaaaaaaaaaaaagaacaggtcttgatctgtgagtcgctcaagcagcagccagcagggcccacacctttactctgtggccttgtaatccgctttctcccgtttcctaggcttgggtgtggttggcgcgtgtgaggctggaggggcatgtggacccagtgactcagtgggcacagcctctgcctttcctgctgccggcccaggccccagccacagccccagccccagcccgcactccggagaaaggctcgatgaatcaggattggaaaagaaacaaggatgggacatttcctatttgcccagctctagaatggactccttaagtccataggcatttcctggttattattaaacaaagagaaagaagcaaggagtactttgcgtgcttggtgttttcacggccgagagctgcaaaacccgaggctgccaaaccacgcgtggccactgagcactgaaacgcattggaacatggctggtatgaactgagctgggctttaaacacatgctggaacttgaagacttagtgccaggaaagtaaaatatcgaataactttaaatatggatgacacactgaaatgatattttggatgtattgggataagtattaagttatcaataaaaataatttcatctgcttctatttccttttttaatatggccacttgaaaatgtaaaattctacacatgaccacgttctctccctacagcaacactggtcacggggtggtgtgaacacctcggttctggggacgctgcctcccacctcccacagcctgcacatctctacctagaaggaatctaaaggtgagcatcttagccagacgtggtggctcagcctataatcccagcacttgggaggccgaggcaggcagatcacttgaggttaggagttcaagaccagcctggccaacatgatgaagccccatctctacaaaaaaatacaaaaattagccaggcgtggtggcgcacatctgtagtcccacctactagggaggctgaggcagaagaatcgcttaaatccggaaggcagaggctgcagtgagccaagccaagatggtgccactgcactccagcctccgtgatggagcgagactctgtcttaaaaaacaaaacaaaacaaaacaacacagtgagcgtcttgaaaagctcagctggaagcaaagctctttcgtgtttggttcctccctgagtgttgggggaagggtggctcctggtgggtggtgacggtgaagttctttcccggtgatccccagccattctcaacacacctgcaggagcacagccgtcagagaaaagacgagcagccccccacgtttctcgggagccacgggcttgcacaggcacccacgtgggttctgctttgctgtttgccagatgtgggcacacaggccgtggagggctgtcttggaatgagaagatccttgggcaaatctgagaaaggccagatgacactgtgattgcccaggtggcttcgcgagcagccactgcagagaaggcgagctaattctccgaaacactccactccactcaggccaagtgagaagcatgcagacgtttgtagaacagtagacacacagctttgtcatgtacaaaaaagtttaaatgtaacttgaatttttatttaaattaagtaatcggaagaatttttgattagtgaagtggttttttcaaaaacttattctccacccaaagagagaaagagagatttttttcctctgcccttttccttatgatttcacacatgtgctataataagtggttgcttttagatgagttttagcatctcagagactcttcagactctggtttcgagtggacacaagtatctgaaaattgaaattattgtgaattcagctacaaatgaacactatttcacttgatattaaaatttaaccatattatttttataaaataaatggcaataaaatgctttattctgaatataaatgatgtaccaatgtctctgattttaaccagaataaacacccctgtttcaaattctgataagcaggtaatttatttaagatcacgttgaaatgaccctagaagtgaagggcatttgagtttccagctttcccactttatctaaaaggggaaaaacggtgtctggcactcagcttttcgaatgtgcaaaactgataaactagtctgttaggggaaaaaaaaaagacaatgaagaaataaaagtggaaattagcagaaaccagtattaggcatatgtctttatgaataagacttaaccatacacttgattttgcaagtacagaaggccctgtggaatgtattaatcagagttaaacgctgtagacaggcgcgttgcagggcggcggccctctccccttggcattaccgacagccgaggaaattgggttaataaagccggatactgcggcggggccgcggggcgcaaaccggcgcggacagatgggtccccgggggcaccctgcccggctccctggatcccggatggtggcagagctgggagctgcgcaggacgggcactgcgcagcgcatctccgttcacacccggcggggcacggggcccgcagcagcttactcacccgtagcccggcctcctccctcggaagggagaggggatcggtggggagggggtttgctggacaccagggctagacggggccctcccctgaccgtcagggttaagtagggcgcgggctgtgaggaccctcctccacgcagccccccgaggcagagggcccgcaaagcggtctccatccaactccaccccgcggacgtcccaggcagcggatggcggcgggggggggaggccaggggacatttaggggacaaattcctcagacttcgaggcagccggcgacggcgtccaattcccaaataaatagaacaaactcctacttggaaaaggccttccccggggtcttcctgcgcccgcggtccagctcctctgcagacggccatcgtgggctctccgcagggctgcggagtctcggagtcaccgaggtgggaggtgccggccacgcgcgtcctcaggaacagagcactgccctgcagtttagcacgaagggccggctggagcgggagcgcgaggcccactgcaagaggatcaggagccagtaagtccggcttttcttcgtctccacctttcgtgcgcccggggccaggaccgcctgtccggaatctgaccagtgcccgtcctcgccgtggccctgggaccccgcggtggtcttcttttggggacgaacggcagtgcccgaaggatgctctacccacccccgttcctagacttgctgggtcccgacaatacccagtgggtgccgcgagttcccgggcgcagagtccagcgtccggctctcgagctcaatcccgcgccccgacggccttggcgcttcccgctgcgctaaactgtccaccgcgcacaggctggaagcgaagtcgggccccctcctcctggtctgcagggtccctccaggcctttcctgtccgggcagagagacagtcacaggggcgatcggaggacgcgtgcgggagggccgggggcccgcgcggtcacggcttctcgtgacagtgtttgcaaagcgcggagggcgtcccggagaaggcggcgcacttgtcagggcagggccccagggcggcgcctgcggagaaggggcacacagtggcctggccgaagggcgtcaagggcgcggcgtttacgggcgcggccaggccctggccctggttgaggaaggccaccaggcgccgcatctcgtccagggcctgcgcctgcatgaggatatagttcttggcgagcagcagcgtggcgatcttggagagcttgcgcaccgacgggctgtgcgcgtaggggatgacggctcgcagcccgtccagcgcgtcgtttaggtcgtgcatgcgccgccgctcgcgcgcgttgatgctgagccgcagagaccgctgctctcgcggccgccgccgcccgtccgccgcgctccctggcccgcgccgccgccgccgctgctcgaaggcgtcgtcctcgtccccgctctgttcgccgctgctctccgccgcctgagctggggcgcgaggtgcaggcgccgcggggaggtcgccgcccgggcccggagtgccgtagccgcgggccgcttcgggttctcgcgccgccccgtaggcgagacccgcagccgccgccgcgtagccgtggcttagtgccaggtacgcgtcccccgacagcgacttgagctcggccatggccgcgccgcctgggctcgggggctcgccgggtgggcggatgctcatgtgggtgagcagcccccgaggccggcccgagcccgccgctgccgctgccgctgcgatgaggctcccggctctgcgcgtcggtctggcttgcctgcgggtcccagagcctcggcgcccgctgcctcctccgcctcttccttctctcccacctcctctccctcccagccgcgacgcgcagggggcgggctctacctccccctcgcccccgcttcggttttaagccgcggaggcgcccggtgggacctcgctgctgtccaatcaggggggaccgggtgagctcctcttcctggagccgggctccaccagcgccgcaggctcacaggccgggggtgggggctctggaccgaggggcggcgcggggcggcgcggggcggcgcgcgcggtcctggagcgctagtacttgcttctcgactccccggccgccgcctccggccgccccggggattccgccaccaaacgcacgcgtcccaggtgggcacccgcctcggtccgtctttgagtctgaccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcccgcacactccctgctcggggcgccctgtggccaggcttgaggggcagagtgagagggagtttctagaacctgttgaaaaacgccacgagcgttgcaggccggggagggcgggaaggtggagggcagcgcggcctggggctccccgggggtgggaggggagctctgtgagctgcaggaccgcctcttccctgccagccgcttcctgggcatctatcagcgaaacgcgtgaggcttggtgggctttcccggagcctccgaacccctggggtccagccacactggatgggaatgtggccagcctcggactcgccttttcagtcctcttccaaccccgcatgaaggccagaaccccagcccttctcccaggtgggaacctgcctggaggcccggccgagtgctgaggctagagtgtgctgagggatagtggcttctccggtcctggcttgggtgggagactgggccaccctggcctatggcacgaggtggagcggcccgtcgggcccttctgtgtgacctgggaagggccgcataccctccctgttctccaggctccgccccaggaggagccacagcgatggggcagtgtgcgcagccccgggaggggagtgggagctgcacgtgtgtggggcggatgtgctgtctggaaggttctgggaacgcagcagtgaccggcctgtccggtggttccctgccaggtgcggggtgtgaggagacagatgcatggataagtctccgtgggaaactcaggcctttgtcctggcggaggggaatgggtctgaggcagcctctgccgggctggcggcctgtctggctgcgcgtcctgcagcaccggcctcacccccagcacacgcccgccaggagcgcaggggccccgaggatggaagcgtctgtctgaggcgctgtcctgggaccccaccccgccttcggggctgatgcacagaccgggaattgaggatacctggtgtggaggaggccgctgtgtttgggcctgggtctgaagggtgagtgggtgtcattgtggccacgggccggggtcgggggagcattcaggtggccggaggaggcctggcacagggaagggcagtgaggggcccgggtggggccaggagatagaggggcgggaccaggcctgtgggacagtttgaatcacgcggggagtttggtctttatgggaagaaaggcgccgtggccattcggagagccactctggcactgctgccggtgcggtccggggctgcggggcctcctcctgggcctgaactgcagggctggtgggggccatgggggaaggtggctccacaggtccccggagctgggggagcaggaggatggggttgaccaggagggaaagctatggagctggagaatgcaggaggcccccgaggggaggtgcagccagcgctggtggggaggcctctgaggggtacgcggtaattgacatcacgggtgtgggtgagagtggctttcaaagcatcggctggagcagggtccccattaaagccagagacgctgacgccatggggctggggttggggctgggccggggctttgggaggtccgaactccccagcagggagccagggctctgggccagttcccaggcccagttaatcttcagtagaatcgatcgaccttggctcagagggttggaggcagggatgggcagggggtgaggggtgaggcgcacgaaacagcacccgggtgaggcccctgctgcggcccctgcgggaccagccacgaattccgggcttcagccccgccagcttcagaggcggcgttttcggtgcgacgctgccacctgctggctgtctgggagttgcacccagaggctcagaacccgtgtttctcagagggcccgggaggggcgaaactgcgggttcccaggccctcccggattctgcgcaggtggacgctgggggctgtttcacaggcgcccacatgataggggagctggaggaacctgccgtctccgccatcgagcgcccctccgagctggggttggacgctgccagtttgcacagcagcaggtgagcctggggggttgagggctgagcgggggtcccagccgatgaagcagccccgcaccttggccagcttctcgaacctcctctgggcagaggctgtggaggctgcgaagcggcggaggcgttgaccaggccagctgctcagcctttctggcctcagtttccacagctgtaaagtggggtctgtccacaacacgtgtggtctagcgacggccctgcggagtgggtctgtaactgcggactcacttgtcccgggctgttctgaaccggtggttcccccgccctcccaggagacagcacctgtggccggcagccgcccctgcagcggcccctggctcccaccgcgccctggccctgggggtgcccaaagaccggggtgtgctgtggcccgagtgagcaccctgtgggcgtcactgctgtccatgctgctgggattggggaagggaggtctggtggggcacagtgggcgcaccaggaggtcaggctgggtggggggagcgggagggagcccccgctgggtggtcttgggccagccagcttcttgcctgcagggcaatggtgctagtaactggaacaacccaccctgcctctcccagagacggcgcctcctcagtgctccccttccacaggacgtagggtcttctagagatcaaaacagggaggaggaaagaaatcctaccgcaggcccctgccccgaccctgggacccacactgtttggcttctagggacaacgcccaggccctgggatttgaagactccaccttttctttcgtgtgtatatgtgctctgtcaaaatgtgtatcacatgaagttgatcgttgtgaccattttcaggtgcacagcccaggggcattgtacacaaccgcggtgttgtgcagccgacgcccccatccaactccagaatgtttgtatcttcccaaactgaaactctgtccccagtaaccccggctcccctcctcccccacccgctggaaaccacgactccgccgcccacctctgcatttgactgctccaagtacctcaggaaatgacctcatgcggtctccgcacgttcgcgtccatcttgtttatttccagcgtttggcccgtgggagcgatgagcgcacctgttcagcccctgctttcagttctttcagggagttctcacgtggtcttcagaggttcccacacgctgcttcccacagcagctgcaccattgtacattccaacagcaacggacaagggctccaatctcttcgtattcttgcaaacatttactattttatgtggtttttttttcttttctttttttttttttttttttgagacggagtctcgctctgtcgcccaggctggagtgcagtggtgcgatctcggctcactgcaagctccacctcccgggttcccgccattctcctgcctcagccgcccgagtagctgggactacaggcgcccgctaccacgcccggctaattttttgtatttttattagagacggggtttcaccgtattagccaggatggtctcgatctcctgacctcgtgatccacccgcctcggcctcccaaagtgctgggattacaggcgtgcgctactgcccggtttgaaaaggcaattgaggtttctaaactcctactaaaggaaataattcctagagttgggctgcctaagagcttacagagcgataatggctcacctttcacagcgacagttacccgaaacacatcttcagccctaggaattcagtgccgccttgactcggcacggaggccacagtctttggggaaagtagaaagagctaatcaaactctaaaaaggactcttgctaaactatgccaagagacatcagaaacctggaggtctttattacctgtagccttattacgggttcgaatggcccctaagggaaatctgcatctcagcacttttgaaataatgtatagaaggcctttcttaactacagacctcctaatagacatagatactttcaagctacagaattatgtgatcaacttaggacaagtgcaaaacgcactccttgactatggaaatcagagactcccttcccccactgaggaagacaatctggttccaacccagctgggagactgggtcctattgcaaacttggaaggaaggatcctcagcagatcaactttccccccaagtggaggggactctatcaagttctccttagtaccccaactacagttaaacttctgggaataaacagctgggtccacttatctcaaattaaacctgtctcttataaagccccacaggccaacggaacacaagagactgatcccgtttattcccgtgagccagtcagtgacctctgattcctgttcctaagaaatgagagggatggggggcataaatacctggattggcattctacttttaggcacaagttggaatcatgcagagagtgatttatttactgagtaggcacagactttagcctgtctacataatcacataaacggttgggtatgtggagaattgccactttcctccacctctgggttgccctggcatagtcaactggccagcctaagtctgtggggattttacgttccagaccattacccaggctatgagagctttagagctcacgtctctgccattgatgagctgtcagtcagtcctctattggcttggttccaacagctgcccagttcttggaaagcctttctgtttagctagtttacttggaatgattttatttattttgctttgctattgtagaatatattgcggttgtactctttgtgtaggaatgcatgacaagctcactcaacactttcttcagttggacatttttttgttttttttttgtttttttttgagacggagtctttctctgtagcccaggctggagtgcagtggcatgatcttggctcactgcaacctccaccttctgggttcaagtgattctcctgcctcagcctcttgagtagctgggattacaggcgcacaccaccatgcctagctaattttgtatttttagtagagacggggtttctccatgttggtcaggctggtcttgaactcctgacctcagatgatccacccgcctcagccttccaaagtgctgggattacaggtgtgaaccaccatgcccatcctgtttttccttcttaaatgagacaagagggatagagaatggggctgtgtgtttcccttcccaacataaaagactggagggagctggagttgatacttcccttcctccaggttggttagactctgattaaactctggtacgttaaaaatagtttctcttgagggcagaggaagaacagaatgctctggcatatttcgaaagtgctacttctcccctccccttgtccaaagcacaaggggatttttctctggtatttacctgggggatctggtagagtttgtgcaggtaaaactcacagaagtgtggcctccaccctaagactgggccctggagtttttaactgtcaagcttggccacacagcctccagcaatctgccagtgacagtttaggttttcccaacctggcagtggttcccagggaggtgtctgctctgcagaattgggattctctgcatctgtctgtcgtctctacaacttttttgggcagtggtttgccctgtgacctcatcatctgttgaatataagaaatattattgactttcagtttgctcacgttttgttcttgtgaaaagattgattgtttccaagcttctcacacagtggactagaaattgattcatttcatttatcctttttgggtttgtggggttcttgaatttgtgacttgatgattttgattacttttagaaatttcctggctattaactctggagtattgcttcaacctcatgttctctcatctcctctctgggatccagttacaaatatattggtccttcttcctgaatcctttgtgtatcttaacctgtcacctgtattttccatttgtattatccatacttcattctgaatattttctactgacctattttccacttcactaattctctcttcagctgaatttgctattaaagccactaagtttataatttaagtgattttatttttcagtgctagaattttcatttggtttttctaggtttttttttttttttttgctgaaattctaaattccacctctatttctgcaaatgctgtaagcacagttttgttccagtctctgtctcgcgactccagtgtctggactggtagatcttctgcctatggtctctgctgctttcattcttgctgatttgttttttcaattgtctagaatttttattgtggactgaacattgtatttgtaaaattattttgtagaaatcatttgaggtctattttattttcctccagagagggtttatgtttgcatctgcgagacatgggggcactaggggtcctggatcatcttactctagtttcagggattgaaatcatttcaagatgattacagtttaggttttcctaccctggcagtggtgcaaaaggccctgagttgctgcaagagccggtctccttctatccacccctatgtctagggtgcggttatttgttgtcccaactcaaaatggtgggggtcggggggatgttcgccaactccccactctcaggtgggctgaatctctcgctgtctggctcctcagtgggctgtgagctatctgaagcagcaaatgctttgggggaaaagtgagcgtcccgaaggcttttttcactctggatctttgtctttctgggattttgtttgtttgcattccaagcaaatatttttaacattttgctcagcttttgtagtcaccatcagaaaagtgatgggtccagattaactagtccctaataaccagaaactggaagtctgatggttgttttcagtcttgaacaacattgattctgcggtgaccagtttagagttcatgcaatagaccttcctcccccttgtaaaatcatcactatttcagctaatacttagagtgacctcctggtgactcatcctcagccccctttgccggttcttcttttccccgacattttcattctggagggcttgggattcagtcctttggcctttttcctagctgtgtctgccccctcggggatctcatccaatacccttcccacagcctacccagaccccagtgctgaactccagactcacggattcagcggagcgcagaatgtcagatgtgtgagggccgcctccgatgcagcgcgttccagatggagctgcggcctcccccagacccgcccacccccacccccagattctgttgagggcaaatcatgcttcctcgcagctcacaccctgttggttctccctcccacgttcatctggaatgcggccgctccccacctcttcccgcctgccctcagtcagcacagcagccttctaatggcttctgccctcccatcatccccagaccctccctttcacacagcagctgtgaggtcctcctcaggcagggtcaggtcacgcctctccctctcagagtcctgcctcagcccctcccctgtcatcaacaaagactagactgtgaatggccccatctgcctcctgcctcccgagctcacagcctctgaggtcccggatgggaaatcccaccaggcagtctgtggacgccgcactgcaggcgagtggggtctatcttttcaaagctgatgcccacgcccagagagggtgtcttccatgagagacgtggcctggcagctgctgctgtgggccctgggcccggggacacacccggccctcattgaagacaggaggcatcccgctgggggagtcagatgagatgtccagccccacgtcacctccctgtgctcggccgtgctccgtgaatggcctggtgggtttctgtgtgtggagagctgggtgggcttctagggtcttgactacggggctggatgtagagtactctagagaggctggggatgagatgaggcagctgcaggtggcccctcctcaccgcctgaggacgcgggaccacgccaggcttttctgggcagggtgcccctggctgtgtggcaacagatatgcacagaaatgccacatgggctcctgaggcagcctcatgtctccactggtgggtggtgtgggagaggggacctgagattttgcctggctccttgctatttgggggacgggtgtgcctctggggtcccagctgtgaaccaggttgtttcacctggggtggggtcgggcttggctctgtccccgggtcctgggctttcctgggctcccactcactgccctctgggcagctgggcctccccacatccctggcgcgctggggcagccccatcttccttcctgctgctcaagcgagagcctcgccaccactctgagtgccttcgctcacgctcatccagtgcatttgaaatccccgtgctccaccttcccgacacccagagtcagccccatcacaggtctcatctgcacagggctccctgcctttccctgtctccacctcccccacccctgcccagtcagccgcatcacaggtcccatctgcacagggctccctgcctctccctgcctctccctgcctctccctgcctctccctgcctctccctgcctctccctgcctccacctccccccgccccgcccaggcctgcagctcctctcacccggtgctccacccctgcatctgggctgctggggcccccgtggccatgacagatgccgcagaggcgtcacatcctttctgggtgtgatggcctcggcttctgctcgctcactgcccggcatctccagtccagcttctcctgcagcatggagagaggccacgtggagggtgtgcccagcccatggcccacccaaggtcccctgtgtattggtgaccctgcttggaccttgcaacccagcccagccccacgggatgcagccacgaggtcaacccagccacacctcatgaagcggacacggccaccccgacccttctctagtcctgcacccagagttgtgactgtaaagtgggggttgttttaagccaccaagctctggggtagtttgctccaggcagcaggtgactgagacactgccctgtgggactccccatttctgcactcgctcccctgtatgggggctcctggatcatgccagggtcacgtctgataaacccaatgttagttgaaagcctccagatgaaaggcactcagtgcactccgcctcctgaatatcattgttcggcctcccggccttcaccatgtgcagacgctgacgtcagcacattcgacaaagtccccaattcccttgctctgtttctaaggccccgccacccccacgctgtggctgcgcttccttgtcctcatccttgtccacctgtgttctttccaggtgccctgagtggactggaggggcacagggcagcctggcacctgctgagcccttgctggggccatgctgtcctgagcccctgctgagcaccttatggggacatgagtgggggctcagtctgggaaggaggaggggaggcctggggagatggtctgactagctctgcccagcccctcggtgctgtctggggacaggctggggtccagggcctccccagatgatgggaccagtgtctccagggctctgcaggctggtcggggcggctgacctgggcatttcttcttctggctgccgggaggcagcaaggccccaggtttgcatctcagtggccaagtctgggcgaggcttttcggggagcaggggtgcagcggccaagtgtgtctttggccactctggggccacatcaacgggtcctggggtccctgaagcacccgggaggcagccaggagggcgccagtgctgggctgtgcagggtgggcctgaagaagggggtggtgcctggcggtgatggagtgggcccgtcccatcccccaggccggcagccctgcctcaggagagccctcagtgggctgcagaggggcctcccacggtgagagaggacggggagggactggagtgtggttcatgtggtggcctgctggtgcagggctgggctccatgttggcagggcttgcgggggcggtgctgggcttcacagtggcaggacttgcagagggggcctgggctccatggtggcagggctggtgcagggctgggctccacagtggcagggctggggggtctgtgcccacaaggccacatcaggcacaggggaccagcccccaggacagaggtcaaggcctggattttgtggcccaacctggacccctaactctctccttgccccacagtgagtaaaccgaggtgcagtcatggcgcctgcctcctgccgtgtgtttaggtgaatgaggtcaggccgggtactcacctgtgcatccccgctgctgggaccacagcaggtgcacccacggaccccagccccactccgaccgcctgtgtcctcaccctctgcgggctgaccctttccccctctggccagtggaggtgggaaggctctgagggcccctgagcccaggttccctctctgtggcccttagccctggccacagcactcggaacttctaaccgagccctgccgccatagcacacggtccgtggtgcagtcacctgacactgcaccagggcgtgatgtccacaggcaggccatgccccggctccacacagcggccccggactggagtgccccccgcagagacagcgggcaggaggccgtccttcggggccaccactgtgaccatgagatgcccagccctagagggtcaagggtccgtctgagctgcccgagaggtcctctgggctgagcagggagtgcacaggtggtggccgacgcctgctgctgagagcgcagctctgcggtgttgatgtggaagcagctgagccctggggcatgggctccaccagggccctcacggcctgcgagactcagggctggggactgggtgctgccatgtggtggccctgctgtcagctgcagtccccagctctgacctgcagagtctcactgtctcctttcggcgtttgcggagttggtgcgtgtgccctggccgtgctcggcaagggttcctcccggataaggtggaacccgatttggggtgcgctggtatcactgtcgcaatgatgcagtgtcgtcccgtctgggaacaaggcatcttgccatttatttaggtcttgaatttttctcttcaatgccttgtggtttcagaatgcggcttttccacagagtttgtgagattttcctatttgtcccacctgttcttgctgcctcttctcttgtatcgtttgggactaacggacctttcacatgactctgtgcttactgtcactacccgcttgtttgatactcccttccttccttccttcctttctttcttttactttctttgtctctttgtttctttttcttttcacagtcttgctctgtcactcaggctggagtgcagtggtgcaatctcggctcactgcaacctctgccttctgggttaaagcaattctcctgcctcagcctcccgagtagctgggattacaggcatgagccaccatgcccggctaatttttgtatttttagtagagacggcgttttgccatgttggccaggctggtctcaaactcccgacctcaggtgatctgcccgcctcggcctcccaaagtgctgggtttacaggtgtgagccaccgcacctggccctttggcttacgtcttagtggccaccctcttcagtaggtaggcttctggtacgtgcttccagatcaccaaggcgtagctctaaagagcaccatgagttcataacagcataagatccgctcgccgcccacccgctcgccacccacccgctcgccactcacccgcccgcccacccgcctgcttgccctttgtactatcgttgtcagacgttttactaaatccacatatgttataaaccccacagtgtattatgaatacgtttgctttaacaggcgattatctttcaaaatttgaaaagtaataaaaacagcatttttttttttaaagagacagctctcaccgtgttgcccagcctaaactgaactcctgggctcaagtgatcctcccacctcggcctcccaaagtgctgggattacaggcgtgagcaaacacgcccagccagaaaaacagcatttttatcatccacatattttccctatctagccactttctttgtctgtgtagactcatctggtgtcattttccttctgcctgaataactttgatgtttcttgtaccgcacgtctgctggtgataaattctctcggccttttgttgaaaaaaatctttatttgcctacatttgtgaggatatttttcccgatgtagagttttagcttgacaggtattctcttctttcagtcctttaaatgtgctaacgcgtcgtctgtctcccagctcacgacgtttcacacgatgtcggctgtaattcctgtctctctatgtaacatgcctgttttctttgactgcttttaagatttttctgtgtcactggttttctacagttttattacaatggccgtgccgtggtttctttctgtttattctgcttggagttcatggagcttgtctagatttttgtccaattgaaaaactttattaaacattttttcttgatccctccaccacattagctgtgtgcagcatattgtggatttttttttttttttttgagatggagttttgctctgtctcccaagctgggatgcagtggtgcgatctcagctcactgcagccttcacctcccgggttcagtgattctcctgcctcagcctcttgagtagctggggctacaggcactgccactaggcctggctaatttttttgtagttttggtagagatggggttttgccatgttggccagcctgatctcgaactcctgacctcaattgatctgcccgccttggcctccccagatgctgggattacgggcatgaggcagcacgcccagccattggtcttccagtcttttttccctcactgggcttcattttgaatatttgctattgctatgtcttcacattccttaaaaaatgtcattggatgttattcctgtccatcgtgtttcatttccgatgtatttttcgcctctgaaattgcgtttaggttcctaaagatctgtcattgcactcttcagcacgcttatgttttcctctgtgtccttgaaaatgtgggccctagttgtgactgcggctttaatgtccttgtctgctgatgccatcgccgccgtcctttctgggtctgtttctgttgattcttttttctcctgatcctgggtcatacttccccctttgttgcatccttggtaatttttggctgcacgcttccttgtgagtgctacattgttaggtgccaggttttgttgtaaccctttagagagtgttgggcttagtcctggtatgtggtgaagctgctgggaacccgatgaccctttccaggctggccttgggtgctggcaggccggatgcaggttatctcagcgccgtagcagttccctttggagggctctcccggtgacgctccctccctgtggggatgcagcttattcctggcctgtgtgagttccaggtgctgtccctgttccattccccagggctttctcccatcttgcagtctcatcccaggcacgtgcaagttggtacctttctaaggctttcggggagccctctgtggacctcggtgctccctctctgtgcagccctctgtctctggtcttctgccccgtggctatgccttctgtctcctcagctcagagagatgtctgggttctgtttgcagccccttctgagtcgcagcatgggagctgtcttcaggtggtgagccgggcaagtgtgggtgcccctcacttgctctctcaggggtcatggtcctgcactccagaccccgagtctgaaggctgctgtccacgtgtgttgtcggtttctagttgtttataggggaggggccctttcctagacgggcaccggagtctggctgcttctgtccctgttctctccactggccggggaccatgagaggctctggtggggccggtgatgtttattgagtggtgacgtttattgagcagtggaggggaccggctctgtaaagcctcagctctgtgcaagcactcagcggcctccttccctcctgtcctacagacggggacctgcgcctggagagcactctgcccgctgaggcagagcccgagtatgtgctgccgtctgtctgtctgcagagcttgggagctggtgtgtgagggggggtgtccagagtcctgggcggtgggtgctgggttctcctactgtgggaagacctcagggcaccaagcgtggggctccctgatgtccacgtgggccctgcccatcccccccatcactgagtgcagagtctccctctgggttcccggatggttccagacgatgtgggtgcaggcggtaggtctctctgcagtgtggatgggtccagacgacgtgggtgcaggtggtgggtccttctgcagtgtggatgattccagatgatgtgggcgcaggcggggaggagtgaggggagcacggcgcagggccatgctttctgagccctgactggacacagcattgtatggggcggagacctggacgtcttgagctgggtctcgccgacttccccttccacacatcccaagctgcacaggaggctggcccgggtcccgagggcccctggaagctgccccagccgcgttgctctcagacaggggcgtcctggctgcagcgggggccctgtgccgcctgcggtgtctgagaaggcgtgaacgcctggagaagcccagggacagagactgcgctgggagcagagtgaatgtgtctgttattgattttctccacgtggctcccacgttattgcacacgtgattttgtacttggctgagattaaatattaatacattgaacattaaaagagttttcagccctttaaacaattgtttatggcacaattaaaaggcaaatgaatgatgttttttaggagcaagtttgttggcctgagtcttatttgtgagggctggagctgaggggaggccccttgagggggcgcagagagggaagccgtgtggcatggccacttgcagtgggcgggcatctgctatttattgaggcaagatgagggggcaggctgccctggtgcccctgctccagacccgcaaataccaggagcagcccctgacgagagaccctagccccctagcccatccaccgttttgatgtaaaccaggtttccatgagcctcccatgcggctgcagggggtgggggaggtgggtcagcagagagcgagccaggtgggcagatggggtgtgggccgctgccctgtgcagggtgctcccctctccctggtgaatggaccgtcacctctgcttcctggcgccagctcctcgtctgtctgacttctctcgtgctgtgacctgcagggtcaggaccgcacggcctttcctctgagctggggttcagtcacttgcaactgaaggatcctgactgagccaaactagttaaagtaggaaaagggcctctggagttttcagttacgtgaaccgagaacggcttcaggcacagtggagtccaggtgccactgctggcacaaagcctgggtctccttccatccctcagctctgctgtgtcctgggctgacttgactctgaggcagtggaaccctcagcgtggcaggagctgccggcagccccggaggaaaacgagcacctcttcctccagcatctgctctctcttggcctggaaattccgtcctgagtctccttcccaggtctcagtcctggcggtttgagtggctgatcagaatctcccgcgccgcccacaggagacccagctgggtccggctggtcagtgccaagccctggacctgcgtggtggcgcccccaaaggctgctcggaaccggcccgtgcaggtggacctctgtctgttggttcccctcttccctcttcacaccctttaggtgcttcctgcaagtctgaaaggaggtgcaccctggcccgggggaggtttgcggggtgaacacttaatccggactagtttcaggagggcttcctggagggggctgcatttgggtggtgtcctgatggagcagagattgtctttttggaggaccgggtcccatgtagaggctgtgagctgcccacacactcttcatgccatgcctctcctttctgtcccctgccgctccctgggccagagctggacagattcttcctgagcacctggtccaacccggctgaggctggtcagtggcgtggttaactcggggctgccccggggggctcctgccatctcaggattcccagcacggacccctcccctgcctgcctcctttgctcctcgttgcctgctctaaagggagggatttgggcttagcatgtccacccgatgccacttcttttaactgtcaatacggtcggcatctgccaacctttcccacggtgactggcccctccttgggccactgtaggcagagtgatggggtcaactcgacaattgctttcactgtcaacccaagttctgcctaattagggggaacggcagcgtggctgagaaaatgagggtgtgtgtgtttgagcacacgtgaggccttccaacctgaaacaacagctgtgcccgcggccccggagcctagggggctgtgtagccccaggcccctgacccggcccccaccctccctggccccggggtcctgtggtcgcccaccacggtggcaccaccttgcggggatagcacagaacacgggcttctcagacccagagttttgaaattaggcagatttgagtgatttttaagaacggggtgggagatcggaactatttcacattttccaaatacagtgaggctctagagtgacgtgaaaactggatggtgcagcacggcgatgtcagttatgtgaacagccgccaccctcgtgcgggcaaaagcggctgatgggaaggactggatctgtggctgccactccgctgctccgtggcggtggggggcggtggccgcccagtccactctgcagtgcgggagctgggctccgcgagctcctggcccccacgccgctggacactggccagcccgggtcgaggtggatctagggtatggcagacagagagctggagcctctgggcctcctgtgggaggcaaaccctcacttctctgtagctggaagttcagcaagcgagaagttttacgaggccgtcaataagattgcatctttgttctgatgccgcggtgcctgcgtgatgatttaaaaccgctgagcccgacgtgctcacgggccaggcctcattgtcaaggcacaaggctctgtcgcttaatcacacaccatgatggcgaagctctgatgggattaagcttcccttctgcatctccacctcccttattcctctcagagggggcctgtgaggccaggggcctgtgaggccaagcgcctcacaatcccgctgcctttggggacatcgtcatggctccaggtgtctgcaactctgctgtgaagggttccctgggggagccatcctcccctgaacgggcaccgggtgtcttgggaccatcccactccagctatggcactcaggtgaaccccgagtgttttgtgctgtgactgggaacccgggcattggcaggtgatgtggttccagctgcagcttcccgtggtccttgggaaggcggcttcagggacggtgtaagttgtcagcgtcacccctgggaagggctccgaagcagaaggatgggggtgtctgtctccaggacccagattgtcctatcgggaagagttgaacgagggtggggagggtctcctggggggacaccagagccgagcctgaaggtgagcagagccttcgccctgggtgagtttcgttctggctgagcagtttctctgtggcccaagggacctgcattggttttttgagttgggttaggggcagagagggggagtgatggggctgtgggggtggaggtgggactttgtttcacttagttttataccctccacgatgttctttcccatcaaggacaggaacacaccacccacaaaatgaccttggagagacttttgttattttttagataggaaaaaacaaaaaaacaaaaaaatccccaaacccaataaccatttgagctactttgatggtggaggcagcgaatcccggggaaagccaggctcctaagccccagacgcccctgcctgctgaatcaggtccccgcccagtgctcagatggtcacgggctctgggatcctgcgggatttggaggaagaggccgtgctgcgtccgggctggctctgcccacaccccggcgagagatgctgacttcacattcacctctgtgaagatcacaggatttaagctgtcagcgtgggacgggcatgtgctttaaggatgattgcgccagcaaagccgccttcctgagccatgcttatgccaggctcctcctgtctctgagcaaatgctggccgcccggcccgggagcttccggaagctgtttgctccccgtgtgcaggaggaaatgtgtgtctgcagccatgtgtgtgggccgctgtctcctgctgcacccggccttcctcacggcaagagctctgtgctctgtgggctctggaaggaacgttccgggccggtgtgtcttgagagtgttgggcagctgccgccctgggggaaggaccctcactaggctggcccggggcaggagcaggaaggatgcggctcagctgccgcctagctctgtgtgccaagtccctgcagggaccctggaagccgagaggggcggctgggtggccacgcagcggggtgggaggtgaggggcctgaggaagccgcggtgccgcgttccctgggcagcgtcgctcacacacagggaggctcattcacgctcactcagcacggccgtgtcaaggcactgcaagtacactgacacgcagcttgcggtgggagggacggtggggtcctcggaccacccaacacagggccgcagactgggctttgacaacagaaattcagtgtcactgtgctggagccggaagtgggagacctgggtgctggaggtttgctgcgatcctggtgttccttggctcgagaaaccatcacttggcctctgccttcatcttctcacctttccacgcctctcccgtgcgtgtctgtgtccacgtttcccctaagggcacagtcacattgaattagggcccaccctactctagcctgaccttgtcttaactaatgaccctgcagtgaccttcctcccaagtaaggccacatctcaggcaccgggatgacgccttccacactagaattcttaagggacccaattcaacccctaagagggatgcctgagctgaggtctgtcgtggacaggctggagctctatcccccgggcctctctcctgcctggtgcctcccatttaaggagcaggttgaaggagctgagacccccccttgggcattgagcactcctgtcttggatacaggcttccccaatgctgccgcctctctccctgacctcaacctgcttccctgcactgagcctcacctttgaacgtccttccttccccagcgcgtggagccccgcacagctggggcagctcagccgagtgcaggcggtggcaggtcccaggggctggtgtcttgggtggggcctggtgtccgaggcctgcagatcagccctgctagccctgcccagtgcccaggctgcccctttgcctggttgggggttggtggggcagggagcctggtgggcttcactctgggtctaccaggaaggtggcactaggttaatcattattgccccgaccccctccgtatgggggggcaggaccagctcagaaattttagagtaccacgcaaaataagaacgttgggcttcttgctcaaaaatgaagaattctgggacagcagtggcggagcatgcagccttctgagcgcagacgtcgggacaccagggacgctggccgggagcgagggaggggctttaccgaggaatgggtttcctcctccagccttgttctggagatcacgcctgtgcaatctttttaaatacagaacagaaaaaaatgccagccccctgcagcctggtcacgagaatgccaggatctcagggcacctgctggctgaccttcgctgagatagaatttacacactgcacatgctcccatctgaaagggatgccccgcggccttcagcacattcacaacatcgcgcaaccattgccactcattccagaacttccaccaccccgaaaggagcccatcagagtctccccactgcccctgtcagctccttgctgtccctgtggacttgctggttctggacacttcatggaatcagaattggtgtgacacagggccttgtggcgtggactacggccctctgagcggtcttgacctgttcacctaaaaccagacgctgaaattaaccaggcccacctctccaggccagggcgggtgaattcccggggacccagcccttgcctgcaccaggagagtaagcgacttattaatagggtaatttatgcgggtgcctgcgcaccgggacggaccagcatctatcatggctgttttgcgtttcttgatttcacgatgtctgttgtgtgctcaggcccctcctctccaaggtcccagctgtccttgccctgttccctgtgaagagtgaagaaccaacgcgggcggggagtggaccggtggggagagggccggtggggagaggaccggtggggaggggccggtggagagggggccggtggggagggggccggcggggagtggtttggtggggaggaggctggtgaagtagcgtcaggtgcgggcctggcgtcggcgagtcaagtcgagctgatccagggccttctttctgcagcttcatcaggttctcaattagcggagggcgctggcggtggaggagggcattagccgtgcctgctctcgggctctgcctgccagagtgccctcatgtggcatgagattaaggctcagcctctttcctgacagcaggttttccatttttcttctccttcctcctctcctggcaacaaagtcctttgctgggctggggggtctccactctgatccacttccctccttcctgcctccctcccacgccctggaaaccccggcccatgactctttccctgagggggccgcccgcagcctctcccccatgggggctttgctctgggcaccccctttcccccggggcgggtggggcagcggccgggactcaggaagatggtggcccagtggggctctctccttgggtgtgtgggagcggagtcccctcgctcttctgggatagaacgctccgttgagctccccaaactgctcccgtgccgagctctgggggagggagtctgttcagagacggtgcagtcctaccttttagaaggtacgcctgcctttttaagcagctcagctctcaacaatgcacaagtggcttgagtagaagagctgctcctgctgggaggcgcaggaggctgagcgaggcccaccctgcaggggcgaggccacggtttgtgttatttcccatgatgactccaaacgcacccgagtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgcctccgtgtgcaggtcccccgggcctccgcgtctgtgtgtgcaggtcccccgggcctccgcgcctccgtgtgcaggtcccccgggcctccgcgcctccgtgtgcaggtcccccgggcctccgcgtctccgtgtgcaggtcccccgggcctctgcgtctctgtgtgcaggctcaagtttgccaacgtccatgcacgtctcagcctctcagcctggactggacaactgggcttcgggaattcatttaaattctacccgctacacgccttccctggattcagggcggcgtccagtgcattcatcacgcgtgtgctgccgtgaaggtgcggggaccccccccaaaaggcttccttccctgtcctgcgtcctgcccacaaggcggtgctgctggcaccaggcctgacctggcgctgccagtgctccactgttttgagttattgaccaacaattcactctcgggtcccgaggggaactggcctgaggccactcaagcagaggctcaatgaggaaagataaatatttcatggtctgggtcggtgagagagggaaatcaatagcgcatcccatcctcagtacggcgcaggcctcccacccaaggcagcgagttgcatcctccgtgccgcgcgggccctcccacccgaggcagcgagttgcacttccgggcttgttctcttcctccctttaaggcaaggctgcaaactgccaggccgatggcccgtgctgggagcaggcaggtgtcctgactccgcctccagccggtgaatcagagccctgagattcaccaagggccccctgcccgggtcgtggaggcagagcctggggctgggagaggcccttcaggacccctctgtgggagccggacgcaggcctggggatgttggaggtgggagcgcttccaggccccttgtgtaggaccagaggctgctccgaccctgctcggggctctggagacagaagaacggcatgagtgtttcacaaatggtgcagacagttcacaggtcaagacaggggacaaaagtgaccacttttagttaaaaacaggtgactccgtcccaggacaagcacgatgctgtgttaggtcccgttagtccccttggaaagctgtcggctttccctggagaggacctcgttctgtccacgccactgccctgcgagcgagagggagtgcgagcggggcgtccacgcgctcccatgggggacctggggctgcttcccgcttcccgattttccttcagcgctgctcgtggcgtgccctttctcccgtggcgcagtcaccagcaggacgtgtgtcccgctcacgctttgggaaacacggccttgtagcaggagctgctctcggggttcagcatcgggggtggcagagcccagtgcctgctggggcattgccaggcatcgtggagctggacccagagccaggggtcccagctgctgctcctcaaggaccctgtggctcaggaaagccctcccattgctaacgtgtcacccgaagggcttggggacctccacgcaggatgggcttcaaaagtcagctcaggcggtgccctggcctcgggtgcgcggggagaccactggcctccctcatgccggctccctgctgactgtctcgtgagctcctggcagcccttctagaatgttctggcgtggctccctgctcacgtttctaaagcaactatcagcccatcctcaattaccgtgtctccaggaccacagacgacctggagcagcaagagtcagtgctggggccgggcgcggtggctcacgcctgtaatcccaacactttgggaggccgaggcaggcagatcacctgaggtcgggagttcgagaccagcctggccaatatggagaaaccctttctctactaaaaatacaaaattggccgggtgtggtggcgcatgcctgtaatcccagctactcgggaggctgaggcaggagaatcgcttgaacccgggaggtggaggttgcagtaagccgagatcgtgccactgcactccagcctgggcaacaagagtgaactccgtctcaaaaaaaaaaaataaataaagagtcagtgctgggacgagaggcaccggtaacatggccagtgttgcagccggaggcgggcagggctgacctgtccagggaccagcagagctcgggcaggaggtgaccctgagtcgggggagagggggcgtgggagcctggggctgggggaggagggaggatgtcactgtggatgaggctggttcccagcctcaggagccaggcccgggcccctccagctccacctgtgctcacctgggcaggtgatgccccatgctgagcctctgctctctggtccttagggtgggggtgcagttcatgccccatgggctgggtgaaagaataaacccccacccagtgggcacgtgcggcgggcacccagagtgcttgaagtttccttgtgaggctgctgctgactctggggagggacggtgtcgttggagtggggccacctggcttggcccgttgcccttggcagcaggaatacagctgccctgggggctcctctgccacacgggcactcaggggtgctggtcgttgggtccaggcagggtgggggcaagagccactgaggggccctttgtttgcatcttaggtgacgctgcagaggtgagtggccggggcatccagagcttccctgaatgactgggccacgacgatgaaggcgtcagggctgcagcctgctgggcgtgccccagccaagttttcaggacggcctctgcttctccttcggggaaggagcagccctactccctctgatggggctgcctgggagggttggatttgttgtttgtagggaaagactggggcggagagcagggtgctgtggcccctctcgtccctttctggttcctggggctgtccgcacagagcaggtggggacacgctggctggatttcatctggatcagaggagggtgagaggatggtctcctggtggggagtgcagagcctcagctctggagtgtggagaaggatccagcttgttgggtggtgtatggtcagaagtggggacctcggggcctcagatctggcctctgatcccaactctgttcccctcggagccacccttccctcatccatcaggagccagtagcagccccaggacagctgccgtgggataaataaaaggagccgccttcaggagctgcctgccgagtgtccacagaacgtagcgtcttcccagcactcagcgggtcctgatgggcctccttcccaccgccctcttccgagtgtggggagctcaacccctgacttggggtcccgggacattcagttttgtgtgtgatcagggaggcagcgcctgacccacagaaagcacctgctactggtggggtctcagatctgtgcacacctgtgtcccgggctcctcactgtccgggtggtcacactgtccctgcgctgctggacttgggggcttgggtgcagccagccttgtgctcctcagcctccctggtacaggaggactgtccatctgcctggcaggggcaaggccgtcttcagcggagagacctggaggccacgtggtctgctcagaagtacctgcatgcagtttgatgccctgctgcagcaatcttgaaattcttagtaattttatctttgaatgctcgctttgtaagtgcaatctaaggatggtggcgtgagcatgactgaaggaagctggagatggtcagggtgcgagtccactgcggagccagtaggtgccagtggttcgagaggccacgctttcccttgactcagagctggccccaagtgcagaaaggaggtggtgttgctctcagatgcccacacaaccaaggacacatcccccccgtctccctgggactcccatgtgagctggccacctgcactgcagatgacgatgtggaaggagagagaaagacaggagaccgcggcttttcctttcagtccttcgtacccaacagcaactgagagggcgtcccggcagggtatgaatggccagcaggacgctgaggctgcgtggcgtttccaccgtgctgcaggaacaagatgcacatcgtgcaggagccgcagagcacgcgtgcagaggtttcggtggctttgccccgcagctaacgtgtgcgtgtgtgccttgacttatatttgcattacttagaatgacattcaatagcaaatgaaagacagccggcaagtcaatagagagaatgcggaaggaaggagaaggctttgtttgtggctctgagggcacttttcctcctgcatttgcattttgcactgtgcagatttgcaccgtgcagccacccgggcctcctcgggtctggggctccatttccagcacccccacccagcgctgtgggcccctcccccacgcacctcccccactttggtggtgacagttggttgtggaggaacaatcgtcagtgatgggtgaactagctgtgtttcacgtggcctcctcatcactctgccaagcccctggggcaggcacattttggctgccatcgactctagaatgttctctggtgtctccagggggtgtgcagagctggtccctcccagcgaggagctctgctcacaggttcacaccccctgccctgttctccaagatgggaatgtctgatgagagccccagagaagaatcagccgctgggggtcggggaggtgttggactctcttgaaacaaaggaggcccaagcctggggtcacggggctgggggtgggggtggggtgggagggagtgggcagtgacctgagaacaggaagggaggtggaggtcttgggtcacgggtgatggatgatggaggaacaggcccaggaggccctgcttgctgggggcttctttcctcttgcgtagtcaccctgtggggggctctcaaactcacagagtttggccgtagggaagtgcaggggtggcctgggaggctgcaggctctgggacagcctggctcacacaggagatgggatggcgctgagaggagaccccggggcgcccagcgtctcaggctataaggagcagccactcattgtgacacccgatggtgaaatgctgcattattatttatggtgttgaataatcacagcacaatcattgcaggccacagggcagaaagtgctaatgtagtttaaaaacagtacatttgaatctggacactggcaagaaaataggcaaaataaatacttttgtccacccctccctaccctcttttggtgacttggggtggcctgggtcggtgctcagcccagggtcccgcggccagagccaaccatggcgcgcctggtctcctccagataaacgcgcgcccacgtctctgctgggctttggaattagctcaatactcattcagacgcagagtgcgtgtgccctgccaggacagacgtcattgctgtgcggtgcttgagtgccatcaataagccacagaagagaaatccggaaacaagggacgcgcagcgtgattccgtgccacggcgtcaggagcggcatgtagcatcttttggtttgagagtaaaattccgcaatcagaaatgaaatccgagcaaagaagcaaagcgcacagaggctggagacgctaaagcatccaggcaggactccgccaggtgggcaggcagaggcctgtgcacaggcagacggtgtgcccgtgagcaggacatgcttgtagggtcacaggtcacccacccgcaggacacgcatgcaaggtcacgggtcagccaccagcaggacacgcatgcagggtcacgggtcagccacccacaggacacgcatgcagggtcacgggtcagccacccgcaggacacgcatgcagggtcacgggtcagccacccgcaggacacgcatgcagggtcacgggtcagccacccgcaggacacgcatgcagggtcaggggtcagccacccgcaggacacgcatgcagggtcacgggtcagccaccagcaggacacgcatgcagggtcacgggtcagccaccagcaggacacgcatgcagggtcacgggtcagccacccgcaggacacgcatgcagggtcacgggtcagccaccagcaggacatgcacacccatgtgtgcacatgggtaggtgtgctcgacccacacatgttgtgccatcaccccatccttgtccttggagaaagggctattggccatcgtgacggggagcctctcagctgcgactgggccctgggagccatggagtcttctggccgcctctcctggccaccaaccaggaaccccaggccccaggcccacggttgcatctgctgtgccatcctgtggacaaacggacgatccaatccagatggcactgcaggggactgaacggggctctgaaacccggccggagctgccctcaggccaccctcctcaccttgagccattcccctgctccgtcacctgtgtcaggcctgggtgccgccaggaggcctccttccagctctctgcaagctggccccgtgttcacgggcatccagcgggatccaccatggaaagacagctttctcagaggcatctcagcacgtgggcccagccagaacctcgagggcttctgtccctggagggcagggcagagcgggaggacacagggacacagagaaggtatcagctggcgagggcagggcagagcaggaggacacggggacacagagaagatggcagctggctgagggcagggcagagcaggaggacacagggacacagagaaggtggcagctgactcggcgggagcggaaggtgctgctttcttcgaggtccccctctttgcggctcacccttctccctctatggcccccttaaccccaacccccctcggctgcctctctgagtaaaggacaggccagcgccgagcaggtatgtcccctgccagggtcccccgcacacctggatcttctaggctggggagtagtggaaggatctgcggggctctcgaagccgtctgggaggaacgtcaatgaccagaggaaggaacaagggtttcgggtgggattggccaattccctgggtcatctcagaaccacgagcttgtcttcctgggttacagggtcctgagcttggccgaaaagggacaaacgaagggccgggtgtgatgaccctgcataggtttgacagccctgtgtccttccaaatcaagtgagtgggtctgggtccccggccccctccagcctggggtccaagcctccctggtctcctcgggcagtcagcctctctgctccagtgccgtcagttgtcacctacgtgggtaaaacgccaggagaggctggatccccagctcaccggcctgtggcccgggcatcctgggcttgcagagggagggccgagggtggtaactaggaggagtggctctgagccggggagggaacacggccagagggggatgaaggccacacggagcaccgcgggagccccgccgtctgcgcagggttcagcctttcagcctcgatgtgggaagtctctccatctgttcaggttttctttgggtctttttaccagccatgtttcgcagtttgcagcgtacaagtctcacacttcctttgcgaaattattcctaagtagcttattctttctgatgctatttgaccaggacgctttctgcatttcatcttggggtgttcactgtcagtgcagaaatatcctacgccccatgatcttgttaaactccttcgatcatcttatcaggttttacttcattttattttatctttgtagattccttaggcgattccacctacggcgtgaggcgtacttctacatcttttttgctaatctcggtgatttgagttccatgttcttgcctcactgccctggctggaacccgctgtgcagtgtgggaggagcgggaggggagggtccccttgacttgctcccttccgtggggagacggtcaggctttccccaggaagcgtgctgtaggtttccatagattcgagacggtcaggctttccccaggaagcgtgctgtaggtttccatagattccattgctaggttgaggaggttcactctcatttctggtttgttgaaagtttttttttaattataaatgggtgtcagattttgtcaaatggattttctatatcagttgggatgatcatgtggcttttgtcctttattttattaatatgatttattacattaattgagttctggctgttaaaccaatctttcagtcctgggaaatatcccacttgatcatggtgtacagtattatctttttaaaataaattgttggatttggccaggcacggtggctcatgcctgtaatcccagccctttgggaggccaaggtgggaggatggcttgagcccgggaggtcgaggctgcagtgagccgagatcgtgccattgcctgggtgacagagtgagaccctgtttcaaaataaataaataaatagtcgaatttggtttgctaagttaaaaaaattaagtaagtgtcccgctcagcagcattaattacattcacgatgttgtgtcaccatcaccaccagctacatccccaactccaaacagaaaccctgtctccatgaataacaactacccattcctctccacccccagcctctcttaacctagaatgtactttctgtctgtgaattaggctcttctagatatctgatgcaagtagaatcatacaacatttgtccttttgtttctggcttatgtcactcagcacaatgcttccgaggtcgctcagcagggggcttccgaggtcgctcagcacggggcttccggggtcgctcagcacggggcttccggggtcgctcagcacggggcttccggggtcgctcagcacggcacttccgaggtcgctcagcacggggcttccgaggtcactcagcatagtgcttccgaggtcgctcagcacagcgcttccaaagttatttacctggtagcgagtgtcagacttccttcatttttctggctgaatcctattcccatgggtggatggaccgcattttgtcctccattcatctgctgggggcaactgtgctgtttccacctttcagccattgtgagtaacgctggtatgggagcctaagtgtctgtttgggtgtttgtcttcattcttccggacctacccttgggagtggaattgctggatcgtaaggcagttcggtgttccactatttgaggagctgccaaatcgtctcccacggtggctgctccattttacattcccgccatcaattccaacttctccacatcctctctgaggcttgttattttatttttatttatttatttttttgagacagggtctcactctgttgcccaggctggagtgcagtggtccaatctcagctcactgcaacctccacctcccgggttcaagcgattctcctgccttagcctctcgagtagctgggattacaagcgcatgccaccacacccaactaattttttgttttttggagagcagccgtcctatcgcatgtgaggtggtgtctctgtggttttgattcacatttccctagtgaccagtgagtgctgttgagcatcttttcatgtgcttattggccattttatatcttatttggagaaacatctattcgagtcctttgcctatttttaaatggaatttttttgttgttgaagtgtagcagttctttataaatcctgggtattaaaacccttatcagatatatgatttgcaaatattttctcccactctgtggttgacgtttcactttcttttttttttttttttttcgtttttgagaaggagtctcgctctgtcacccaagctggagtgcagtggcgggatctcggctcaccgcaagctccgcctcccgggttcgcgccattcttctgcctcagcctcccgagtagctgggaccacaggcgcctgccaccacgcccggctaattttttgtatttttagtagagacggggtttcactgtgttagccaggatggtctcgatctcctgacctcgtgatccgcccgcctcggcctcccaaagtgctgggatgacaggcatgagccactgcgcccggctgacgtttcactttcttgatagtgtcttttaatgcagaacaactttaattttgatgaatccaatttatctgttttctgttaaaaaaatttttttttttttgagacagagtctcaatctgtcccccaggctggagtgcagtggtgcgatcctggctcactacaacctttgcctcctaggttcaagcgattctcctgcctcagcctctagagtagctgggattacaggtacccactatcatgcctggctaatttttttatttttagcggagacagggttttgccatgttggccaggctggtcttgaactcctgacctcaggtgatcctcctgcctcagcctcccaaagtgctgggattacaggcgtgagccaccatgcctggccctgtcttttttcttttgttgcctatgctttctgtgccatttaccattgccatgttgaaggtcgtgataatttgcccctatgttttcttctaagcgttttatagttttagctcttacatttaggtctttgatccatttcatgttaatttttgtatatgttgtaagataaatgtccaacttcattgttttgcatgtgtaaatacctttttcccagcatcgtttgttgaggaggctgccctttcctcactggtgttggtcccttattgaaagtcaatggaccatgtatatgggggttcatatgggggttctctgttctactccattggcctctacatccatccttttaccagcagcacattatcttgatgactgtagctttatgagtaagttttgaaatcagaaaacgtgagttctccaagtttgttcttcgttttcaagatcgtttgggctatttagggttccggaagttctatatgaattttaggataaaggttttcaatttttgcaaaaattgctgttgggattttgataaggatgacgttgaatctgtggattgttttgagtagtactctcatcttaacaacagtaagtcctccagtctgtgaacacgggtgactttccatttatttgtgtcttcttaatttctttcatcaacgtcttgtagttttcagcatacaagtctttttcctcctgggttgaatttattcctaagcatctgattcgtttcgatgctatcgtaagtggggttcttttcttttcggattgctcattgctagtgtccagctgacttctaagtaatgattttgtaccctgaatctttgctgagttcatttattaggtttaacagttttttttttttttaatggttctctgggcttttctacatggtgcatatcatctgcaaatacgtgccattttagttcttcctttccaacttggataccttttgttcctttttcttgcctaattgctctggctaaaactcccagtattgtgttgaatagaagtggcaaaagcaggcatccttgtctttttcctgatcttggggagaagctttcagtctcgtaccattgactgtaatgtcagttgtgggtttttcatagatgacttgatttactaaattttactaaggatattttggtttacgttcatgagggataatatcttatagtctgttcgtgtctttgcctggctttgataccagagtaattctggtttcatagaatgaattagaaagtgtttcctcatcctctaccttctgaggattttgtgtgagattgctgttatttcttctgtaaatatgtgatggagtttactagtgaagccagtgctatttgggcattaatttctttacttgttgtgggtgtcttcaggttttctctttcttcctgaactcattttggtaatttgtgtcattctaggaatttgtccatttcatctaagttgtcaaacggttggcataaaatggttcataatgctcctttataatccttttaatttcaataggatcagtagcagtgttctctcttttattcctgattttagtaatttgtgtcttctctctttttttcatgggcattcttgctaaacatttatccactttgttgatttttttcaaaaaatcaagtttgatgctgctggttttctgtatcggctttctgttttctgctgcactgctgttcactctggtcttttatattatcttccttctgcttggttggggttggatttgttcttctttttcttgtttcttttggtggaagattatattattgattatattattgatataatatgattatattattgacctttttgcctttgaaatatgggtatttaaagttatgaatttcctgctttagctagatctcatgcgttttggtatgttgtggttttgttttcataagttcaaattattttctaattttcttttttgtgatttcttttttgactcatgggttatttagaaatgtgttgtttagctctcaaatatcaacttatttctccagtttatttttatttttattttttgaaatggagtctggctctgttgcccaggctgaatgaaatgcagtggtgtgatctcagctcactgtaacctctgcctctcaggttcaagtgattctcctgccttagcctcctgtgcagctgggattacaggcacatgccataatgcccagctaatttttgtatttttagtagagatggggtttcaccatgttggccaggccggtctcgaactcctgacctcaggtgatccacccaccttggcctcccacagcactaggattacaggcacgggccaccgtgcctggctatttctgttcttggtttctaatttaattccattgtattagagaacataccttgtacgatttaaatacttttaaatgagtgagacttgctctgggtctagcctacgggctctcctgaaaagtgtggcactgctgctgagtgctgtcatcatggggagcgatctataaataagagtttgggtaagttggttgacagtgctgttaaagtcttctgtgtccttactggtactctgtgtagatgctttattcgttatggagaatgggcatcgcaatctctcatgataattattgaataatatatttctcttttcagttctgtctcattttacttcatatattttggagttctcttgttaggcatgtatatacatttatgtctttctgtcaatattgacccttttatccttataaaatgtcctctgtctctagtatttttttccttgaagtctattttgtcagatggaatatctgtgttccacctctgttgcagttgttatttgcatcatgtgtatttttctgtccttttgctttcagtgtatttgcatcttgaaatttaaagcatgtctcttatagatggcatgcagttgggcctggagtagtttatccagtccaataatttctgccacccgacagtgttgttgttggtttagtggcatttttgtctctgacgttttgttccttgctttctacatgtctcgtgtcttttttgtttctgttcctcctttactgccttcttttgtgttaagcaaatatatctcagttaccctgttagctaattctgctgccgattgtgttaattgttaaccatgttttgagttgtgttcttagtgattctccaggaaaccagtatatatcttaatgtattacaatctacatcaggtgaatactgacttaattccagtaaaatgtcacctctgatccaggacagagccgttcccgcctgaattgtgactgcacacccagtttgtccctgtgtccctctagcctgagggtggcgttggcttcctgtagttgagactttccgagttgctcctcatccccatggggaccttctcacacctcttcaaccggcatcccatatcgaacccctgggtatgtgctgttttctcccatggactccaatgggtgcaggcatctccacctgctgtggccctgaccctccccttcctctcgatgttcatggggcatttaggggcttcgtctggggatggattaaagggcctgggctcctggggaggagctcccctgttctcccgggctttcctcggtctcccactcccctcaccctttgtggattttcctgggggattttactttattaaacgttcatgagcagatattctgctgccaggaaagaaaagcaatgaccagagattcggctgtgaaaaaaagaaaatggaggggttgggacaccatatcattcataggaccccttcattccaaagctcagcattgggctgaggcctgggcggagggcaatggagaggtgcagcgtgggggctgagtgcggcttggctgggtccccaccggtggccacggcacctgcaaggccacagggaccccatgcggggaatccgtgggcctctgtcgtgaactgcagccagggaccctgaagggctcgggcagctggggtgctctctgcttctgctgcacgcctggctggtgcctgagcagctctgcgatgcgcatcatggtcggggctgttttggggccgtttccaacaccagcagcgtcgtggctccacagcagcaaggcttcctgaaggaagaagggggcttcgcagtatagttcgagtcgggctctgtttctttccatcccaaacacatagagacgaccaaggccctgatcccaaaagaagaacccaggctgccggcgatcctggggacaacgatgttaactcagggacaggcgcagtctctggaccaggccaggtcgtggtgcacacactcgatctctgcagcgtttcccacatgggcactgcggaccgggaatgtcaggggaacgcgggcaccgtggaccgggaatgccaggggatcgtgggcaccgccgaccgggaatgtcaggggaacacgggcactgccgaccgggaatgtcaggggaacgggggcactgcagaccgggaatgtcaggggaacgtgggcactgcggaccgggaatgtcaggggaacgtgggcacggctgaccgggaatgtcaggggaacgcgggcacggccgaccgggaatgtcaggggaacgtgggcactgtggaccgggaatgtcaggggaacgcgggcacggctgaccgggaatgccaggggaacgcgggcactgcggaccgggaatgccaggggaacacgggcactgccgaccgggaatgtcaggggaacgtgggcacggccgaccgggaatgccaggggaacacgggcactgtggaccgggaatgtcaggggatcatgggcactgtggactgggaatgccaggggaacacgggcacggcggaccgggaatgtcaggggaacgcaggcacggctgaccgggaatgtcaggggatcgcgggcactgccgaccgggaatgtcgggaacgcaggcactgcggaccgggaatgtcagcagaacgggggcactgcggaccgggaatgtcagggcaagagggaagttgtttgctagcttgtcatatgtttagctaattatttaatttccctaatttaaagtttcaccggattaacatcaaaacaaaaatcttgtgattgcagcatcataaagcaataatgtaattaacttgtttagggtaacttactaacttggctgattgcaaggcatggggtctgggggcaccacacttgaggtggtcggggcgcttgtcaggcccaggctcctggcctcagcgcggcgcccagctcccggtgcacagggctcccaggccccggtgaggatcaggccactgtgccgcctcagggagtgggtgccggcctcacccccagggctggggctctcactcaggctgcgggcaggcatctccttggcccagaagctctgaccttggccacagttgggttttgagcacgcagcccagcagaaatgccgttccgaagccgtgcaggctgtgcaggccgggacaccctgctaaccaggagtggaattgagaacaggatttctctacaccacgagttcctcccagaactctggaacagattccaatgttgtttgaaaagttaccaaaccctgtttgatcagcatccattgctgagagagcagctttctctcttccccttttcctcctcccctctcccacctcagcttccacagaggtggcgtgcatggcgggaaccgtctgtcctatcggagcctggagaccctgggtctttcccttcagcagcttccacagaggtggcctgcatggcgggaaccctctgtcctatcggagcctggagaccccaggtctttcccttcagcagcttccacagaggtggcgtgcatggcgggaaccctctgtcctatcggagcctggagaccccgggtccttcccttcagaaatccctgccatctggttttgagactggctttgggggacagtggccctggtggggattcgggcatgaaaggccccctgttgaggtcgagcctggcagcatggggggactcgctcgtcttcgtggtgggcctcacagacacagccatctgggcacacaagagcattctggccgtgcatgtgtgcaaatgagaaccgtgtgcttcagaaacagactggagcgtgtggggacagacgggaactcacacacacgtgagctgccccaggcccagcagacactgaacgtgaggtggcttgctacagccagtgggcagaaggggcaggttttggtgttgggaacccagtccccgaggctgagaaactgcccacaaacctcctgctgttctttgaagtgaggggttcattttgcgtggagcccggagcacagagcaggccccataccaccaggcaaagcccacctggctcacctgctccctagccccgagatggtttcaggatgaggcagtgtggtcaatttggagaaaaatcataaaaccaattcaagcctggctgcccaggttttgggatccaccaactgggctgctttttctcaattttagccacatcgccctcagttcgaggaagtacttcccatgagcttgtgctatggtgtgaatgtttgtgtccctccaaaattcacactgaaacgtcatccccagtgccatagtacggagccttcgggaggtcagtaggccgggaaggctctgccctcaccaatagattagtgccagtagatacaagggcgggagggatgagtccgttccttctctcccttctgccatgtgaggacacagcaccgctcccctccagaggacacggcagcaaggcaccatcgcagaagccaggagccgctgtccccagactcgaggctgcagtgccttggtcttgcacttcctggcttccagaactgcgtgaaatacatttcaatgctttataaatgacccaatcacaggtgttctgttacagcagcacaaacacactaagacagcttggtagaattttctagaagctatctgctgattaaacaacagggaaaaggtggagtctgagagggagtagtgtgtgaaggggccctgctgggagaggttttgggaatctgtgggcggctttatagttcttggcactttcattttcctcttgggggtcggtttggtctaggttcccccagtgccaactctgacctaatgggggttgggtttatctgacaggtgattgcaggaggagagggatggaggaaaacagtgcccaggctgggacaaagggggctcggctctaccggcatttatccaccatcccatctctcggtgcgttgacgccctggggagctcacccccaggcagaagagcacaggtgcctggtgtgttcgtgaagcatcctcagaacctgggggggtgtctagggtcctcagaacctggcatggaggggggtgtctagggtgggctgaagggcatgcacagcatctccctttaggaggaggaagcacctgccatccagcaacccgccgtgagcgccgtactgcacagtcctccctcacctctccgaggacagactctcctgcaactgaggagctggatgtctgccttttcttacattctacatctaccctccctttctgagtggtgtcagatcctcggcttgggaagaaaatgcaggctgtggtctctcagacagctcttcatggtgacacatttgctcggcacctgctgtgtccccagatcaatgccagtggcctggggtcagagggcaggtgcacgatttgggtccagtttttcccagtgggtcatatgtggatctggggcaagaaccaccacccaagaggacgctactggcatgcagccctgagcatttttctgtttttctttctcagctttacatgttcagggtgtagtcagatggctgtgtgcaactgcagttcactttcaaagctgtgtatctgttttgcgaatgtgccgccgtttctttacctgctcattggctggttttgtggatgtgctaccatctcattggtcagttttgtgaatgtgctgctgtctatttacctgctcattggtcggttttgtggatgtgctaccatctcattggtcagttttgtgaatgtgccactatctatttacctgctcattggtcggttttgtggatgtgccgccgtctcattggttggtggcatttgcgtggtcctcagctttgggttgttttagactcagcttcctgaacactcttgtccgggtctctcatcttctgaacactcttgtccaggtctcgcatctttcactttggctgttctgtgggtgtgtcgtgcgtctcattgtttgatgactgaatcgccattataatagcatgaaggtgcagctcacaagcgtccacacaggcgaattcacgtggtggctccagaggaatgttggccttgcagagtcttggcatctccgtggcttcccatgagcctgcgagaatgctgggcctgtgatggtgacagcgagtcttccctgtcctcaggggtgcggccttcaccttggaaacatcatttgtccccctctgtttgggttcaagtcaggttcagtgactcactagaaagacagacctgagaaacgcagttctagtcccgattatggtttattaaaacaaaaagacgcgttaaactcagtgaagaggagacgcttgtggagcagtcatgggcggcaggcatgagctgctgggagtgctctcccgtggagctgtatacacagcactgtttctcccagcagccagcccgggaggctcgcctgagctttggtggccatggtttttactggggctcagtcatgtagacttggagtccctgtgtggctgaccctagttactcagtctcaagctgaccctgtgtggccccaacctgaaatcccatcatttccttagactacccaacgtggcccaaagcccccaaaatacaatgttctaatggctcaggatggcttcccaggtgctcgttaattgctggacttttatttggaatgtgtggggtgtgggcagcccaggcctgctgagctcaccgtcactgcacgccctctgatgtggcctggctccaggctgttggcaatctgaccctcactcctggggtttccacaactgtgagttccctggcgggcccctgagggaagttctagagaagaaagaggaacacaggatcagcctcaggctctgggaggagaactggaccccattgtttgggcttggacagctgtccaattgctcaggacctgggtgctgggtggaggcctcatcagcaagtgtcctgactccacgggtggagggatctcacactgcccaccacagtggcagcctcagagtaagcacgagcctctcgccctccatgcgtgtataaacaacatggctggtgggtgcctaggcccccagggaggcccctggtatgaggccagcggagggggcgggtagggaggagccctctctcttgcacttaggtctctggagtgacagggatggccctgccccactgacccaggcgttcaccccagagaagcgtgcaggcaggtgagaagcttgtttggacctgaagaccagcctgagcgaggagagtcttgtgcagacggtttatccaggaggagcccggggagaggggggtgggaaaagccacagttttggaggtcagcaaggtcatgtgggggcagactcctcctcctcctcctcttcctcctcctcctcttcctcctcctcctcttcctcttcctcctcctcctcctcttcctcctcctcctcctcttcctccctcctcttcctcctcctcctcttcctcctcctcttcctcctcctcctcctcttcctcccctcctcctcctcttcctcctcctcctcttcctctcctcctcctcctcctcttcctcctcctcctcctcttcctcccctcctcctcctcttcctcctcgtcctcttcctccttctgccaggacccttcttccaggacccctgagaagcgcatagaatagcgtccaggactgtctgccccaggcacgctgaccactggctccactcccctgggcaagggtcgcccctgggctgctgcctcccagcgacacaggcaggacccagaagcctggtagaaagtgaccatgtgtggcaggtacaagaggccgagtgcggtcaacttgaagggacaggaagcctgcaggcagtgaccactctctaggctgtgctcagaggagaggccaaggggacacaggcaccagggccgtgggacacacctgggctaccccagctcctatcaggcaagcacctggagcctcactgtggaggggagactgtggccgccggggcgagggtgacacagggacacctgctggagaggggaacccagggctggctcatccactgcggccataaaacttcagcttttcctggatggtcactgtgcttggccagaggtcactggtgggaccagactctggccaggctttgagacatacgtgcctttccgtgtggtaggcctgaccttggaaggggaggccaagacctccaccccctcccctccgccctggcctgcgctgctgggaagtggatttggaggctctgttgctctctgcacagcccctcctggcctggcggcccttctggagcctgggagcagaggtgaggctggcatgggcacgaaatgtggaaatgctccacgcccccagggcttgcaggggaagcgaccgacgtaggtgtgtggccctcagggacagccccgggaagggaagtggccgatgtaggtgtgtggccctcagggacactcccaggaagggactgggctgcagaggacccgctcagggaagcccggcccagggcagggcaggtgctgaccctctgcatctctgcccatggtgtttcccccacctggagtgccctggccagtggctcaaatcctccatggcctcgagcctcccctttaggttccaatgccgtgctccacacagggtgctgtgtccagtgtcactgagtgaatgggagagtacatgagggataccatcgaggggagtctctgctgggccccacctgctccccaaccacacactcccccagacattcctctatcgagggcagtctcccccaggtcctacacagtcccccagccattcctctatggagggcagtctcccccaggccctatacagtcccccagccattcctctatcgagggcagtctcccccgggccccacacgcccccgcagccattcctctatcgagggcagtctcgcccgggccccacacgctcccctagacattcttctgggccccggggcatctgtgtggctgctgggacccccacaggggtggcgggtgtggctgcccctgagaatcatgctctgtagtgtcccgcccctggtgcagagaatcatgctctgtagtgtcctgcccctcgtgcagagtattatgctctgtagtgtccctcccctggtgcagaggatcatgctctgtagtgtcctgcccctggtgcagagaatcatgctctgtagtgttctccctggtgcagagaatcatgctctgtagtgtcctccccggtgcagagaatcatgctctgtagtgtcctcaccccggtgcagagaatcatgctctgtagtgtcctccccggtgcagagaatcatgctctgtagtgtcctccccccggtgcagagaatcatgctctgtagtgtcctgcccccagtgcagagaatcatgctctgtagtgtcctccccccggtgcagagaatcatgctctgtagtgtcctccctggtgcagagaatcatgctctgtagtgtcctccccccagtgcagagaatcatgctctgtagtgttctccccccagtgcagagaatcatgctctgtagtgttctctccccagtgcagagaatcatgctctgtagtgtcctccccccggtgcagagaatcatgctctgtagtgtcctccccctggtgcaggatccggaggggctgccaggccaggctctcagggaaggtctgcggatgcccaagtgcctgcacacctctgagggcccgtggcaagtgtagaaagcaagctctgggcagggctggctgctgccagcctcccacctccttggttcctcctttgtcctgcaggcttgtctcttccagtcttaacaatgctgctctcaaaagtctgaagccatagaatcccttcgaacagctgattcctctggagaatccaaaaacataactcaattcccaaaatttaactttttatacaacttgcaggacttgatgtggcgtatggagcactgaccgtccatgtggcaggactcagaggacgcgggcaacacagtgcccaggacagagaggccacagaggagcaaacgggcaggccgaggacagtcaagaccaaggggtgccaggcagggtgtgggcttcttgggcccacaatgacgggccctccatcgggatcctgtggggcaggccaggggcaggggcaggtggcctcataagcccttgaggaaggtgcagggggagttgctcccactccatggctgggggacaaggggaattgcatttccaagggggctgagccaagcatcctcaaaggcggcagttttggagcgagttggcaccataagcacagaagacagcaaacgttagaccctctcccaactgtggcggcctggagggagctcatgccacctcttctcgaagggagcgccctatgacctcctcaggtgaaaagacagagggcagtgctggcaagggcaccccagaccgcccccaccacaggtcggggagatgctgcaggtgcctacaggacactcagcttgcagtcatgggaggtcaccgccacccccctgcggggcctcctgagaactgaggccaacagagcgccctgcatgcccagaaatgcaacatgctctcccttccttcccctgcaggacccctcttcagtcactcactcccttccttcccctgcaggacccctcttcagtcactcattttggggcaattgaaggctttatttggaaaagacataccaaatttcctcagctgagcagatttttaagtagcaaattattatcaacccgaactgggaggccaagtcgtctgtagaccctgtgaggagctgggaggtcacttccctttcctctgggtggaaggggacgcctgagagccaggggcagaggaagaggcagaaaggagggaggggacagggagagaaactgcaggtggacagacaggcagggcctggagtcctggagctcagaggggacaggagcccacccacagggacagcccaactctgtcttgtctttttgcaaaatgctcaagctcaaagcccggctgaggctgctttaaattagatgctgcctcagcgggtccctctggagttgttggaaatctaattagccaggcagcctggcacaaatgtcctaattccctgacgctgggggacgcgagtgtctctttgctgctggggttcccggcctcagcctggcctttgcactctgcttgttttccaggatgatgcctatcagaaaccctaattgttttttcagaaacggctaattaattaggctcagcctcttgaaaggcacttaaaatactaacgacttgctaaaaaagggcaggacttgaaagcaaagccaaggtccaaagtgcccaccagcgtgaggggtctgctgcctccctgcggggaagccctggcagagccccttgctttgctgctcacagagtccaggacatgagagccgagcccatgcaccagtgactcacgccccggcacagatgagcccagagcccggaacagaggccgtagcaagaccccgggagcccagcctcccctacccctccagccccgctctgggccccaggaggctgacctccatggatgtcccagcaatctgtctctggcctctgggtgggtgtggccaatggagtcatccgggacacggaggtgggaagggactgggccctccttatcaggtctgagggtcaggggccctacatctgcttgtccctgttctcagcgccaggctcacctcatcccctgccccttgtcagagctccttctttgaccctccccaggggtccagctcacttgtttgttagtgacctcatcacagacaagttctcagccctcccatggggcggtcggtccttcaggcactggaaatacagcggtggacacagtggtggacctcccggtatgtcctctgttcgactgaacagtcgggttgcggggcctccaggagctctgtgagcccgtgctcaggtgcacacaacagaagtactccgctgacgcccacccctttcactcagctctcggttcagtcatcgccaagcaactgagagcctttgtgaagaggcttcctgccctcttcatcttccacagacacgctcttcttccttaagcccaggcatacacagacacagtgaatgcacacacaaagacacacaccagtgtgcacactgctctggaatccacaggttctataaatatctagaaatgatatctgaaagtgcattgttatatgcgctggtctgtgatggttacggtgatggtgattcctccttccggaggatggcgcggctgcagccagagggagattaggtggcggaggcttcgatgaccatttacattttacgagtacttattttgagtgtgtatttggaaaaattaaatttgtatatcaagcccatgatttcacagatatttttgcttaggtcaaaggctaaaacaggtatttaaatcaattcgtttatttaacttaaagaaaaatatgacgggttaaggttgggcttccccagaagtagatcccgaagcaggaatgggaggtgtcccagcgtggcggcgagttacttcaaactgggtggctttaagtaacgaggattcattccatctccgttctggagctggacatctgaaagcaagctctgggcagggctggctcctgtggaggctctgggagggggtgtggtttcttcctggtcccttccagcttctggtggctccaggccttccttggtgtccccggcttgcagccgcatcactccaatctctgcctctgttttccgtggcgtttttctccaaatctacctgtctcagcttctccatctcttatgagggcacccttcatgggatttgaggcccactctaatccatgatccttaccctaattacatctgcaaagaccttattccaaataaggccacattctgtggttatgggtggacatatttgggggccctgttcatcctacttaaggagggaaagttgtttattttggaggtgactctgagagcacagcagcaggtgagtgggaggtgagatgcccagtgaccagggcggccatcaggcaggccacggccaggcttctgggctcagcctcaccaggtcctcagctgcccagggctttctcacccaggacctgcctggagactgctccggggccatcaagtccccggcatgtcagcccaccctggccagaaacagcctggtcaaggggcacagggctgtggagttggggtgcccaggaaggggagaaccagcggggtccatgggccaggagagtccagccttgaagatgggggtgtgaaccacacagtcacggtctcaaaggcacagagctttgaaagcaaggtagtagctcctcaagccctctgggcacgccccaccagggtttgtgtgtggagttaatagggggcagttccaggagcacaccagaggggccggggcagccggaggggccagggcagtggagggctgggcagctggggcccaaccccagtggggactgagaggcctcgtgactgctgcctcagatccacctctgaagggcgggaagcctgggctctccctgtcccccacaaaccagggctggggtgtagctggggggtgtggagtgaggctggtgagaggtgcccgacgggagaagggccccggtccagcagctttccctgatcaaccaagggggatctattttgtttgtaaaaagctgattatcatagataaatgtgtctaattagtctcatttgctgacacacaagcctttaattgcaagttgaataattagacatatctgcatatgtaaatgatacagttataccctatgtcagtctttaacgtgattcctccagagacaaataattctatttcaggagagaatatgatatattaatttacatagacaaacaactttatttagaaccagcaactctcgtgtttgtttacataaagtaataactcgagaaatgggaaagatcgatgttgcagcaacatctggaggctcctaacctgcaggggagtccctggcagcctcccacgggagctgggtcttcctccgccctcctggggccccagtcctcccacgtggacagcagctctgggcctgggggtgggctggggcccaggccatggggtctccctcccctcttccccctccaccctccctcatgccatgcttcctcctctgccccttgtcctcgctgggtggcaggatgggtgagatgcccggtggccctgcaggcctgcagctggcccagtgcatgtgggtgtcccctctccatggctgtgccctgcatgctggcagagctgccaggggcagcttggagcaggagcagctggagcttgggtcctgattcaggcagtgctacagccggctccctgccaggccctgggtcagctgcccacctccccagtgggtgtcatgctcagcagcctcaggacagggctggggggctggctggtgccgcctgcctctgtcaggcccccggcctccactctggctgagtacatcgtctcctctctgagctgggcagggcagccactggcgacccctggcatcctccgggtctgactggcggggacagggctgcgaaagcatttggaggcctgacctggaaggaggaatgaggggccagctgagggcgtcccaggcagagccaggcttgcgatgcccagggtgcccggggcacagagtggcccggccgctcccacaccccttcccccttccctgggcccgtggtcacatgggtttcgctgggaggcagagcgtgaggaatttggctctggtggaatgaggacggctgcactccctgctttgcagagggcccgcacagcagcccgtcactgtggcaaccggctccgtgatgctggcaggagctgacatcgtcccaattcgcccctgtggtcccttttggtccccctcccctcgaccgccaggagccgctgtggatcgagttggccagcagagggcagcagagggctggcggggctggcggggctggcggggctggcggggctggcagtggacgccacactttggggtctccaggcccccaagtcttctggggaaagcagcagacaggcgacagccacagggatggggaggcgccatcactactgcaaccactgggggtagcccttggcccgtctgggggcatttcatctttggcagagctgaggggtccagcacgtgggcctctaaggaggggtctcccgcccaccgcccccagtgctactgtgaccgcggcggctcggccccgcctgcactcccaggttctcactcatgcagtcactcactcattcgctcgctcattcactcgctcattcactcattcattcactcgctcattcactcattcactcattcacacacactcatttgttcactcattccttcactcaatcatttacacactcatttgttcactcattcattcacatacttatttgttcacttattcattccttcattcactcattcattcacacatactcatttgttcactcatttccttattcactcattcacacatgcactcatttgttcactccttttttcattcattcattcacacacactcatttgttcactcattcattcacttattcacatacactcacgcatttgttcagtcactcattccttcattcactcactcattcacacacactcatttgttcactcacccattcacacacactcatttgtacactcacacacaatcatttgtttactcactcattcacattcactcattcatgcacacacttactgattcatgcacacacttatttgttcactcactcttgttcactcattcatttctttcactcattcactcacacacattcactcattcatggacacactgattcatacacacagttgttcactcactcattgcttcattcactcgttcactcacattcattcacacattcatttgatcagtcattcattcatgcaatcatttgttcactcattccttcactcattcattcacacactcatttgttcactcctttcttcactcattcattcacacactcatttgttcactcattccttcactcaatcattcacacactcatttgttcactcactcattccttcattcactcattcacacactcatttgttcactcgctaattcaatcattcattcacacacactcatttgtttactcactcatttgttcacccactcattcctttagtcactcattcattcacacactcacttgtttgctcactcattccttcacacacatgcactcacttgttcactcactcatccacacacattcattaatttatttacacacactcactcactcatttgtttactcagtcactcctttgtacacagggaaagagtaaggtacctttccctcctgttcagctgctgccagaagcagtgtccagttctcctggtctaagcaggactcaaggtcctgcagcagctcagcagcccctggagctgcagcgtctcctttgttctctctgaagggggcatgccttggccccaacattcttgtccttcattttttgaagtttcttccccctctctcctggctaatctcatatcttaactaccaatataagacaaaatatttctgtgactttctttccaattcaataaatccatctggtgagaagagaaaaaaatgcaagaagagaagaggcaatgccgcaccccaaaccctgtcagtcactcacactgaggacattttcacgaggcgttaatgggtgatgtttgaattctggttgccagcacagatcagggcaaagctcttgtaaaactctattaaagtctgtggatccagctgagacacagggctgggaaacaaagttaactgttctccctcctgagcggcttgtggttcaggaaacacccccaagcccctgccttgggggatctgtgggtgagagggaagcatatttggatacagcttcaagagagaggtccgactgctctgtgtgtacacgtgtgtgtggattgccctgtgtgcaccagctctgtgagtgcctgcatgggagtgtgtacacacctgtgctctgtgtgcatcctcaaacacaccacaccaacaggggtctggcattgcctccctacggtgctcatggtgaagtcctcggactccaagcccctcttctgcgccagcagtgaccaggctgtggtcagcatggcctgttggtggcctttgacttcctctgttggcagatggcttgaggccccccagttcagggccacaggtgacttccccctttcccaggtggtggggccctgtaggcttgaccagccccaggctccagagcgcacagaggtggctgtccacagagcgcgggaggcatgggagggtgtgctgctgcctgctggtcatccagctcctcgcccattaaggagcccgctttcccctttgggaggccacaggggctggcgaaggcccttcagctgtggctcaggtgggctgggcaccactgcaggagaagcctcctccagatgggaggaggtaggaggtgcctcctccagatgggaggaggtaggaggtgcctcctccaggatcaaccccagctccttagcaccagcgaacagacacagtagacacacgcaggaacaagcacatgtcccaggctgcaccgtctgtgtctttccctttttggggtccttgcatttcacccttacctggttctggattcagcttttaagggcacactgattggcagccaggccactgtgagcgctggctccaaatgtccttttgttttgttttgttttgttttgttttttgagatggaatctctgtctgtcatccagcctggagtgcagtggtatgatcttcgctcacctcaacctccgtctcccggtttgagtaattctcgtgccttagcctccccagtagctgggattacaggtgtgcaccaccatgcccagctagtttttttgtatttctagtagagacgggttttcaccatgttggccaggctgctctggaactcttggcctcaagtgatctgcccacctcaatctcccacagtgctgggattataggtgtgagccactgcgcccggcttccaaatgtccttgacaacggccacagcatagcctgcagccaaggggcgagggctgatcgcgagggcctgtggtcattcctccaccttcggtgccctgcctgggcacccccgtgcagctaccacgtggggaaggcacttggcctcttccctcatctgcagactcagccaacttctggggctccctcggcagttggggctaactcagtgggtcaggtggaccccggctgtgcgtgcagcccccgagagggtcagcaggggcgcggaggcccccttggctctgctttgttctgcctgcggctccggttggtttgtgatatctttgattccatctcttgcccccatgtgaccccatcgtctgcctggccgggggctcccttgttggagtgtggggcgagcccccacccgtgtgggaagaggagaaggccaggctctaagccccactcagctcctcgtcctcggaggggtcctggccctaagagggcttgttggggtcacgcaagctcacaatggctgtggtcctcagcaggtgggacaatcgggctgttttccgatggtgtttggcagaaagtgggagtcaaagcttagaaaagccctgacagaaatggttccctgaggctggcgggagagtggcactcgggatattaaaacagcgaagtcggtcctggccaattatcagccagctggccttgctccggcgcccagagctcacagggtgagtcaccatctgcggctgagcatccctgttcagtgagggagacagatcctgtcctggtccctcctcccagctgtttgtggcctccctcctcaggctgcctgggaagctgtttcagaaccttccagtcccctcctggctggccctggggctctgtggaagtcctgcttcccccagcagtgcctggccctttgtccccgacccaggaaaaggtgaagtgggggtacttcctgtgcatgacacgcccccttcccttctcccagcctcctgcctcggggctctggcaagaaagagggcctgagctgcaggagaagggcttccttgagcaggaagaagccctggcccagggcagggtgcccggaaggcggaaggatcccagcccaagccacagccccaccagatgggtgggggccttcatcacaagaaagatcagagagttgccctctgaagccttcgcagtggccctgacacaggctgccagggatccgtcactcaagggaaggccctgggggtggggggctctggcaggggtgaccacagtggttaggggcctgggtgagaaaagggacccctgatgtcccatcagggccgggaggggaactggaggacctcctggcactccctggcccctcctctggtgcctagcaccttccagtgcttttcccaagaggaagggagagcctggtttcattactaagccctccatgtcctgtccgtgtccgtgtcctgtttgtgtctgcgtcctgtctgtgtccatgtcctgtctgtgtccgtgtcctgtccgtgtcctgtctgtgtcctgtccgtgtcctgtccatgtccacgtcctgtctgtgtcctctccgtgtccgtgtcctgtccgtgtctgtgtccatgtcctattcatgtccgtgtcctgtccgtgtcctgcctgtgtccgtgtctgtgtcctgtccgtgtcctgtctgtgtccgtgtcctgtccatatctgtgtccgtgtcctgtccatatctgtgtccgtgtccgagtccgtgtctgtgtctgtgtccatgtccatgtcctgtgtccgcgtctgtgtctgtgtccatgtccatgtcctgtctgtgtccatgtctatgtcctgtccgtgtcctgtcagtgtcctgtctatgtcttgtccataacctgtctgtgtccgtgtcctgtccatgtctgtgtcctgtctgtgtcctgtctgtgtccgtgtcctgtccatgtccatgtcctgtccgtgtctatgtcttgtctgtgtccatgtcctgtccatgtctgtgtccgagtcctgtccatgtccatgtccatgtcctgtccgtgtctgtgtccatgtccgtgtcctgtccgtgtctgtgtctgtgtcttgtccatgtccgtgtcctgtccatgtcctgtctgtgtccgtgtcctgtccatgtccgtgtcctgtccgtgtccgtgtccatgtccatgtcctgtccatgtccgtgtcctgtccgtgtctgtgtccatgtccgtgtcctgtccatgtccgtgtcctgtttgtgtcctgtctgtgtccgtgtcctgtttgtgtcctgtctgtgttcgtgtcctgtccatgtccatgtcctgtccgtgtctgtgtccatgtccttgtcctgtccatgtctgtgtcctgtccatgtctgtgtcctgtctgtgttcgtgtcctgtccatgtccgtgtcctgtgttcgtgtcctgtccatgtccgtgtcctgtctgtgttcgtgtcctgtccatgtccgtgtcctgtctgtgtccatgtcctgtctatgtccgtgtcctgtccgtgttcttcttcaccctgatgtgggggagctctttcggcctttcctttactgcagcccgaaaaggaaaaaagagggaaaagcaggcacatttcttgaccagaaaaaataaacaaaaacaaaagccccttgtgctccatgggggagagcgtgaagcccccgagcgccactgcccccggtcccaggaggctcaaagtcctctctgctcagagagccgggggtgcttggccccaccctgtcccccttcccagccacttggtatttacatgtacagctggaccccgagagaatccccattctaagcccaacagtacattctggggcgttttaaagaagataagaaagtagctcagaggtttgccaggctgcctcattcctgggatttttagtgtgagccttggagctggtgggcttgaatgtggggttcctgcagttgggtccccctgacgcccccggcccttccctgtcactccggggtgtaattaggagtgtcccccaggattgagggagtgtggtctcgagctggttggactcaaggctgttctacttttttctccaagttttgtttattgtggtaaaacacacataaaattttatcatctcagccatttttaatgaacagttcaatgacactaaggacattcccatggttgtgccatcaccactgtccatctccagaacgcctttcaccttcccaaacccaggctctgtccccattaaacagctccccacgcctcctcccccagcccccggcctcccctttctactttctgtctctacaaatgtggcagctctgggaccgcgtgtgagtggacacctacagtattgtcctctgcgactggctgatttcattagcatgtcctcaagcttcatccacgttgtagcctccgtcacaatttccctcctttttaaaggctgaataatattccattgtgtggatagacacattctgtctattcattcatctctcaatggatacggttgcttccatgttttagctattatgaacaatgctgctgcaaacatgggtataaagtgtctctttgagatcctgctttcagttcttttgcgggtgcactcagccgtggaatggccggatcacatggtcattctgagttttgttttgttttgttttgtttttttgtttttgttttttttgagacagagtcttgctctgtcacccaggctggagtgcagtggcgcgatctcggctcactgcaacctccgtctgttgggttcaagtgattcttctctgtcagcctccccaatagctgggattacaggtgccggccaccacacctggctaatttttgtatttttagtagagacggggtttcaccatgttggctgggctggtctcgtactcttgaccttgggatccgcctgccttggcctcccaaagtgctgggattacaggcatgagccactgtgtccggcccattctgagttttttgagggagtgccatcctgttttccacagtggaggcaccattttacatcccccaccagccgtgcacgagggttccagtttctccacatcctcaccaacatttcttattttcagcttcttcttacggtagccatcccagcgggtgtgaggcgcatcgcactgtggttctgatttgcgttttcctcatggttagcgatgttgtttcacgtgcctattggccgtgtgtgtgtctttttggagaaacacttagccatgccctccatgcatttttgagttgggatttttgctcttattgagttttaggagttctctgtacattttggatgttcattccttatcagatatatgatttgcgaatattttctcctgttttctgggttgcctttgattctgctgagattgtctgttaaggtgaataatttaaagttttcctgaagtccagtgtgtctgttttttcttttattgcctgtgcctctggtgtcatatccagggaaccgttgtccaatccagggtcatgaagctttgtgaggctgttctactttatttccagggagctgcacaacctggggtcttctctggggccgtgggctctgagggccgaaggccacgttccccgggtgttggtgtggacctcggcacggcccccactgacctgcatgggccgaggtcctgcaagagaacgggctccatttgcgtctgagggccaggatgcctgcactggggatcacgctgtgcttcggatggagcctccaatctcggggatgccattttaccctggaggccatcgggcttcatgccccacgggcattgtatcggcttccgtgtggccccgagagcagggcaatccgagggcaaggccaagggagtggtgagcgtggcctgcagggcggagccaggcgaagtggggtggggctggaggccgcccgggctctggttggtgggcagaggcaggaagccactggtagctcagcacagcacagggctgatgtcaggggcggcacccagccaagacccagggagctgggtgctttcagcttctctttgccagtcagctgctatgagggcctaagcagtccccatggcttcctgctgagacacctaggtcccccatgacttcctgctgggacagagaccccctctgagaggcagatgccaaccctgagcaggcccccgaggttccctcccattctcctggtaccagggctgggagggcagggttccggcctgtggcactcaggctggtgatgtcagaatacgctgcgggtgccctggactcctgctccggttccctgaggggtcatgaccttgagtactcatgagagacagcttctcacactcacttccgcgtgccttccccaaacgcggagctgcctcctggtgcagcctgaggcattttctcatggtctgtccagaacagtttctgggtcagattcagttttcagaagcagaagccacagcattcgtcctctgctccgtccacacgcggcacccaccccaaggaggcggcacagcctggcgccagccacagggctcagcagagagaggggaattaaacagccactggctgggaaaggacgtttcaagggcgtaccacgcggccaattcaatggaaaaccaaactgcaagcgggaatgtgcatcagaaccagcccggagccagcaggcgttgctggagcagggtggtgggaggtggcgttccaggcctggttgcactccggtttgtccttcaggtgcgtgaggccgcctctgccatggctctaggcacgtccctgccagtgggggctccagcataatccctcgtcctgcagacacagcaccccccaccccccgcaggaagtgctgcatccggctgcctgggccgtggtgcccctggggtcagggacgtggcaggtgcggaggccgtgctcggtgccaggctctgagaggtgacattgcctcacctgggtcgagctccagccaccgaggacgatggaatgactggggtgtcttccgggagccgtttgattgtctctggagaatcagccgaggctggtgccgccttggagcaaaaacaggggaaatgagactccacaccttctgccaagactttaattctcttccaagcttcagaactgaaataattttagaagtcattgttcatcagctggctctgttttccacagcttaaaaatgtcctgaatggttgtggagtcagggtgctaaaataacaacgcaaaccgggaggaggccgggatgcagacagaaagagaggacccggcctgaaccaagcactggccacggaggctcgtggcagcgctgaggggaggacggtagcctcctgcctgtggctgccggggctcacatctgagcgccactggcttaccaggactccgactgggcttgccaggcagcggcccttgggaaccggggacgtccaggcagccaaggccttgctctcagccatgcatgccactggccttcaacaggctttccttaggtcggcattttaaacaaaccccagggtgggtcctggtgaggatgctctgttctctgtgctgtcctctaactgcagggacgctgggtccgcagcttccatgggctgggcggctctggtttgggccggggtggatcctggctgtgcattcgtggacatcagcttctctagggtttgggatgggggatggtttatctcaaacccccaacccctcactggacctcaggcctgctgcaaagcagaggctagggttggctttaactcgctgccccatgcaggctgcggacactccaggagatgctctgttttcccgcccagcagtcaccatcacggagatggaggcctgaggtgcggtcttttccccctgcttctcttcctcttgtgggaatcactgcaaatgagaccacagcagcctgggccttgccagcagcaaatgctcagtggtagagccaggcggccctcttctcctgaaagccttgtcctgggtcaggcccgggaagaaaggatggggacaggaaaggacgaggctgcggctgccgtcccccagggcagccacgcctgggcagcccccggacagagcctgtttcagccctcagacttcacggggcaagatcacagccctctcacctggcttcatatggcagtgccacagaggcccctccctgactgctccaggctctccctgacccctccctgacctctctagggatctcgtggggacccacaggccatacgacattctgagggcctggaacggtgacttccctgacacttttctgttattttaagtaaaataatacatgctcaccaccaaggccatttctggttgaatttttttggctcagattagataatgctaaattttatgctaatttaaagtgtcaaacaagaggccaagccgcggttctccgtggtcccctgctgcaccaggttatgtaaccgtgtttctcctgctcgtttgcctggcgccgcccaggcccgtgtcttttctattttgggtgtagacggaggtccttctgtctgagctttggagcacaagggtctgggcgtccttcagttaggggaagggctttgatccctgagtgcctgcgaccttgtggggacagcgtgatcatgaaatatggaattcaaaggttcccaggtttgagatgttgacacgtgagtactttgccttcaccagtcctggaaagacctggtgggggaagaggacaatgacaaagttgctgtgtggatgggcggcgcgtgcagaaggcagggcctcgggctgcagggggatgtgcccctgtctgcctcctgcctcgagtggtcaggccggtgctgggacatacccacttgccccaccccaacccggaaggacagtccttgtgccgggcccttcccacgggagcatctgtgggatgcagagcctgccagcaccggcatgtccacctggggccactcagcgttttgtttttgatgtcaaggtgaatgcccctgtgtaggttcagcaaaatgaaggactgtatattaagtgtgttacacacacatgaatgaatgcctggacttgtagaatgaggaaactcaccaagcacctacaaggacctggagaaagagagaaagaggtgggagggaggaggggtgggccgagacctcagcccgtggagctcatggtgggtgaggggaggagagatgcttaggagaacaaaagccagcctggctggtggtgaggtcacggccaggggagcacccagtagaaggggacagcagctataaacactgaggaccaggaagggctccctgcaaaggggcagtgtggccaggactggagggaggcaggggcgtcgagacccgcgggggcgtcgagacccccgtgtgcctgagcacggcctatgcctgccctgtggctacgatgagaaacatcccacgtgggctgccagtggacgaattgccagcacctgccatctcctgacatcactctccttcgaggctcactcttcttcactcagagttgctcacggattcgcctgttccctcattcactcattggttcagccaccaaattactcattcattcattcattcactcacttattcatgcgttgaacacctggctgacgttttggggagcagggttgggatgtgcagcaccccacagcgctttgtggagctctgatggcctcacactccttgaccaccaagcaccagcccctgggccgcgagccagccaggctgttgccgtgtgtgagacccagaggcagaggtgggagctgggccccacgctgaattcatgggcttttgtctgcctctgcccacctgtgtctgtttattcacccgtcccctccctgcaccccagtccccacccccacagcagcaaaggcagccccagtattgacacccagcagtggggcctgcaccccagtccgcacccccacagcagcaaaggcagccccagcattgacacccagcagtggggcctgcaccccagtccccacccccacagcagcaaaggcagccccggcattgacacccagcagtggggcctgcaccccagtccccacccccacagcagcaaaggcagccccggcattgacacccagcagtggggcctgcaccccagtccccacccccacagcagcaaagtcagccccagcattgacacccagcagtgggggccgaacagaccccagacaaggaggggccaccaggaagcctctgccaacaacagccccactaggcctcccgcttcctgtctgccctgccagccctggtcaggatagcattgagggtgagggcatcgggggccatggccaggatgggaggaggcagcgctgccacccaccacccccggctctggggagctggactcggtgcccatcccactgaaaccatctgctgtcctggagcccagagatgcccgggcctgccgaggtgggcagcaagaaggtgcgatgaggtgtttctacagaaatagcaggctggccatcccacagacagcacaaggaccttccccctttcctcccagagaggaatctgcatgtctcctccctcccagagaaaacaggagctccttgtccaagtcattcagggattttccaagggagagggagtttttttattgtttgtttgtttgttttcagagtcttgctgtgtcactgaggctggagtggagtgcaacggcatgatcttggctcactgcaacctctgcctccctggttcaagtgatttttctgctcagcctcctgagtagctgggattacaggtgcacaccaccacgcccagctaatttttgtatttttagtagagatagggttttgccatattggccaatctggtctcgaactcctgacctcaggtgatcagcttgccttggcctcccaaagtgctgggattacaggcgtgagccaccgtgcctggccgggagggagtttttaaagaggtcagacctcttcctgattttggggtgcagagccagcaccatccaaggagatgctgcggggttgggagggaggaccgggtccatgctccccagtggaggtgccggctctgggagacacagggcccctcgccctgcatgcatgcacatgcggcttctcagggcagctggacttgctctgttcatgagctcttggccttctgaaactgctagttagaggccagttagaatgcttggcctagagaggcccctgttcccccatcggagctgagctgccatctctcatcagaggctcgtgtcagaaagccctggtggaggaaagccaacacttgggaagcacagggaggcaggctggacccggcgtccttgcgggctgttggcaacaccgtctggagagggaccgggccctgtgcccgccagtccccagggcggggcggcctgagctggcctggtctgctgtccttgggatcaggccaggactcagctctgtgcctgggggccctctccaaggtgctgacgacaccatgttccagccttcactcctgccagcctgggagaccttcgagcggctttaacaaaccccatcgcaactgggcttgccttgaacacagccctggacaatggctctgtctgggtgtctttgggaatacacgtctttttactaacttcagtcagaccttcagccttccttgatccagcctctctgttcttcccctgctcctcctccccaccccaccctccctcccacagcaattccccaaaggagcagaggcagagggagagccttcctctgcttgtcccttgagaagaggatgtggaaacgtcagagattctcctgagagttgcaggcaggcagggaggacagacgtacttgggacacttcctgctgtgattccaaactctgctgacccaaggaggaggtctgcatgccctgcgctgttgactgtgtgacactgtgtttatgctgaaatatggagtcccaggaggctgggccatttccctctgtttcttttcttttctttttctttctttctttctttttttttttttttaacacagggtctcactatattgcccaggctggtcttgaactcccgggctcaagtgatcctcctgcctcggcctcccacagtgttggattacacgtgtcagccaatacgcctggcccctatttcctttcccacttaatgaaacaaaatatttagctggataacaattatttcactttctgaagtcaacacgagtctatttgcaaatacctagaattcattctagtagcaggaggcaaaactacgagcctgtgttggtcagcgtggctctgctgctcggcttttcatgccacattagatgggcatctgcccagtactgtgtccccctttgcccagcattcagcccttgtcattgagaggggacagatgcaggtggaggatgagagcaggctgccagagctgagtgtgggcaggggtggaggcaacctgaagtagacactctgctgggtgctcaagctgccaaaccctgctggtaaaacagagatgcctaaaggatttggagccagacagggaggctgagtggggggaaacagcccagcatggtgggctaggtcatgggccctggacaactcgtgtctggtggagtgctgactctgcagtgagggtgtgaccttggggagctgagaagattgaagagctcatttttgaaccctcattcctttcttggtttcctcatctgtaaaggggtcatgttactagggtctcatgtaaactctggccccttggtcagcactcagcttcacaggtgttgcctcggtccccagctctcaggtgcccgggctggtgagagggcactgcgccaggcgcagcagctctgcaaaggtggtgacccaggacacctacccttctctgcagctcagcccgtgaatttgcaccacaaatttcaatgaagtcatcttaagaagatctcactttgttccttcttccagaggcgggtgggtgggaggcccagctcccctttcagagaggaccttcctcacatgctaccctgtccagccccacgccgttttcggtgacaggggcctggacagatccctggttcagagcccaccccactggaagtacaggagactgagtcagaggccagtcaggccggatgagatcaacagtgatttgcctccaagccctgattcctccctgaggaatgctcctgagaaaacgctggctcccactcacagctggagcttcaaaggttggtctagcactgaccgtgtggacccacgtgcttctgtctggaaaagccccacaagccccgccccataagaccccgcccctcttagctccgcccacaaggccacttcccagctccgcccatctcgcgtctgtaccctacaggctctgcctggttccaccccaccgcttctgccacccactctaaggacccgctcctccccgcccccgcccccaaagccgctcctctcacggcccccgaccccgcaggcaccgactgttctcagccccgcccctcgaggccccgccccgcggcttcccgccggggattgcggctgcgcctctgaccctccgctccgggctccgggctcaggtcccacacctgcccgcgcccccaggccccgccgtcccccagagcctgcagcgggcgccgcgcaggccgccgggctcctccgggtgggccgggctcgggcttttggagccgcgcgcccaccgacccctcccacgggcggcggggggagagcccacccagaggcgcagcggggccggtggtgtttcccgccctcccagggggccgcgggtccgggggcagcagcggggcgcggggcggagggaggcccggcgggaacgggcgccccctttgcacccacagccgtggaacgccgaggtctcagctcccctacggcgcgcgccccgagaccccgcaagggcagtgctggggacgcggggccgagactcgaggacgcccgaggccgggacggggtgtgggggcgtcccccaggctcccgggtcccagtgcaggggctcgcggtcaggaggttaggtggatgagtgaaggggaaaagcgcggttctagctgcctgctcaggcttggggcgatgtgaacgtcggggtttgcccctcgaccccccaccagaacgcagatacttctcagcaaagaggagcttggggcagcccactccccacagaggaagggaggggcccgctccacggaggacctggggggctggaggaacaggcacccccatgccaggcaggacccgagggatcggtacagggcacggggagaggggcctgggggaagctgttgaccccgtgatcctttttacaaacttgtaaatcagagagaaattaattcagatgctgcaattttttctgataaacctcgaaacatgtaaatatcaaaccctcttccttcagtcactaaaacaaatggaaaacacatttattagcatagagatgagtttaatcaaatcagcctgagtgcaaattagccacaggaaatgcaatgagctgggaattaattagcagcgtaatgatgataaggtggcctgctgactgcctggaggccgcctctccccacggttgccgggctcctggcagctcagcttttcctttgcaagaggccctgagcggggaccactggacagccccctggaccccttggagagctgcagaggagaggcttcagggggatgcctcccttggggggcaggtctgtgtgttctaggggagcccagcctaccctcccccggggtgctcgtggcttcctctctaggaggccagggatggggaatgaggccttgggatggtttgaggccttcgggagcccaggagagggcctggccccagggcagtccggcccagagggggctgcctgctctgaaggaggggcttcccaatgtagaggtcccagtggccctgggtcccagctgggggtggactttggtgacaggcagcccccacctgaactggaggagcctcatcgagggtcctaaatgatactacagatgagacgtgcatttcaaatctgagggcaaggctgggaccctgggccctggcacgtgggactctggaatccacctgagtgcccattcctgcaggaattcctgagattgcttggcaccttgcgggttgtggctggtactgaggtgagcggttgaaatgtcccccaggactggtcagctgccctcccagttgggctgggtgcccaagtgttcacagggctcttgggaggacctgggtggccttgtgcaccctgggggctgttggtctaagggtgcaggggctccctggaggtcgggagctctccctggggccagctgcagccctgcgatgtgccctcccctccctgcacaggctggacacacagggacacttcttccccggaggcttctccagtccccaggaatctgtcccccacctgtcatcaggaaacttcagaagatcaggaatttttttctggagctgcattttgcacagtttcctctttttaagggaggaggctcggagtctccggtcaccacagccgatttccctgaagcctccgcagggggccacccccacagagttttatatgctaacagttcttaaattcggagtcctgtgggaaggtgggaaagttaggtatatacactttttaatgtttttgtttttgtttttttgttctactcaaaaagtcattggtacctaggtaacacacttaaagaaaggcacactttgtggctgggcacagtggcttacacctgcaatcccggcattaggggaggccgaggcgggccagtctcgcttgagcccaggaatttgagaccagactgagtaacatagtgagaccgcatctctactaagaaaaaaaaggttagccaggcgtggtggtgcgcacctgtggacccagccacttgggaggctcaggtgggaggatcacttgtacccaggtggttgaggctgcagtgagccgtgatcaggccactgatctccagcctgggtgacagagtgagaccccgtctcaaaataataacaataaaataaaggcacattttgagaacagaagatgtttctgagtttcacatgttgccatatcctgtggacagcttatagtgggacaccagggcagatattgaagtttgatgtaacttgtgaatggcttaaaaagtggtaatttcttgggatcagaaagctgattaaggcaaggctgagaggagtcagcttgcctctcttccacagcgtccactgggacagttcaaccctatctgcgggaccaatctccaagacgtgagttggcacagccatcagttcgtctccatggatgtctccacgggcaacctgagctcccacgtggcatggtgatggttctgaaagtgggtgttccaggagacaggaagtgccagttccttaaggcctgggcctgtggtaaaatatgcataacacgatttaccttattagccattttaagtggtattgagtctgttcataatgttgtgcggtcatcacgactgtccacctccagaactctcttcatcttgtaaaactgaaactctgtccgaattaaacaactcccatcccccctccctcaagcctcagcacccaccgttctactttctgtctatgaatttgactaagtacctcacaccagtggaatcgtatagtattcgcctttttgcgactgtcttatttcactttgtatcaagtcctcaaatttcatccacgttgtagcatgggtaaatttccttcctttttaaaggcggaataatattccattgcgtggatagaccatattttgtatagtcgttcatccttcaatggatatggggttcatattagctgttatgaacagtgctgctatgaacatgggttcacagcatgcacatctgctataggttatctttgagaccctgctttcaattcttttgggggtgcactcagaagtggaatggctggatcacgtggtcattctatttggagttttttgagggagtgccatcctgttttccacagtggtggcaccattttacacccccaccagccatgcacgagggttcgtttctccacatcctcaccaacatttgttattttcggttttttctcacagtagccatcccagtgggtgtgaggcgcatcgcactgtggttctgatttgcattttcctcgtggttagcgatgtttcatgtgcttattggccatgtgtatgtgttctttgtagaaatgtttatccaagtcctttgcccatttctgagttaggttttttgttgttgttgagttttagaagtcctctgtatattatggatattaatccctaatcagatatatgatttgcaaatattttctcccattttctgggttgccttttttccctgttaatattgtcttttggctgggcatattaactctgcctgtaatcccagcactttgggaggccaaggcaggaggatcacttgagggtcaacaacctgggcaacatagtgagaccctgtctctacaaaaacataaaataaaaaacagcctggcacagtgctccatgcctgtagtcctagcttcttggggggctgaggcgtgaggatcacttgagcctaggagttcaaggttgcagtgagctgtaattgtgccactgcactccagcctgggcaacagagcgagaccctggctcttaaaaaaaatagtcttttggtacaaaaatatttattttttacgaagtccaatttgtctgtttttttcttttgttgcctgtgcctttgatgttgtatccaaggaatcattgccacatctaatatcatgaagctcttgccctgtgtttgtcgtagttcatttgtgtggctataaaggaatacctgaggctgggtcacttatagagaagagaggtctgtttggctcatggttctgcaagctgcacaggaagcatggcaccagcatctgcttctggcaagggcctcaggaagcttccgctcatggtgaaaggtgaaggggaagcaagggagctagtgcacagagatcagacagcgagagcatggggagcaagagaggggagcaggttcttttcaacaatcagttcttgtgggaactaagagtgagaactcactcccccgagaatagcaccaaactgttcatgaatgatccgccccacaacccaaataccttcaaccaggccccacctccgacactggggatcagatccccacaggaggcttggcagggccaaaccaaccaaatccaaccacagcagttttcttctaaaagtttgtttatgttgaacatttaggcctttgatccattttagttagtttttgtatatcttgttgggtaagggtccaacatcattcttttgcatgtggatgtccagttttcttagaaacacttgttgaaaggactgtcctttccccatcaaatggtcttggcaccattgtaaaaaaatcatttaaccatgtatgtgagtgtttatttctgggctctccattctattttatttggtctatatgtctgattttatgtcagtaccatattactttgattacagtagctttgtagcaagttttgaaatcaggaagtgtgagttctccagctctgttttttttttctttttcaaagttgcttcggttattcagtgttccttgagattccatagaaattttaggatgggtttttctatttctgcaaaatacgtcactgagattttgatagggattacattaaatctgtatattgctttggatagtattgccattctcacaatattaagtcaatacatgaacatgggatgtctttccatttatttatctcttctttaatttctttcagcaatattttgtagtttttattgtatgtctttcatctcataggttaggttaattcttagtattttattcttttttatgctattatatgtggaattgttttcttaatttccttttcagattgcttgttagtgtatagaaatacaactgatttttatctgttgactttccatcttcttactttgctgaattcatttattagttcctgcagtttttgtgtgtgtcatatttagtgtattttacatctgcaaacagagactttttttaagttctttctttctaatttggatgtcatttatttttcttgtctaatcactggataaaacatccagtactatctcaaatagaagtagtgaaagcaggcatccttcccttcttcctgatattagacaaaaagctttcagtatttcaccactgaatatgatgttctttgtgggtttctgatacatgtatttcattatgttgacatagtttcatagtttgttgaatggtttttatcatgaaaggatattggcttttgtcaaatgcttcttctgcatcaattaagatgatcatgtggtttttttccttcattctgtaaatgtgtattacattgattgattttcatatgttgaaccatccttgcattccaggaataaatcccacttggtcctggggcataatccttttaatatactgctgaatttgatttgctagtattttattgaggatttttgcatcagtgtttattaaaaatattggtctgtatttcataccattgtggtcagagaagttattttgtatgatatctatctttttaagatctattgaaatttaatttgtaaactaacatagtctatcttagaaattgtttcatgtgcacttaaggatgtgtaagctgttgctgttgggtagaatgttctgtatatgtctgttatatcttgtgggtttattgtgttgtttaactcttctgtttccttatttatcttttgtatgattattctatctattatagagagaggatattgaggtctctaactgttactgtattaatagaactgtctatttcttccttcaactctgtcagttttttgcttcatacattttgattatctgttgttaggtgtataaatgtttataatcattatatcttcttgctgtgttgaaccttctattaatatatgatgcccttgtctttgctcttctttgtctctttttaaattgtaaactctattttgtctgatattactatagctacccctactctgtttggttgctatttgcatggaatatcttttccatctttttactttcaatctatttgtgtctttggatctagagtgagtcttttgaagatagcatatagttggatcatatgtttttattcattctttcaatctgtgtcttttgactggagtcaaacccatttatacttaaagtaattactgatgaggaaggactggcttctgtcattttgctatgttttctatatgccttagagtttttgtcctgcatttcctacattagtgtcttttgtgtttagttcatattttagtgaaatgtttaaatttctcatttctttttgtatacagtctatagctattttccttgtggttaccatggcattacatttagcatattaaatttctaatttggattcatagcaccttaactttgataacatacacaaactctgcttctttatagctctgtccctacccttttcagttattaatgtcacaaaattaaatctaaactaataattcttttaagtgcattagtctcaaattatgtagaaaacaaaatgtggaattacaaaccaaatttacagtagtgctagttttgactaataactttttaaaaaagtattagtatcttaaatcatataggaaacaaaattgcagttacaaaccactgtggcaataatgctaacttttataattggccatgtatttgtttttattgagacctttatttcttcatacagcttctagttactgtctagtgtcctttatttcatcttgcaggactccctttagcatttcttacatggaaggtctagtgataacaaactccctcagcttttgtttatctgggaatgtcttagtttctccctcactcttgaaagacagttttgacagatataggattcttgtttgtttgttttaaattttattttagcacttggaatatattggcccactgtcatctggcctccaaagtgtctgatgaaaaactggcttgcaatctaatagaggatcctttgtatgtgacaaatttcttctctcttggtgctttcaagattccagagtcctcctggaggtggagtgtggagggcacatgtgggtgcacacagtgggccacccagacccctctcagcacaggggtttgctagcagctcacagctgagtctctttcccagggccatccctccttagggtcagcctccatcccaggacatggagccctgccccctacctcaactgggacaaccctctcccctgccctgccctccaacaaagggtactgccagaaagaacctccctatactggattgaatggtgtccaccaaaatcgatgagcttcccggaacttcggaatgtgaccttattaggaaataaggcctttgaagaaatacttagttaagatgttgtactgaagtgtatgggccctgatccaatccctggtgtccttatagggagacaagagacacacagccacagaggacaaggccatatgagatggaggcagagactggagagatgccgccacaagccaaggatgtgtggggccaccaggagctgggggaggtgaggaacagattctccagagagcctgtggagggaaccagcctaccaacaccttggtgctgggcttctggcctcagaactcagacagtgaatctgtgttgtttgaagcctcctagtttggtccttggttacagcagccccaggacactcagtccccagcagcccctgcagcaaatctcagtgtctctccccccatctgtttgcagaggccccatcaacgaacaaatgcagacaactcttcctggagttttgcattaaagacaagaagctgggggcacagcgagggggacatgaggtcaaggcgctgctgctttgttaggtaggggagattgagcatgtttgtatcctgatgggaatggacaagcagcaggagcatctgatggcacagcaaccagggggccaccccttaaggacaggtgggccggcttgccttggagcatgggtgcttgctcacaggctcggggcaaggcacagatgcgggaggcacagacgcggcagtgggagcagctgggtccatcttctcccagctctgggcacaggtgggaggcacagtgcgtgctttccctgcaggcttcctgtgcttcgccccgagccatctccccaggtctgagttcctctgctggtccaggagggtctcagtgcggtgggacaaactcgttccattggtggatggagacacacccagtgtggacagaggctgcaagcatcagagggcgtgtccatgcggcagtattggtgtcatggccataaggttggcacttcctacagactccggccttgcattttcagcagctggagctgttcacagcatccttctcacaggagttttgggagcacaaccaggtggggtatgcttgaaagccttagagtgaggaccagcacacccaccctcctggtgtcccatgcaaagctgctgaaggggctgctgtggctgaaatctgagctctgggtggtgcctgcaggagcccaagcagctccagagggagccccattccacttgaccccttttccttatggcagattcagcttccctggggtgaaatcgaggggcatttcccagttatctccaggagtatgaaatttccctcttgtttctgcccacctgaggggctgcacttggaccctgccatgggaagaggtctgttcctctctgcctcctgggggaccccctccttgtgtgagtcccctctgaagccctgcagaacctggtctgggtcctgaacagtcctgccgaggcctggcctgttggacacagatgctcaaaatctactcagagcatgctggcccctgtggagtggttcctgttcctggggggcttaagtgaatgagggcgagtgattcctttaaacattctttatgtgctgggcacagggctaggggctcaggaaccaggcgtgcgaaaccatgcatggtcatggcctcaaaggccgagctcaccatatgtggacacacatggacaagggggtcactgacctgggaaggctgtgaggggcactggtcagggcaggaaggccttcctagaggaagtgagtcaggtgagaagaagttaaggagcaccgttcctcttcttgggaccttgggcatgtctgtgtccccagctgtagcagaataaggtgccatctatggatgtggtgctgtgtggtctcatgtagccccatccacggcctgaccttcctgaaatccataaacgctgagctacagatgtcacatgtgtctaagatcactggacagaattagcatgcctcaatgaaaatgaactacgtccccaagtaatggcacgattgcagttaaacttatgcaacttcagaaataacggcagataaagggctagagacgtagaaaccgtggctggcatgagggaggagcttagtgagccatgggatgaaggaatgtggtgcctgcaggagcccgagtggccaggagccctgctcttcccaccgtgggactcctatggcctccccaccactccagcctctgcctggggctcctctagcccctctagttgggagaggtcatcccccaacagagacacaaagtatcaaaaagacaagcatgcttttgtttcctgtttccgtcaggtgtttctctgatccgtaagagcctcctgcccgttcatccatcaacagcctctggggacaccttcggcagcaggaatcactggtgttgggtactgagtttgaatttctgtgcccacctttgcgctggcacaaaggggctggctatgtggaagcagaatgtggggcccttgctttaaagacctcagaggctggttgaagggataaacctcacacccccaaaattgagagaaaacatcaagggagctgcaccgcagcaccaccttgctctctgggcttcagcaccagggaggcggacagctccattcactgtggccgccaccgcccatccaggactccagccctccccgcatcatcgctctgcttggctgtcgggggaggagagcggctgctgctgtgcatgggtgcttgggggcggtggggggtggggtgcagaggaggcaccaccctacccggggccatcaccaaccaatggggatgggagcgggtagataaatgccccagcctccccagcgtcggtggacagtttggaagtgcattcattctccatggcttcccagagggcccccagcaggcctgagcagcagctcttgtgaaactgccctccatgggctgctctctcttcctgtctcactgtgtgctccgtccctcacttcagcttcctggtctcacatcccaaacacactaccttcgtccaagtccttgtctccaccagggcttacatttggggtgcctagaaaaggagagagcatataatcaatgccagggtgagtggggggacacccagagccatgaggtcccaaggagggggcgatggcagggtggcccgtgaggcaggtggtctgggcccaatccccggctcaggatggacagaaggcaggagcagcctctgtgggggctggtgacagtgtgagctggcccagcagtgggtgggcttggctccaagggtgccacagggactgtgaagcaggctggagagggtggcgagcgggcctccagtgggaaaaccaggcatggcactgaggcgggcaggtaagttcagccctacactcctcctccttccggccggactctcacgtggatctctccttctggctgtgcaggttggatctatgaacacgagacacagaaacaccagctggaggagcccaggaggcccagcaggtgaggttatccacagaataggcacgccgccctagtccatggatcactgagtgcccagaccagggcttcagggggttccagccgaggctttgtgaaccggatcctgggtcactgagtaaccagactggtctcaggaggttccagctgaggctttgtgaaccagatcctgggtcactgagtgcccggaccaggggttcaggaggttccggccgaggctttatgaaccggatcctcctctttgcgtttcaaacagcgggaaccatcttagtccatgggccactgagtgcctggaccaggggttcaggaggttccggacgaggctttatgaaccggatcctcctctttgcatttcaaacagtgggaaccatcttagtccatgggccactgagtgcccggaccagggcttcagggggttccagccgaggctttgtgaaccagatcctgggtcattgagtgcccggaccaggggttcaggaggttctggccgaggctttatgaaccggatcctcctctttgcgtttcaaacagcgggaaccatcgtagtccatgggccactgagtgcccggaccagggccccggggcttcctgacagcaggaacaacaggaatcattcaaaccctggagcccagagggcaggacgggagcggccttttgtcccccgcgggcaggccagggaggtggacaggccgggagcctgaagcctgagcagctggaggctcgctcattctcccgtggtcactgtgttcccggagccccaacagagggccaattgtcccacggggcggtgcctggtgggtgtggtgtcttggcggcagccactgcctggctgttctcaggatcccaatcccaggtgaaggctgcagtcctcttgctgtgtgtggactatttagctccgtgggcggccaccttgccatggggccacagcagccattccagaggctcccccagtgccctcctcgcccgggggggggtgctcccgggtgtggtccggctgaggagtctcactcgcaggaaaggtggcgtgtgacgggctggagccggcctgcgaagtctgcctggtggccatggctcaggggcctgtgtctcccggacgcccccagcggggcctctcttgaagggactttgtgctcctgccaggagaaaacagccctaacagctgcctcctgggccatttccaaacattcgtgtgtcaggccagagagcgccagttcgttgcccttttgggtggttccaaacgtgtggagttggggccctggcagcttcggaccaccagccccccttcactgaggggttcgtcatcaccaagcctcagccagagatgttaaactggaaaaacaatcacggacccccgtgggggaagcagcttctggtctggggacagtcatgagctctgcatgcagctgccggtgtcccttctcggtgcctggcgggtatcagggctcacccttggcctggccacacctaccgcctctcaggcccacacctcttcccggaagacacctggaggcttcaacaccggctcacgccctttcctggaagaaacctggaggctctgacgccggcccacactccttcccgaagaaacctggaggcttggacgccggcccatacccatttttggacaccgggggcttcaatatctgtggcatcagctcctcagctctctcttccctcagcatcccactgacccgaaattccaggagatcccgagatgggccaaacacaaaacaagaaaacaacaaaaacaccctctccagaaagtagagaggaggctcggagtgaaggtgtgaagtgctgtgcccggcacaaagttcatccggacagagcggctccttcccatctgaagctcccattttcctacagaaatgagttccgacatgcactgcacagctgctctctctccgctttgcaaagcaggaactcatgatgtctgatgagaatccactctgctctggtctgagctggggcaaatcttcgtttgtcctccgcctgtccaacccagccctcgcctgcagggcatctcagagcccagcaccttccctgacgctctgctgagcccggagccacttggagctcaggaacagcagagggagggaggccacggggtctcagcacagaaccagcaagtccgaggctggacatctgagcagcgggtggttgacagggcccatgggcagaccccgcgggcagaggaccggggtctctgcctcacccgcttccaccgcccttgggtgcacctggccaaggccgtcagcaaaccgagccaggcctgtgtcctggttccctcatgggctcatggtcctcctgccaccctgcgagagcacccccgtgcacgctgcctgcagctcccagccgcgaacggcagaggcccagtcccgccgtcacaccctcgtcccgcctggctttcagcgacgtcacctttgcctggcaacattcaggcggggctgctcaggcctgctgattccatcatttaaagacgcccatttcttctaagccagggattttatgacgctgaggattagaagctgttatcccaaccaaccctggagcactctgttctgatttgatggtaagcttcactaataaactgtttaaaacatacgctaattgtgtttattgtattctttaattatcatatgtatcattaaggatgtgcttctcctggaatccgagggccttgcagcctctccccgccgtgtgtgcatgcgtgcacatgtctgtgtctccatgcgtgtctgtgtgtgtgtgtgtgtgtgttcctagtgcacagaacatttaccttttacaaattagaagaaacatctgtgggagcctgtggtcagttcggccttcatttaaagtgaggatttagacagtctctgagctttgccgcccctggaagcagaggcgggaaacgaccggataaaacagaacgatggggagtttcatcctgtcatttattttgagtctgactacagatcattatttctcattttggatttcagatggtttgaaatgcaagtctagctgctcaaccatggggctctagaaagaggtgcctggctatcactcaaggggttgtgggagcccaggacggtcggaggcgctaggagctctgggattgcctgtgaggccgcgcagagacaggagtttaagatgaatgaagcaccccaaccttgcgctctgggaatgcgccgtgtttaaggctcccctggtcctctcccgggtgccccggacccttcccaagggctgctctccctctcaccgagagcccccttgcctccgaccgcacccctgtggcacctggtcagctgcgttcacgtctgcaggtcggcctctatgggggggacccacacagcgtcctgcctcacttcagtagtgtttccattcagaccagatgtccagccaaggacgttctgctcccaggtaagacctgtgcacctgcctcatcaccgtgggccagtgcagggcctggcaggagctgagggtcctggcactgctcagggagggtcccggggccctgcagctcacgtggtccttaccagaatcaggccctggccctgcggactggccaaaaacagggcccaagccaagccgcgttcccgtgggtggacgtccacttattaagaaggcctgtgtccacaggaggcgtgattctgggcgtgtgtgcacacgtgtgtgcgtgtgcgtgaatctgacacagaacacctcagctgttctaacagcctgcagtgcgcaccggggtctttctggaggagacctgagctggcagagggctgtgcggctgtcctccctcccctgtcccagccgcatgtggagaaagaggggctgagggacgtgagggggtggtgctgtcggccggggtgagcccagctgtggctgcaccaggttcatgaccctgtctgtggcatccagagctcactctgattgccaagtgcaaacaccgggctgagtgaggcactgattcttaagggcagaaaaattcatgctgagtgctcagcaagggtgtacacagatgcgtctgggcccactgggtgaaggcacgcgggacccctgtgactccggggttgaccctgctgggcccaggaagcagcgagcaggaaaacaagcctcacctctgttggaagtgggcttcctggtgcgggggtccccactccccaccctgcagcccctcctcacgtctctgctcttccggctgccaccaggctcccggcacgcggcccttcttccttctgagttgtttttcaggggctgcgctggggtcccacggacacctcgccagaatcagctgggttcccatgggaaggggaagtgccgctcctgcgtccctgcacccttgccctctgtgtggtgtggcgtgtctatcccgactggcgaggccgcgagcccatagtttgctgctgctccttcaccgtccgtgctcattcctcagcctggtacagccccaaccccctcccacctttgtgtggttccaggcccatgcatgacacgcgtgttccatttccacgtgctaccggcaccagagcccattctgtacatgctcgtttttacaaccgctttttaaatcagcgaagagaggaaaggaggtgactctacgctcacagcctcttgtagccgcctttcccgggctctgtgcgcctgggctccagtcaccgtcggggccccgtgcctgacccctgggcagcgtcctcttccgtttcttacgaggtggctccatgctagggcagccgaatgccccagagaaatgggcaaaggtgtgcagaagttatccctgcccaacaggagggagcacggccccaggtttacctgctgtgccttccagggaaccccttgcaacctcagcctgcagggacccagggcgtgggttctggatttagacaggtatgggcctcctcgcatcagccgtgtagacttgggacacgcattcgtgtctggacgcagtttcctcacctccagacgggaatggctgcagttccgtgatcacagttcagcgaggatgaagcaacccctccaggggaagcctttccttacaggaccaggcaggtggaggctctgagcagaggctgccattgttcctcttgctgcaatgatgagcgtctccagcacctgggctgcagctgtggtgtaacaggtgcgatcagaacacctgcccagcaccgggctcaggctcagagcgtcctgagagtggaaggggtggggaggctggcggcggtggtggtgaggcgggagcacctgcaggctggggtctcaggcagcccccggagcttgctgggagagggtcccgagctggggacccagagctgacttgagctttgctgatgacagacatagctcatcagacagttgtcacccaggcacctgagaacatggtactactcagggaagggcacatgggcattagccagtctgtaaacataccgcaaactctatagaagtaattgaatagtaactatcatgtaattgcagggtaatcacatggttatttttgctttgcaaattaaagtgttactatgagattgaacaattatgcggggtaattataccctgattcacatgctaactccaagcaaaatcatcaggtaaaccctagggtgggtagttactgtataaatatggagtcgttgtgaccacatcattatacattagtgggagagtagctggcctcctttgggataagcctcccactgcacctgaccctgacttccctactgagcacggctagaccccgagagcaacaccggaagcccagaggcagggcgccccgagacctcgcaccaggggacctgcttgatggggcccgtttttgagcatgaagcacattctgagaaagttgttcttttcctgacacgctggggtttcggcagggctggctgccagcacattagggtgagaactggctgcagagactgcctctgtcacaacctggcctgcaggctgggccacctgcaccacacctgtgccccaggctgttcaactcacttgtgacttcggcctcacggcaaccccacaggtaaccccaagagcgggaggcacctgtgtgtcagtcacgccacccccaggcctggaaaagtaccagcacctgtcaggcaggcctgcgtcctcccggaacttagtcactcacacatatgctgcgatgagccacacccacccaagatgccatctctgtccctgggtgcaggtgaccagacagaggctggggagatcgtccctgggtgcaggttaccagacagaggctggggagattgtccctgggtgcgggcgaccagacggaggctggggagatcgtccctgggtgcgggcgaccagacggaggctggggagatcgtccctgggtgcgggcgaccagacggaggctggggagatttacccaaagcccccgttgttatgcggtgcaacactcagctcccagtgtgccctcaggaccgcgggccaggctctcagccgtgcgctgctggcatctgggaccgagggtcttggtgggggctgctctgactgtggcagcgtggcagcttccccggcctcacccatgggatggcggtagcatcctctccctattatacgtttaattataacaattaaaaatatctccagacactgtcaaatgtcccccggggacaaacattgactggtgatctggcttttacaggaaaaggttgcccacgctgggtcatgactggagtattggctcaaaccaagtagcttcaggaaattgaaaaaggggattgtgagtgactcagggaattgataagttaaactatttccaatatacactgggtgctataaattcattatatgtattaaacgccaagaccaggagtgctctgtaagccatcagtgagctgccaaggtggcgggagccacatctgggagccctcagtcacatgttctgcttgggaagtgcctggggttgagggggctgcacacagtaggctctcaggcacacagtaggtgctcaggcatgtagtagatgctcatgccaggccactgagactcataggccctgtcatcagctgagcatgtttcttagacgaaagacctggccgctccccctgcctcgcttttttttttttttttttttttgagatgaagtctcactctgtcactcaggctggagtgcggtggcacgatctctgctcactgcatcctccgcttcctgggttcaagcaactctcctgcctcagcctcctgagtagctgggactgcaggagcatgccaccagcacgcctggctaattttttatatttttagtagagacgtggcttcacagtgttagccaggatggtctcgatctcctgaccttgtgatccgcccaccttggcctcccagggtgctgggattacaggcgtgagccactgcgccaggaccccaaggtgctgggattacaggcgtgagccactgcgcctggcccccaagatgcttttacatttccactggacccttgcgggaggcgttggctgggccgccctccaggacactttgttccctctgctcagggcattctcaaggcctcagcgacactcgggccagccttcccttccccaggacacctgcccgttcccatccctggatgtcccaggccccaggaacccctgtgccagccatcctggcagcccacctgcccacctgacaccctccccacaccagcctgggatccacggaaaggcgcggatgtgtcacccttgggagccaaggctgcactgacaccagggcctgttgtgacctcagtttaagggcagcaaagctgtgagccaggtgaggcttcttggccagctggaggctctcctgggacacggtggggagttattggggagggcccagcatccccttgaaatagagtgttgggacctgaagcaagagtcaaggataccggccgtcctggctgatggccctgaggctggtctgagtgctgccctgaggggctggatgatccctgcagcctcctcccctctcggggcctccgttaggagagggccaggaaggtccttccagcctcggcatccgtgtctgcctgtggacagaggcaggcctcgcccctggcccgccttccttgtaaccttgaccccacgagagacgctgggtcggggcgttggtggatggtgccctgccctgcatcgccccagggcgttggtgccctgccctgcatcaccagcagcagcactctccttgattaagcagcaaggcaaggtgggtgctgactcggagtcactcacagaccggaaggcgaattgcagagccgcaccctgtaatttagtcaaaatgaaaagggcaggaaggaaaggtcaatactgttttaaattagtctaactgctcctttatgtagaggacactgttgctccaaaggactggcgatttagcagttggggagaaaaggtcaagcttcttggtcctagggcaggtgataaaagccagttaaatttttggaaatcatacctgcaggttgtcaattctggcaaattctgtacaaattagtctactcaaaggcttgaagagaaggcgttgcaaacctcactggcaagccaggtggactggggtgggatcacccatacaggcatggggaggggaaggcctggggctggggtgggggagacggtcaggccctggcccgctccatccagtttcctgcagaccggatcccaggccctcctcacagagcaccccacagaagggctgccccgcagggaggcgctgcagagggcaccccaggtgtccccttgcacttggggtgtgcaaatctgatccttgtctgcatgagcggacagagacggtgccggaacgaccctgttcaatgtgtagcaccaactcccggccacccacaccagacaccctcacccccagtctggggtttctggagaaggggaccaggggcggctcccttctccccgcaggcttgcagggctgctcctgacctgtgctgcagctcctggctcctgtggggcccaggttcccggggctgcgtgggagacacagaagtgggggcacctctgcagcacccacatcctgccgacgccatgcacgtgagtgtgcatgtggggtgggggtgcgccaggaaggcaaaaatcccaaatgtcagcgcccggtgatttgaggagttcagacaaagccttccctggggctgtcctcggcccacttccccatcatcccaatgtccctgcagcccttgaaatggctcggatgtggggcaggagggctgggcggatgctgatctgaggccgaggttgatggattccggctcccccagtgccgatccggctgctgccccacgtggggctttgaggctgcggcaacagagccggtgggacacgctcctgatgccagacccaggggtaagagctgcccctgctccacggtctgcgccacgatggctgccagagcgaaaatgggagggagagaagcgctgtcagggcctcccagggagggtgtgtggcgtgtggcttgctaagcaccctcttttctgatcccgccctgagcagctccctgggacttttgttggtcaaagcttcagctgtggtcagaggatccaacgctgccgtcaacaggcagctgctgccgtatggctgcagatgtggtttctggaacagacgggcccagccctgcaaggtgggctggctctttggctctcgagagcaccatggcacagtgctgatctgggtccacacggcccagccacccggtcagctcgcctggttcttacatttccactccacaaacagaacccagacccagatctgcttcctccgcctcccgccctcctcgccccgcaccgtttcttgtcccacagaagctgtcatgggtgctgtgtaccccacagggcgggagagaaaggtgtgtccaggagcaatctcgggaaacagggggcagaggatgcggtgcagagccgagctccggagccaccttcctgaccgccagagcctgactgcatccgtatggcatgaggtcggtatctaggaggccatactctttacctaacatccaggacacaggaaaaggacggaaacagaaaaaaatacataaataaattcaagatgcattttaaagaacatgaaaaactttaaaaggacgggtaattgtctaacattttgttaattcaatcaggcttgcaatttaaaaatagctttgccttttactgaaaaagaaattaattataatttcttactgaatccagggagagaattcgggactagggggttccctgagaaggtcttcttacacgttaccctccaatgtcctgtggccaagggagcttcaaccccctctttacgagggttctggtggctggagaactcagagacggctctaaaaaaattgcaagctggccaggcacggtggctcacccccgtattcccagcactttaggaggctgaggcaggcagatcacctgaggtcaggagtttgagaccatcctggccaacacggtgaatccccgtctctactaaaaatacaaaaattagctggacgtggtggcgcacgcctgtaatcccagctactcagggggctgaggcaggagaatcacttgaacttgggaggtggaggtcgcagtgagccaagatggtgccattgcaccccagcctgggcgacagagcaagacttcatctcaaaaaaataaaaaaatgtaaacatcgcaagctgcacccaggtgtgaatctggagggcgcctccttggaaaacttggctggtgaccgcaccctcagttcaagctcaccggccgcccttccctgtgcacacacgtgagctctccagtatgtttggaatatcccagagccgctgtctcctggctgcccggcctctgtgagccgcactccagcctgaaggccaagacggctgctctggagaaagaacttcccctggtgctgaagtcccgaaggagagccccatgggcatggggaggggagggtgcctcgcccccaaggctgcgctgctccgcggcctggccgggaccaccacacagaggcttctctaggaaacaagccacactcagtgtggcagcagtgaagtgcttttctcagcttcctgctttcctccagagagtaaaccagtgcctgaccgtccggttctccctgaatcaacactcaccgaaaggagctggtggaggggcccgtgggcgacaaacagccacaaaccagaccccggggtctccggagctgggggctctgggtggcccaggggtcgttaatgggcacggtttccagtccagtccaggccagctgtggtggggctcagacccgtccagacactgggagccagtcacccccagaataacgagctgggcctcgagttccaagtcatctttgagcagccgtgtgtcagcaccgctgtccctgaccaccccgtgccggtctgcctccgtctcctccttctcgctgtaccccaggtcgggagctaaagggcaattcagagcctgctgcctgcaggcaaaacgtctccccagcaccgcaagtctgcgcaatttgaggcccagaaaccccctggacgtagcttctgcttttcaaaaactgttcattcgtttagccccaggggacctcatccctgtatgtccacactgggcatcccaaggaagctgggggggaaccgcacctgcatccctccaactcagaaacccccttctgcaccggcagctccgggcccgcactaagtgtgcagcgtggccatcctgcggctgagacacagggtgtccggcagcgtttggatggattctacaatatttgggacagacttacactaaaaaatcagtcactgcttctccaaacttcctgttgagctgggcaccctgtgtttttgtttgctgcgtttttgtttgttgtatctgggtaccctaagaatgatcccaaattacaaagtcaggccctgcagactcatgggaggcagaatgggggcccctaaacatgcccacctcccggtgcacggaaactgtggacacatgaggctgccagtcagccgcctgacacggaggggtgaccctggattatccggggggacccagtagaatctcgggcccttcaacatagaggcggagggcagagcaggtctcagtgacgagacaccactggctctgaagacggaggatgggactgagggccgaggggttctcccctggagcctctagaaggaaccagccctcccaagacctgatgttagcccagggagaccatttcagacgtctaacctgcagaaatggaaagtgtaagtgttcttttttaaaaaattgtcatgagtacatacagggtgttgctatttatggggtccatgagatattttgatacaggcatccaatgtgtaataatcacaacaggggaaacggggtgaagccgctatgtttgtgataattttttagagcagccataaaaatatatgtaaataggacctagttagataacatatatttttggcttctgctctgtagaaactcacacatgatttggggagttgtgaaggcctgatttgattttgtttgtttgtttgcttgcttgcttgcttttgagcctggtgtgccgggcgggcaggtgtttcattgaacctggccccttgcttgttcaagtgttgagtgagggcagtctccaggttccgggagcttccgagtgagcctcacgcctcacggctgcaggtcagaaagtgatttgtggcccagagacccccggacgtagcttctgcttttcagaatctgttcattcatttagccccaggggacctcatccctgaatgtccacaccgggcatcagacctggttgcagagtgggtggttccaggaggcagcagtgtagaccagtgaaggagcagccagggcctgagtgaagctggggcagcagaagcagctttcgatattttttttctgctgagtcttgccagcttttagtttagaagttccttcctggggaagaaagtggccgcttaaatggcataaaaaataatgcaccaggcaggggacccttgagaccctggggctgggctctggctgggggcctcacacggaggaggagggatgagactctcaaggaggccaaggtcccaggtcctgggctatcggaggctccttggggcctctgccttccccaggagcaagcaaggaaggaatgtacagcagcagggcgtgggcacagggcagccccaggaacaatggggatagtcacgtggccccagcctccacctcgctggcactcctcttgtcccaggacaagcccagcctgctgcccgctgcctgcttctcctgcattggagggctccaggcccagaatagctgctcggagccagcatttgcatccacgtctcctccacacgttagaaaacctggactttgttttgtaactgctggttccgctcagcaaatagaattgtacctaactgtggaggggccctacacagtggcccggcccgggagacccacgagggcctcaggagcatggcttctcccgtctgcctcctggtttctgtctctgaccatgtatctccaagccagtcagtcctgagtggccacagtggggatggggctgcaccaggggcctgccctgctgtgctggcctctgccagggctgggccctgcctgtgaaggagccctgggttgggctcttttgtgcccactctcaggtggggttgcgggaggcctgcttggccccatggggatcagtgtgatgagcatgactggaggatgtgcgggcttaggatgagcagagggaccctacagagccacgaccccaggcccagggcccctgttggccccaaagcgagtgtggtggccgtcgttgggaccccaacagggggtggcactggcgtgaggtctgacacttgccaaattcctgcgagctgacccctcgatggggcttgcactctaattctgccccagggaagcccaaggtcaggattagcatcccccctgcttaagggacagctgaggccagggtggggctggggtggaatggcgggctgcatgcaggaagcccatggagcccagatctgctccaggtcacaaccctgtacctggcttggggtccacactccccagacacagatggtggcatgttcccctcggactgtccacctgttgttcggccaagccctgaccctcacagcaggctgctgagttcaaggatgcccctgggcagccaggctgggacccttgcccactccctggacgcacatccgcccgccgctgggttcacaggggagggattagaaacctctcaacggaacgtcgacgaggcgagtggggtggggatgggggtgggaaggggacaggccctcccccacacgtggggagatgcatggctgtgaggtgctgcctccgcctctgaggctggcgataggctggattcagacacagctcgagccgctcaccctccacgtcctgcttaggaggagtgcggggccggctaaatccccaatgcccagggcccaggggcatcccatccatagcctcaaggtccctggcttcccctggggatggggctgtcgcacctgtgtcctcccagttccgaggtaccattgatacacacacaggggtccctgggggagtttcctaactcctcttcctctgaaggccaggcctgggagaatgaattctccaagcacccaccctcactgtaccacggcaggttagagaatgcggacagagctgcttggctgcacaccttgggggggcgtcaccctctttttagcctcagtttccccatctgtgcagtgggtaccagagaggactttacacagaggctgtgcattcccttttttttaattttttttttttgagtcagagtctcgctctgtcgcccaagttggagtgcagtggcgcgatctcggctcactacaacctccgcctcctgggttccagcgattctcctgcctcagcctcctgagtagctgggattacaggcgcacatcaccatgcccggctaattttttgtatttttagtagagacagggtttccccatgttggccaggctggtctcgaactcctgacttcatgatccacctgccttggcctcccagagtgctgggattacaggcatgagcgaccgtgccctgactgaggctgtgcattccctaacagagggggacgtctggctgcccccacaaaacagcagctctgagcatgtctaaggtcagcccctccctgctttccttttctccctgatcaaattcatgtggcttccactcagccccttcttccggctcttacttaggaatgcagatctaccccaaaccccaacacacactggaaccctcaaggtcccatcctactgaaagccaggtagccggtgcagtgagcaatggacagatggatggatgatggatggtggatggatgatgggtagatggaggaatgcatgatggatgaatgaatgaatagattaatggatgaattgagtagatagatgaattgatggatggatgatggatggataaatgaatggatgatggatgaatagattaatagatgaatgaatgagtggatggatggatagatgggtgaatgcatggatggatcatggatgatggatggatgacagatgcatggaaggatagatgaatgaaagaatgggtgaatggattaatagatgaatgaatgagtgggtggatggatagatgggtgaatgcatggatggaacatggatgatggatggatgacagatgcatggaaggatagatgaatgaaagaatgggtgaatggattaatagatgaatgaatgagtgggtggatggatagatgggtgaatgcatggatggatcatggatgatggatggatgacagatgcatggaaggatagatgaatgaatgaatgggtgaatgaattaatggatggatgaatggatgacaggctctccatgagccgctctgctctcctccatggcctcctgctcactggcccctatatctcacatcctacttccagtttaatggagacaagagtgtcctccccaacccaagttctcacccccatcccttcctccctcagacccacctggaagagctgcttctcttctcttgtagaagtctcccatcccaaggaggtgcctggtctttcccctcaggaaggcacctggtccttcttcctcccttccctcctgggagacatctggcccttcacctccccctgccccttcacctcctatcaaggcagctccctcagtattttctgcagaccttgtttgtctcctgtgacgttcataccctcccgttcccacagacattcttccatgtccagcccagacagaaggaggtccccccctgccggatggatgattgaggctgcctgtgtgtacacgtatgactgagcaatggacggaggtgtctgtgtgcagcaggcatgtggcacgacctcggaagagggaacaagacaagatgtcccccaaggtgcccatgaggaccctccctgggcagctggactccagcccaccttgggctgcagtgtgcattgggggtggggccaaagacccctccacatagagaaggcagccaaagggaggagggagtggtcagaaaaggttgtctcagccagggagcggctccaccctctcctgaggacgcctgacctcagacgtcagctcccgttagagacccccgtataccccctgcctagagccaaactctgagagtctctggatggactgaggggtgggacaaggaaaaaaaggaaggagggagggagagaagcagcaaggaggggtcgcctggcccggctcccccagtgaggaaaggggctgtggcacagagattccatctgcagggctgggggcagccgagaatggcacctccaacgcccacggcaggggcccacccgcctgcctcctccgggaccaccgggcctggctcctctcacagactctttgagagcgtatttgtgaaacgtagcatattgtgggtgattagatttaaatttcaatacactttgttaaaaatagagttggctctcgccaagaggaggccgcaggaaggggctctcaacggctcgtctttggaatattaatagtatggaaatgttattagaataatttttcatcatgaataataaattaatggaataattcggcagcgccacgtgacataccctgctaagaggggctttgttttaacagaatggggagggtgggtttggggtgtgggggagggcagagctgggggagggtccgcccagggcaggcggggttgggtggaagtgagtgaggtgcctgaagagatgaaggctccggaggcatttggggaggaggacagagacctgggaccaagtcctcaggcacttttagcttcatgtctcagccagggttctggccctggccggctccttcccacagaaaagctgggaagagatcttggtaggtgtccggccccacacaccatcctgctgggggtggctgggttggacttcaccatccccacagccctgcagcctcccctcctgcatctttctccttggtaaatgccaggaacctcaaaagcacccagaggcccagagaaattgagcacacaggggtggggaattcaagagcaggagctgtttctagggccccaggggcagggccagggtctcctggtcatttctgtgctcgggacccctgctgcacctgagctcactgtggaaactgcctgagggggccacacggagctgatggggacaagcatgcagggtgggcacccttgtgggctcagcttggtccagggtgtccactgggggacggggagggagatggagcaccagggaagaagcgtctcttcatgtggtcagcgccccctccttctccccactccctccttttgcctcccttcctgctgctgcctgcacggtgagaacagagatgagatggcccctgcccgggagcagtcagcggcaccacaaccctcccaggccaacccagctcctgacagagagggagggaggcagcctggggctgggggccctggcagcagtggcacacggagtgtgcacatggatcctagtcagccttttgcagggcgctgaagccagtgggggcccccagggaggttttgggggagtgttgagggggcctgaagggttccgctcctcccacccagggaaccgccatgccactagtgggctgtcctggagactcggggagaaagcacacaggctgtcgggaaaggtgggtcgcaggcgggcagggcagccctgctgtactgatgggcaggcgctgggtgggtggaaggcaaagccatcaggtcatccccctctctgtccctgcattgggccaaccaggtgtgtcaggaggatatttgaccattcctgagaggcacattctctctctctctctctctctccctctctctctctccctctctctctccctctctccctctctctccctctctctccctctctctccctctccctctctctctccctctccctctctcccccctccctctccctccctctccccctctccctctccctctctccccctccctctctctccctctctctccctctctctccccctctctctccctcctctctctgtcacacacatttgcacatcctgcagtgtgaatggagtatgaatgtgtgtggtaggcgacagctgtgtgtgtacgtccgggtgcgtgtgtgcgtgtgtacatgtgagcgtgtgtgcacgtgagttagagcctgagtgtcccctgcgtgggttagtgtgtgcgcccgcccggtgccctccgtcttgggagtctgggctgctgctccgcgggctctggagccggcgctccccacgagcccggactctccgccgcgcccgggagctgcgcaatcggctgctaagacgccggcgccaccggctgggccctgttctcccctctcttttctacagtcttacccgcagctgacagggttcgaaagagcatgaaacggaggagacgttacagcaacgtgtcagctgaaatgatgggcgtagacgcacgtcagcggcggaaatggtttctatcaaaatgaaagtgtttagagattttcctcaagtttcaaatgaggcgaatcccgttttccgcgatgctgcagcgcgcgggttttaaccgcagggtcacgcggaacgccgcgccgcgcgactgtgcctcggtctctgcgcccggctctccctccggtccgcaagaggaggaaggcccgcggcgtgccgaggtcagcggcgcggagccaccaggcgagacggtcacggacgcctgaaccgaggtcaccgaggccacggggccgggaggccctcagcagagcccgggggctccgcacctcaaggccggccaggaagaaacagcagcaggagcccagggcgccccggggagcccccgacacgcgggccgagcgcccagagcggcccaggccctcgcgaggagaccggcctccccagggcggggcttccgactcgggcgcccgtgagccccggaggcggcgcgaaggggcagagtccgcgtttctaaccagcccccgggtgggcggtggcccgcgcggcacggtgggcgcgagcgccgtgggctggggccggcctgggctttcagggcgagggctttccgcgccggccccagcccacccggccccgctgcgcgcccctcacgctgcagcctgggaacctgggccgggagctgcgggccgctccggggaagcgggcctgacctcccctccccaccgccgcccctgcggtgagatcctgcctgccggggcgcaggggcccgcggttgggctccgggagacggaagaggccccacagctcgggccccacgcagtggacgctgccacttaattttggcgtaattgatgtcaaggcgggtgcccgggcccccagtgaaatgcctcatgaactcgctgcgaggaacggcgctccacgcggtgcacggtggccaatcagagctgccgcttctgatggaggctgagccggctggggaggcgtcttggccaagaaccagccccagcctcgctcagggccccaacccgcagaccatgtaattaagctgcgttctgcagccagggcaaggtgcggaggggcctgtttctagcattggggaggaggaagtggggaggagggagcggggaggaaggagtggggaggagggagcggggaggaaggaggagtggggaggagggagcggggaggagggagcggggaggaaggagtggggaggagggagcggggaggaaggaggagtggggaggagggagcggggaggaaggaggaaggagcggggagcagaggagcagagcgggagggaggatcgtcgtgcagggggcctttgtggatgaggctgggatgtccctgcccctccgttccctccagagtctcagctctgaacatcttcccgcacctctgaggagccaggcctggaaaccctctaaaatagatttttctgcctcaagacagaagatgggcgttccaggcagagaagagctgcccagtcacgtgctctgctccacctggtcagagacccttgacctttagaagactggacctgagggcgtggctggtggacctgagggcgtggatggtggacctggccacccagctgtagctttttgggttcctgtggtcccatttcttgggtcaatctcacacctggcagctcccaggaagacacccccaggcccctcacactcctgggggcagctggaattggcttcagggcgggaccaggggccccatgggtgtttggaatccctgatctgggtcaggcaccggcagcaggattccagcctggcctggactctggtgtgtcccgtttgaagaaaccccgccctgtgaaagttcaagtttagcatccaatgacccatttaagaggtttgctgagccacgtcacaggagggtctgggtgcaaacggaggtggcaacacacagagcgagccttgagcacccaggttacccccaggacctccagtctggcttgggggctcctgctgtcctgtggagcagccccctgggatcagggacggggctgagctggagagtgtgcaggattgattaatgatgtctgccacggtcaggccaactgctgtgtttctggggcccacaagctaaaaatggttggaaaaaaatcaaaacattaatatttgtgacatatgagaatgctatgaaagtcaactttgctatccataaataaagttttattgacatagccatgctcactctttctcatattgtccatggctgctcgtgtgtccaggcacataccaggaggctacagacggagctggattctttccggccctttgctggaggcattgctgacccctgctctgaggctccccatggctctcaggatccagaccccaggcttcccaggacattgggggccaatggctccctgagtgccctcctccccagctcttctcccacccctgcccccccaggagccctcaccatgtgccactcactgcccacgcaatctgacctgtgaagggcagacagaggagcaagcctgcctgaaaaggaggactctgactttgccactccgctgccctgcctggccccactgtggtgttaccaggaaaggccatggcagagggacatgcccacgagctgccctgggggagagcggctggggcagggagggcagcactgccctcagaaagccccgcggtggtgcccctacctcccctgggttccaggagtgtggacagaccctgctgggagcagatggcacttctgcagctgaggcctgctggacgctgggccatgccggggacttgagcctggggccacacgctcctcctggccgatgtcaccactcctcttccaacagtcttggccccggggtgggcctgctccccgcccactctctgtgtggacggatcattgctgccgccctctgttcctccctcccaggactcagaagaggggcctggtgtgaacaggaggcaaccgctgacccctggcctgtgcccacgcagaggccacctcccagtctggtctctctgggccagcccctggagtgtgcaaaattgaaaaatagaaattcctgggaagtgctgactctcctgcagtgctcagaggttcgccaggcctgtgcctgtcttggccgggcccacggctctcaatgtggtggccgccatcccgccagccttggccgctcggggactgtgggctgtgtgcctctgatgttgcatgggagctcagatcccccatctgtggactgaggcctctcagcctggtggccgctagacccaaataacacgtggacccggcccggccgggtcagaccccatcgaacacttgggggttcctgtcaatcacaggccctatgccttgcccggtgcctcaacgcccacggggtcagcctgttccacttcctgacaccctcctctgcactgggccagcctggcaaccccacctccgccacaacataaccccggatctgccccacccccaccctcccacagaacgccactgcgctcccgcccaagtcagtgtttcaggaggagcacagcagaaggtgcaggaagccgagtctggccaacaccctccagaaactcattcctgcatccccctgggagacctggactgggacatgggcacagggaggacctctatgctctggggcgtgggggtgggtagagtcaggaggggatgtggcaggaaacatgcccagccgctctccgaatctgcaggaggcacctgccatgcagctcggacctccctgggcttccgggcttggtgaccacaaggctgggctgagggtgggggcagctggcccagtaggggcggcgcaggtgacccagaacaggggctgtgggaggttaagggcttgctggagccaggctccggggctcctggaggaggggagaccacaggaagacctggtcctggagggtcctggccccgtgggcactccgtctttcttcctaaggaacaaccacacctctcctgcagcccgagcttttcttagagaccaaggaggccgaacaagaagcatattttccacataacctttgctttcccatgggaagggacgatggcctgcacttgctggcagttttggaggcatgcccagaagtttgtgtatctgtggatgctgggccaggcatgggcgggaccgtgttgggaggggcctcgttgctggtgtcgagggaatgagctcctcacaggcctctggacagtggccccagggcgcccagccccttcttatcctaatcgagatccctagaggacaccctgtgtcccctgagttctccagggctgaggctatctctgccccatgtctcaagcctcaagaggctcccctctttcttacccgaagaaactgtggttggcaggacaacaacagtcccccaaacgtgtccacgccccaatcccaggaccccgtgaccctgtccccaagtggtacaggaactctgcagatgggactgagttaaagaccccgtgactctgcccccacgtggcacagggaccctgcaggtgggactgagttaaggatcttgagccaggaggtcatccctgtataattctattctatgccataatctctttacatataaaataaacctaattgtatgtaatctgtatttatatattttatttatgttccttcctccttataggagcgaggcaggaagtgaggccatgggagcagaggtcagcgagctgcagtgtgaggatggaggaggggccacaagccaagggatgcgggcggctccagagggtggggtggcaggaagcaggttctctacgggaggctctggaaggagccagccctgcagacagcaagattttagcccagtgagacccgctctgacctccaggacaggaagacgacacgtcgtactgttttaagggctcattttgtggtttgtggaggcagccactggttctgacaccaatcgaccctgattcctccagtgagtccaagagcacagaacagactcccactctggctgaggacacggtgagggaactgtggtgaccccagttccgttcatgtggctgtcactccaggaggatggctctagagcagggaggggccaaagaaggcgaaagcagacaacgggtagcccatgctgggaggggttgcatgtgtggcagccacctctgagcgggggacacctgagctgggacctgtgcggtcatctgggagctgaggactccaaagaccatgtcaggttgaagccatccagcaggagtgacctcagacccagaaggcagcagtgaggctggactggggacagctggagagatggagacacaggggccagcagtgatggggacaggatgctgtgtgagacatccctggtgatgcctggcaaggtttccagcaggggatgggtagggtttgctttgtgctttcagagaagctctccagtggctggaagggtaggggtagcccagcttcagtgccaggtgctggggtcagacaatgcggctccctccactccaggtggggaagggttaccccatggaccctcctcgattctctggcccagaagggtcatgtcaggaggatgggcgtgggagctgcatctccctggagtccctactttcctctttctcagactgatactctccaggggagcagagctgctggtggctcattaattgtgatcaactgtgaaccctgagggaattgttttacttgagggaaggtggggcagagaactgaggagggagggaggcttctggtgagaaccccatttcccagatgacccctgacagcacccctgaccccaggacatggagaccactgcccacaaagggagcctccctgcagctggaggggctgctccctgctccggtcccctcaggttggactgaggctcggcttcaaaagggcccttgggcgggagccaccttccaggcagtcacccccgcccccaatggtgggacccagagggcaagaaatagacacgtctctttccctggattgcagggacctctagccaagcaactccactcatttcagcataattccttattcataatgtgtgagtgaggtggcaagggccataaaatcagccaataatacaaaatcttgtagtcttgttttgcagttctttcccagggctatagcccgaatgtttatgtgtcccccaaattcctatgttgaaattagaacacccaaggcaatggtattcagaggtgcggcctttaggaggggactaggccatgggggtggggccctcctgaatgggattagtgcccttcgaaaaggaaccccagactgacctctcacctcctgcactatgtggggacacacagaggaggcaccatggatgaaccaggaagctggccctcaccagacacaggacctgccggcgccttgatcttgaacttccagccatatatatgtatatcgtctatattcggcaccattcccaccagcaaggcgcaagagttctaactgctctgcagcctcaccaacacgtgttattttccatgacctttattatgaccatcctagtggatttgaagttgtatttctttgtaattttgatctccattttcctaatgactaaagatgttgaacatcttctcacaggcttattggccatttgtatatcttctttggagaaaggtctattcaagtcctttgctcatttatagttgggttgtctgtctttttgttgttgagttataagaattatttaaacattctagacctgagtctcttatcaaatatgtgattgacaaatattttctccaattctatagattgtctttttactttcttgataataccccttgatgcacaaaagtttttaattttgatgaaactgaattttttttcttgtcttgttcgtgcttttggtgtcttatctaagagttcattaccacatccaaggtcataaagatttacctctaacattttactctgagttttatagttttagctcttacattaagatatttgacacattttgagtttatttttgtatattgtgtgaggtaaatgatttttttttgcttgtgaatatatagttgtctcagcaccatttgttgaggagattattctttctctattgaattgtcttggcacatttgttgaaaatcagttggccatagatatataggctttctctgaaatagattctatgctattggtctatatgtctatcttgatgaccgcatcatactattttgactactgtggctttgttctaagttttgaaattagaaaatatcagtcctccatttttttctcctctttcaagattgttttggccacttgaatctccttgaaatttcatataaatttgaggattgggttttcattttctgcaaatgatccttggaattttgatagaggttgcattgagtctgtagatcattacggataatattgccatcttaatattaaggcccccaatccatgaacatgagatatctttccacttcattcctaggtattttattcttttgggtgagattataaatgaaattgcttcctaccttcttttcaggttgttcatggatggtgtatagaaacacaactgatttgtgtgtgctgatcttgcaccctgcaaatttgttgaattcattcatttgctctaaagggttttttttttttttgtaaatattttggagatttctgtatataggataatgtcatctgcaaatagagatttttttttcttttttccccagtttgaatgccttttatttctttttcttgcctcatttttctggctagaacttctagtatgatgttgaatattagtggtgaaagtgggcatccttgccttgttcctggtcttggcggaaagctttcagtctttcaccactggatataatgttagatgtgggttttccataaatgccctttatcattgtattaggccattcttgcattgccataaagaaatgcctgagactgggtaatttataaagaaaaggcgtttaattggctcatggttttgcaggctgtataggaagtgtggtgctggcatctgctcagcttctgaggaggcctcgggaagcttcgaatcacggcagaagatgaaggaggagcaggcaggtcacatgataaaagcaggaacaagagggggtggggagatgccgcacttttaaacaactagatctcacgagaactcactcaccatctcgaggacagcaccaagccatgagagatccaccctcacaactcaaacacctcccaccaggccccaccttcaacactggggatcacagttcaacaggagatttgggcagggatatatattcaaaccagatcaatcgtattgaggaaatgcccttgtattcctagttttccaagtattttgtcatgtaagggtgttggagttttcaaatgctttttctgcctcagttgagatgaccatatggatttctcaactttgttttattaatgtggcctattttggtgcttgagttttatacgtggaatcgtccttgcattcctgggataaatcaaacttagtcaggatgtataatctttctcatatgctcctgggagggtgtggaggctcagttccccactaggccctgctgaccccatcccataagagattgggtcaccacctatttccaccatgcaggggataaatgatccactctctgctcagccggtcgacaccactgagtgaggacatcagagaactgccacctgcctctgcagggtgggggtgaggtggagtggcctctctgaaaccacattggtgtctggctagagtagggatgacaatgcctaaagggggctctgttgtttgaccaccctctcctcatgctttggctgggaggaaagctccaggcttctcctggagagttttactctgtcagtgatgactgcaggttgaaggccactgcagtgtcctgtctatgatgtgtgggaggcaataaggaaacccagggcactcagcaccacgtcatcctgagtctggaggctcccaggcggtggccttctaggctccttggttgtgttatgtgcaggacttttgggttttagtgggaagatccaggaagattgggccgctccattttggtggaaacagaagtctccaattcacccccttttgagtatcctttgaggttttgatgggaacgtgatgacttcagaggcaaatctgaggagtgctggcacctgcatgctgcatgtcttcctacatccacggcacacatgtccacatgaccaggccatcctcagtggccttcacaaagatcacatgtgtccttgatgggcgactcttcatatctttcttccccattgcaaagggaattacttttaattgttctttattatttttatagggatgataatgatttttgtacatgaagcctatactttgctgattagttctcatagtttagctgcatatttctctgagcttctgtgcaattatattctatacgagaaaggactatttgtctctccctcaattcctagtccttgtcttttttgttttgtcttgtgatattggctaggacctctaatacaaactaaatataagtgtgataatgggcctttttgacttgtgcaataatatttccaaagttctattattaaatgttatgatgtttgctgtatttttttttgccttgtatccctagcttgctgagaatttatctgattaacgctgcaatttgtggactgcattttcttgcctctgttgaggtgatcacatggctgttctccttccagtggttcatgtggtttaaaacaaagtgtttctgagattgagccagctttgcattcctcttcatgacatactgttttatatatggatggacttgattttctagtgtttctttagtccttgtcctgttttgatatcaatattatactagacttacacattacttgggtagtttccttacatgaaaaacttttaaagacagatatttactattcctagaaagtttggtgaaacttgcctataaaacctggatccagaggtgtgcgtgtgtgagatagagggagagaggttcagttaccattttgatttgttcagtggtaactgatttgttcacttcttttgtatttttgagtcaattttaccatagtttttgtaaaattatttattttatcagtattttccaatttactaacataaagtgcttggtgtgatttacagtttttaaaatctgtactgtgtctacaaacacacaatattctatttttctctatcctaatttaaaaatctgttcccacctgcatgtgtctcacatgcacacacacagcactgatggaaacagcatgcgtgcagtaagtatgtaatcctggtgactgcacagaccccgtggtggaggagaacagcaggcaaagcagctgttgatccaggagcttttgatgcaaggttcatcttgggatctagacacagacataggtgggaatggtgggttagggctgtgctgtacctggccactctggaccatgccagggagtgctctcacaggtgccccatggccacctctgttgcccccacagcccaaggaaggactctccctgtgccagctttgaccaacactgccttggctgtgaaccaaactggacagaaacagtgtctttgccacaagttcacgcctggtgagggagagaactgagacacgtggagtccctgatgcaaggatggtgcagggcatggacagcaggaaggtaccttgaagggaaggctgggaggggtggggccacagaaggagaggcccgagaggcatttgtggccaagagtaacaagggccccccacttggactttactcacttctcatgggcactccacggcgggtcctcaggccctggaatgtggcctgctgatccattttccagatggagggactgaggctgagggccaggtggggtgtcggatgcactagaattcagacttcaactcctgtcctgttcaacccctcctcttcgggccatgcaaggaaggaggcctcgtctgaattgcccttcccaggggagccaggctcaaggtgacactgtgcctcaggtgctgtgagtccaggcgagttcagctcagtgtaagggcccctagcacggctagaatcaggcagagtgatggggcccaggacgtcctgccagccttgcttcctgaagaactcggacaggccagggctgtaccagagttcctatcagactgggggcttgtgaggagacctcacagactctccgcacaattgcccaaatctctgcctccctctgcatgcaaatggccttcggtgaccttggcaaggccccttccccagaatcactctctttatctcattttgtgcaacccagatgcctgccaccaatgtttcacagatggtttgaaagtaaaattagctgagcacacgggagctcatgcctgtaatcccagaattttgggaggccaaggcaggtggatcacatgaggtcaggagttcgagaccagccaggccaacatggtgaaaccctgtctttaccaaaaatacaaaaattagccaggcatggtggtgtgcacctgtaatcccagctactcaggaggctgaggcacaagaatcgcttgaacccaggagatggatattgcagtgagccaagattgtgccattgcactccagtctgggtgacagagtaaaactctctcaaaaaaaaaaaagaaaaagaaaaagaaaaaagaaaaaaaagaaagtaaaactgctgtttaagagtctattttaaaaaaaaagtaattgcatgcaatgtagatttgggaatttaatgcaatcaatgagttggcaatttcagggtgcacttccacatctatttccaggggaattttaattttcttggtctttcttttatagcaggtaaagcaagatgtcatgatcatctttgagaaatgtttgtttagggcatccagggcctttaagtgggaataatgatacttgggaacataaaattgcttctgaataaacgtctggctcataaggcagcagcactcagagaggccaagagtgcatctttatgaatgagcatggggaacgaaacaggctgagtaaccctgggcccacacactggctgctgccaaaagctccgtcttcagggagccgcgtggggatggccgggtgctggggtttccaggtgcttggattctgctcctgccagggagccaggctgtcaccatgctcagaattgacacctgagacctgcactttggtttgggtcccccagagacacactggagggcaacttgtttgtgtagggggtgatcttaggaaatccggtagggtgtggggaaggaagggagtgtggccgataaaggttgcagcaggatcggctgtggctgcagggatgttcggggagccaggacagcccgtgcgcctcaactttcccgccggaggggcaagggagccgcatgtttttgccctgatacccccagcgcgtcatgggttaaggctgctccaggcctcaggcagaggctctgggcaggtggggttccgctgggctgggtgaggtggcgaggcctgagggaagtggctggagctgacggcacctgctccttagatttaaaccagccgtgacatttccaatattcgtggttttcaaggcactttctcatttgtaaacgtggtcaccaaaagaggacagaggcccctcctttctcagtaaatacttgctgagcttctggggagtgctggcagttggtggccaccagacactcccagatccctgcctcttgcagatgctggtctcttctgtctggcacgcatgacctttgcggtcacactccaggatgtttgtcatggggctctgaggagcggggagtcgacggctctaatgtttgcataagtgtgacttttctgaatgcgttggcagagacgggggtgagaagcaaataatctgttttggttttgtacattctggtaaattctgcaagcgagactcccaaacagctgcctaagagtccagggtaaagctacgggtgacaatgccaggtagcaacgtctcattcagcatcactgacagcaccagatggaaagagcccccgccccttccatacacggatgctcatgcaccacaaacacacacacacacacacacacacacacaccatagaaacgtagacatgcaaatttgcatgcatgcaaacctgcatgtgcacacacagacacacacgtaccacacaccacacacacagatacacacagacgcacactcaccatacatcccacacataggcacacacatacacacacacaccacacatacggacacacacatgtgcacacagtctgtgtctgtggttactgaccaggagggagtgtgtggttgggggcttacggggtagggaaacctggtttggtctccctgctcaaaccagctctgaggcctccttaagactcggttttctcatgtgtcgcatgttggtgaaggctcctgccccaccacctcccaaggaggtgatggaacttcaaacatggtgacagatggagagggcagcctgatggggaggagatgtgatgagtgggtgccgtgagctgcggacggcaccgtgctgcagcccacctaggtgtactttggatgagcagagttgaggcagtcagtaggttggggcagttggtagggaggtacccctctggcacgggaagggctcacttgaggctggatgcatgagacatcctcgccgggacaaggcaaaggccctctccaccccaggtccagccttcacagagctgccagaggtgctgcttagaagcagagtccagaggcagcagccaggggctggccagactggaaactatggaagaggtgggaggaccacagagatcctcttctcaggtgagggctgcctcccccgctcctgctgtctctgattacttgaatcagtgctggacaaaggaccatctcatggaaaagcctcaccaagtacctccaaccaatcttccatcttcggctcaaatgccccctgctcatggagaccttcactccctggcacccacactccctggcacccacactccctggcacccacactccctggcacccacactaggccagtgccccggttttatgccattataaagcaacacatttcctctttgtggctcttaagtcagatgtgaccacacgcccagtccggcaaccgcacgggaggtctctccccctagactgtgctccatggggtggacccaggccttgtgctgtttttacttatatcccccatggagaccagagctaggcacagagtacagcagcaccccaactttcagccggttacccatacatctctcatgtcattaagaacaatgaaactatagcacacacacattccagtggaaaaaaataattttcaaagttccctggagttcgttgcagtggaatccatggcccaggtgagcacagctgcagggagctgcgcggggggagccgcagagctgggcacttgcgaattaagtcccggtgaccggtgactgccgaggctctggcaggcggagggcggggtgcggagatgccgttcagaacctcggacagcgccgcggcccatccggccagccagaagctgggtttcatctgttttcttggggactccaggattacggagtattgccatgataggggccagagtgctttatcccccaaagcaccccccaaaacgcggcacgggtgcaggctccggcctcaacacctgctgccttgccgtgtgatctggggtggagcttcctcacgtctctggggctgtttcccacaggaggaagaggtttagttcagcctggaaggagggcatcccatctgagccgagacctctttgagggtccttgtatgtcacctgctgtctgtcgctggttcgccttctggcatctttgatacctccccagtcagagacctctgtttgtgccaagaagtcatctgctgtgtcttcaaacaagaccgtaggaggcagagcctctggtgctggcacatcgcagaagctaatacctcgtcaccaacggagtgaagagaccacggctttcccctttccttcctgtattccagcttgcatggatgccagcagaattcaatctaaagtggaaagagaaaagtaaacaaacctgagaactttctggatctctgcagagctgggcactttgccagtacaggttttattggagggaagtggtgggttgcttcctcgtgttcccatcgcacaggctggagtaaactagctccgtaagcaggcttgcctttggccgacagatgacaacgtgtctgcatgtagacatagactttacaaagggctagagatggctggtggttctcatggggagatggccctgaggctgatcagtgtcattccagtcaaagggctgcctcttaggggcacgtgacatcccccagcacccgacctgcccggacaaccagccaccaggcagacaggagtgagggggtgaacgaagtatggactgaatccacagcctacctggacaacctcaccacgaagacaggagtgaggaggtgaacgcagtgtggactgaatccacagcctgcctggacaacctcaccacgaagacaggagcgagggggtgaacacagtgtggaccaaatccacagtctgtctggacgaccagccaccacgcagacaggagcgagggggttaacgcagtgtggaccgaatccacagtctgtctggatgaccagccaccacgcagacaggagcgagggggtgaacgcggtgtggaccgaatccacagtctgtctggacgaccagccaccacgcagacaggagcaagggggttaacgcggtgtggaccgctgtcatggctcacagcagcctcaacctcctgggctccagtgatcctcctgcctcagcctcccaaagcactgagacgaacatagacgcaggcacacatgcacacaggctgtgaaatgtatgtctccaagtggctgcgggcccctgaagggctgctgcagccctggggctttgctcttcagagccatgtcgagggagcagtagcgggagccacatgtgacccccagatccagacagagaccacttccagcccccaggaggcccacactcccctccactccacagcgcccccaaaggtgcccacgtctctgacccccaccctgggtgagtaggagcacgtagcaggtgcccctcacgtgcagctctctcatccacacatactcacacatgctcacacaggaaagcacatgcccgctgtgtcctgctgcattgctgggcagtgtccactgcacgtcgctcgctgcattgctgggcagtgtccgcggcatgtcgctctctgcattgctgggcagtgtctactgcacgccgcttgctgcattgctgggcagtgtctactgcacgccgctcgctgcattgctggggagtgtccgctgcatgtcgctcgctgcattgctgggcagtgtccgctgcacgccgctcgttgcattgctgggcagtgtctactgcacggtggacgctcctgcactcatggatgctcaggctgcttcccgttggacgcgattgtgagtgacgctgctgtgagcctccaggtaccggccttggagccagcaaatgctttcatttctcccatgcaacatctggggctggaatttctgggtcatatggtgggtgtatatttgactgtactagaaagtgtcaagcggttctgaagtggccgcaccatgcacagccccagacagtgtgagcgtccgctgcctgcagccccccagcactgcccagccagtctttccggtttgggccattctggtgggggtgaggcagcactgcacagggtcttatttccatttcccgaagcccatatgttttctctctggaggacgggggactcaaggcaccctccccgccccctcctgccttctccataaatctctccctctgaaaaacacaatcaataagccacagagcccaacatgcgaccgcaaagccgctccattattaagtctgtaattgctgagaattaatttgctaattgcacgcaactaatctgcgtcctttctgttttatatcaattaacagagtaattaaaaaaagcaatcttcgtgtcagctcctccctggcagacttagcctgccagagctaatgagacaggccacccttcagccaacctcattagtgacgaccgtgcggccaggaagtccttgatgtgcgatgtgcagtagctaacaagggcccccctgccgcgaagcaacaacttgctgggcatggagcagggacccacgggtccccatcattgcctccgggctggtgggacccacaactgtgccaacacaggggctttgctgggctggcaagtgcagggggccccagccaggcagtttcagaagagcaggcacgacgccaaggcctaggaaggaggccacagaggcccgagtatcccagggggtctttgctgggatctggcattgggtgcctctcccgctacgcagggatggagagaaaagacaccgagagtcctggggctgatgaagagcttgagctcggagcctgaccacccacagacagcagagtgatagacgcctccatgacacagaacgcagccctccctgcctccagcccacaaagcctcctcctccacagcccgacaagggccagtgctgggccagctgctggaggacagacagccacgccaggggacaccacagctcccagctccctcctgcgcctccccggccaccatgaggatggaagacagcaccaaggacgaagaagagagcctgagcagaggccaggacctgggccaactcagggaccaggcaagcacaccttgccatcttgcctgtcccctctgctgagcaggactattgctgggactggccccctccacagcacccaagccagccttgggcaaaaggtgctgtcatcccagctgacccctggtgccagcccggtacacaccagtgaggggatcaccagggaggcctggtgccagcctggtgtgcgccagtgaggggattgccagggaggcctccacacagactgacctcttttggtgctgggggaggggctgccactgtagatgctctcagctggggaaccttccccagagcaagctgctggatgtgcaggggccccgggcatgctgtccagcaggtcctcccaggctcccagctgcccccatccatggccttccgacacagccgccagccgctgaccgacatcaggtgcctgtgcattgctgggcccaccctccagcactgtcacgttcatcttagcaatggctcatgaggttggatggctcctgtccatgctcagccaaggatccactcagagcagttcagtggccttcccctggctgcagagtagagccggatggagttggacctggacgcaggccgcccccagcctgtgctcctggccaccgctcagcctgcccctgctgccaacacggtccgaatgaccactgtgtgtcccatgcgcctccacgggcccagaggcttgtgtgtgccaggctcagcacctcaggaccctcggtctgatcgctcgatgcccaggaagcccaggaagtgcctgtgtccccctcatcccctgcacagtcaccccaacacgagtccctgcaccccccttcctgacctccctcaccctgcacctttctcctgtaccctccaggtcctggcccctcccctcccccagaatgagcccttcaatttctcacccaacgaaagcctggccctgccctgaggcccccgtcaaggggcaggggcaggggctgctcccaccctcctgtcaaggcgactccattcctgggccattctccatcctcctccccaaagtcctcgcctcccgggcccaggctctgccacctgcctggctcagcctccagcccagccccccgccttccatctccccttgcccaccagagggtggggccccagacatgggctcttgtccctctggcctgcctggcccccccacatgcacacagggtgaggcggggcagggaagctgggccttgggtatccagccctggggaagagccaggccagggtgaggctgagggtgctcagctgccaggtgctcaggaaagcagggagcaggaaactcctggaattgggaattaagtgcaaggagaggggatgtgtggagctggcagcattctgccaagtgctcccccagagagccagctgcactggagcccacacgcacagagcccggggcgtggcactcatacacacgctcgtgtctgccttcacgtgtgtatatgagtgtggagtgtgcacacgcatgcttgtgtgtgcttgagcacatttgagtgtgcacctgtggctgcggtgcccaggtgcatgtatgtatgctcccgtgcaagcacatatgtgtgtgcattgggaggcaggaaccatgacgactgcacagcccagcacggcgcccccacggtcacccgccctgaaacgaaagggacccccaggtcacccaggctggagggtttccagttgctcccctcagggtcacttaagagtcaggcgagtccacaagacctgctactgcaaaatcacagcctgcagcatctcagggcctgtcttccaccccagcccattgtcattctgcataaaagcagaaaaaaaaaaaaggcaccaaactgcaccaagcgtgcaacagatgcagctcaaacaaactcgtgtacgacacggaagagacaaaagcgttgccggcaacttgtttgggacacacgtgatacagaaaggtgacgaaacatcacagatcagtgggaaaacaactaaactgcaaactgaagaatgggcttgggcagaccactcacagaagaaatcccaaaagccaataaatgacttgaaactatccagtgtcactattaaagaaatgcagatttaaataaagtttgactttcaaactagcaaaaaatgtatgaaactatgaagctcgatgcgtgtgatcatcagcagaggccgacgctgcaggcagggccaaagcttctgaccctggcccccagggaggaacccagaggccagtcagggaggggcagcgagctcacggccaggcagcgccacagcactggcgaccctcagggagaacaggcactacccagggctggatgcgtaacgggccccccggccacaccccaccgcccatcagagccgcagctcctgagaacgcatccggaggcaaggccaaagtcagccatggcacaaacatttgtgcatcaaggtcctgttgctctgcaacaactcaccacaaacagaggggtggaaacctccatgtcatcggacggcccagcggtcagaagtccaacgccatctccctgggctgatgtctgtgcaagcagggctgatgccgtagcttttccggcttctggaagctgccacagcccctggctcatggcaccatcctcacatcctctgaatccacattctcctctgaatctcccgcctccctctttccactgtaaggaccctgtgatgacactgcaccctcagaccctggtaacccagggtcatctttccacctcagggcgtctgacttaagcctgcctggagggtccctgtggtcacattcatgggttccagggttcagacacggccactttgtgggatcattactctgcctaccacaccatgtggccctgtgtgtgttttcagggggcatttgcgcttatatgcaaataatacatatatgaataaacgtgtgaatggtggtcacgtaggagagggcatctgtatggggccacacctgtatcttcgctgtgctttccacttgttattttctaaagggtggatatgatcttacagaggatagctcaacgtccagttgtggaaggagatgggacgagggttggatttacttggaaacacaatggtgcccacagagcagccaggactgaacttggcctggatctaccctgagcctgctcagtgcagtaggggctggtgctgctgtggctccatggtttcaagttaatttttgatccatttcaagttaatttttgcatatggtgtgaggtaagggtccagcttcattcttttttatgtagatgtgcagttttcccagtgccatttgtttgggactatattttaattaactatttttttttgagacaggaggaccccttgagcccaggaagctgcagtgaaccaaggtcatgccactgcactccagcctgggtgacagccaaacctatctgcataaggtggtccctgagcacagccgtggtttctgcaccatggtggcccttgtccctcagcctgcagtggacacagtggatgttgtccccaagctcctgttgtctggagcctttctagacacccgtgacccatggaccagcccagagacctcaagggtcacggcaacaagcgtattgtgggaagggagggccgagatgacgccggctgcagagactggccagagccagagccagatgctggagagtctcatgggtcccaaggtgcccacagggcagaaaagcccacacgtggtgatgggagggcgacctggaccacacacgtgaactgacgctcagccgcagagtcctggggccatcacggcagccccgcaagggctctcaaggtcctggtttcccaatggtcacaccgaggcagagaaaactgaagcgtggaccactgtggcccgaggccagaccccaacctcgccgggcttggaattaaccccgggtagatggcggcacgggcttagctgaccttttccaacgtctcatcagccccagggctccttgctgttagggtctccaggtttagcaaatgaaaaaacaggtgcccagttaaatttgaattccagaaaaacaagaaattcttttttttgtatgtgtgtgttttgttttgttttttgtttttttgagaaggagcctcactctgtcgcccaggcgggagtgcagtgattccatcttggctcactgcaaccactgcctcctgagttcaagtgattttcctgcttcagcctcccaagtagctgggactataagcgtgcgtcaccacgcccggctaatttttgttttagtagagatggggtttcaccatattggccaggctggtctcaagctcctgacctcaggtgatccacccagcactttggaatcccaggtgtgagccaccgtgcccgacccatgaaattcttttttcatataaccacatctcacacctgcacagggcatccttcatgcaaacctcggggtggggccggcgtcctattctccagcgtctctgccccaagtcgagtggatgagacaggacctcccagctcctcctccctcccaggtatgtttagcttgtcattccacacttacttgtggcaggtggctgtcctcagcccaaggtcacgtcatgaatattctggtttgggcgtgggagcctggggatgaatcacaggccagattagcagcccctcaaccctctcgcaccaaatcaagggccagcaggcctacgtcaacgtaataaacgtaaaccccttctctgccaaaaaagaaggctggatgagtcctccctgagtcacccagaacatctactagtcacagccagttattaactcccttcccgggagccaccgctgcaggaacatggcagcagggcagacatggatggggctggggccttggtccccctcccggctcaggccactgcacagccgtcctgccccaaggccctctctacatgcttgatgggcgccaccgggcactggggggcaggaggcagaggagggaatggaggtgagccacacaggggggccggactccagagcccaaggaagctcgcctctggaggctttgttacccacatgttcctgaggggccctgccaggaggaccgtcccctgaagggagaggaggcctcagacaggccggggatgcccaacacagctgtggagccatggaaattacacaactcagtaaatcagaacaaaacccaaggagagagacgagcaaaagtgagaaaggccaggggagaggccagcggcggccactgagggctgtcaggatgaacgcaggccacaggctgcagtgtggagaatggagagaggccagggaggtcaccgagagtgaagtatttggggagatagcgggaggcacgtcccaccctggagccatctcgccgggcctctgagagcgaagtgtttggggagacagcaggaggcacgtcccaccccggagctgtctcgcctccttcaggactgtgggtgtctgattctccacggctctttaaacaaactgaacctagaaatggcaccagcaccaacagacttggctatgtttcgtgcagtaaagagcgggcaggtgggccttggcatggggctcccagcaggagggaggcagcaccccctctgcccttctgctctgctggacagggagtgggcaggctccgtctgcatctggtcctcctcacaccctgggagctggttctgtgatcatctcctccttgcaggcaggaagtggggctcagggaagccaaattatctaagaccacatggttgtgggggccgggctggggccgaggtgatgggtctggtgggctctgctcctgggactgtctctctcagcctggccctcagagctcccctgaggccttgtctcggtccagggacagccagaggtggccaagaagaagggttccctccactccatcagcctcgtaaaaagagcctcagatgactgtctctgtgtttatagatgcgttgccccaggatgagagatgcaattctctgaaaggaagcaaatgcgatcattatcctcttcacccaggcctctttgctggtgggaggttagttttgcgtttaatgaacatgggctgagtctctctaatgaggaagagatgggtgcacagtgattagaaacttggcagagaaagaagccatcacagcttctgtggggaggagccgctgggtttgccgtatctgcagactggcaggagggctcacagcaggcaggctgcacactgatctctgagacccccgcaagcctgaatcccctcgcctgctgccccaggctctcaggaggacaagtccctgggtttgtgggcgacctttggttgaagctggggggcatccacaaaaataaagcaggtcagaaaccgtcctgagggctcccgcagcctcagcaacccaggactcttccgccccacgggactcttgtcccacagacaggtgaggcagatgcaggtagccacccacccaagcaccctcagccagcagagacgcaggaaaatgtttctgctccacatactccgttgaaatgggccccactgggagagaacttgcacttgacctgggaaccacagagcctggaattggcagtgagcttggtggtgcacggtgctgtgaacgggggcctggcagcagcaggtagggctggcgcattcctgccaaccctccggggggaaaaggcccaggaacaatggaatatgactcagcactaaaaaggaacgactttcgagccacaggaaggcgtggagaaacacatgcatgtcactaagcgacagaagccagtgtggaaaggctgaggggaatgtatgagtccagctataggacattctagaaaaggtgaatccctggagacagtggagagaccaggagtggccgaggttgggggagcagataatttttagggcagtgaaactgttctgtatgatacagcaatggtggatacctgaccttacacattgtccaaagccacagaatgcacaaggccaagcgtgcgctcaggtgcactctggactttggtgaatagagatgtctcccctgtgacaacgtcccacaccaacacaagaggccaatcacgggggaagccgtgtgcaggggagtggggaacaggaaactctctgtgctttctgcttaatttatgtgtaaacctaaagccacaccaaaaaatcaagcctattcgtttttcaaaggtgtaggcgacaaagcataaatgaagaaactctgtcaggcagaatgctcatgccaggtgccctcccgatggagctgggcatctgtgcagtggtgacagagacctgcccctgagaatggagctggagggtccacgggtcagtgtcctcacctgcctgccagtgggcccgcggatcagtctcctcacctgcctgccagtggcactcatctctgaacataaccataaaaatcacattccccaaggcaaacagcaaagcctcggccccatacgctaccgtttcccctgaaaaatattttgtcaagtgaaacatttgagaaattagcaaattttccacttccaagatcttgctgcaaagtgatgatgcttcattctgcccagagagctccacaatcacctccctctgaaagcccccctccttggagcctcctggctcccacacagaggcaccgtgtgccagggactgggccccatccggaggcagcttggactccacgtttgctcattctgccaaaaagaattcgtggcaaataacgttcacacaagcacagccagcggtgggcagaggtgggtgcctgttggcttgttttaattttttaccatttttatcatggaatatcatatcacaggagaaagtgcaaaagtgcgtgtgtctaagtgactatgaatcagaggccaaatgttgtcagccctctaggggccctctgcgtccctccctccagagaggaacgccatccatgtctttcctatcattgttcctgactttatttttttcctcagttttttaattgtgataaaatatacgtaacataacgtatatgaccattcatagctgaccattcttgccactcataagcacccagttcaggagcatcaaggacattcccatggctgtgcagccgtcgccaccatccatttccagaacttttccaccttcccaaactacagctctgtccccattcaacaccgactccccatcccctcccctcaagcccgggagacgcctgtctatcttctctgtgaatttgatgactctcgtgtttcttatcattggaattccagttccagtggaatatgcattccattggtacttgtccttttgtgacgctcatttcatttagcataacgtcctcgagcttcatccgtgctgtcaagggcgacaggctccccttcctctttaaggctgaatcattttccgctggatggacggacacattcgcttctccgtccatctgtcgacggacacgcaggtggcctccaccctctagcccctgtgaacacaggtgtgccagtattttttcatgttcctgcttccaattctctggagattgacccaaaaggggggtttctggatctctgctttcttttacctctttatatgcctcctagataccatagtctgcagctttgcctgttcgtgaactctctgtaaaaggactattctcagtgtgttcttctgatttgctgctttcctgccatctcagttctaaactccgtcctcactgcacgtgtgactcttgtccacgcacgtttgtggctgtgtcgcgttcccggcgtggccacgccgccacgtattgatctgcccgctgcagacacctggcctattttccaggactctgcaggcaggggcacccttcgccagagtgtgtgcagggcctttctgtagtgccctcccccagaagcacatgggcccgtcggcccccgcgtcctcggacacgcaatgctgtcggtcgttctaaccgggctgtcctgacgggcgcgcagcggcatcccacggcagtgttcacgagtgttgccccgtgtgtggggaggcgcctgttcagctgtgccacccgtttttctaaggagtcctctttttcttgctgattcagagtccttcatattctggttttgagttcctgtgagttttatgaatgaccgcaccttcaccctctcccgtgtcttctgagaaacaaagtcatgtgtgctgatgttacccgcttccgctgcagcaaaggctcttgggggccttgtctgtgaggtcatcaggatggggctctgggtcaaaagtgctgccctctgggcatccacctggggggatctgaatgccgtgggagtctactttccttttttcccacgtgggcacctgactttcctggcaccagaacaagagtccaaccttcccccaataacctgcaacgccactcccttcatcacacatccgcgtgcgtgggcacgagcacaggcccccctcggtgcccaggcggtgtcctacctcgtgggtcagcggccaagccccccgccagcagctcctcgtgctctgggcaactgcggccccataacacgtcccacttgccatccgctgttgcaccgtccacctgctcctcaggagggtctgggctgctcccagcctttctgtacttctctgtacattttagaattggcttctaaaatcaatctctctctctcactctcccccactggactttgctggcactgatgtgcatctacagacagacccagggaaaatggtcaccttcctaacagcaatctttccaatccatggaagggatgtctcaggtcttcttcagtgtctccagatttgtgggtttgccataaatgtgtcacatttctttgctgtttactctggtgtggttcatagtttgatgttattagaaatgacgtttcctacatttattttctccctttttgtggttaatgccctgattttcttacactgtctttaacctagaagcgtcaactctctcgccaatgcccacagtgcaggtcactggggacccctgagcacagccaccatcccccgggacagcgttattccccatccccacccccgggcccccactttctcgccctccctaaccctgccctgctcctggggtgtggggtgcaccctcgttgcctcccatcatgtgaagcctccttcgtcttccaggtgcactgtgaggctttctaaatgtcctaagtggaagtctaatttatggagctcttttctgcacccatgaagagaatgagactttccccctccaggtgctgctgtggtgtcaccgtgatgggttctatcccctcaaggtcctgctgccatcggggccacacctgaccatttgctcccgacttggggcagattccttggggctggagtgcaggagcctcaccgccaggggctgccacccccaccccggagggctcactctagggctctgggtctcaatccccagagaagggtgcgtgggactcctcctcactcacccactcacctttccaaccaaagccgtggacaggctcagatcactgtccacacccaacaccgcgcttcccgtgtactctgcccgtgtggtcagcaggggccgctccctcccctcccccactcgccctcctcccctcctctcctccccccgccccctcatcacccacccgcccgccaccacacaatacggttcctttcattgtcttgtgttaaggctctcgggtgggggggtggttattactgtcccactgtgtgacatcataataggctgctgtcccagaaaacaaaggctttcgaagatggcgaggagacacgtcctatttacgtcgtcactgcctagacagacgtggaagtgcgggagcagaataaacatctgtatccggagagtaacaatagcgctggctgccctgttatttccgaagcctgcctaaattatgccctgcgcagcacagaaagggattttttgtgtatgtgcaggtggattaataaaaaaccattgaaatgcaaagtgagggctcctccctcacaccccctccccgagagaagggaatcgtcacccaagaactcgcagatcctcttggggacacataggccggggtcgaccgtccgcaagcacgagacccagggctgcagggggaggttccggctgctgctgttaccgtcttgacccccaaaagaccaaaaaagggccacgtgcaaatcgtaaaaatcagatgtgaatgaaccacacggctcgcaagggtgggaggttcatgccccagcccaggggtctcccaacacctttaccattggcacccctgttttggaaaaataacacagacgttgttccactacgtgggaaatacaccccgtggctgaactccatggcttcacccgcctccatcgttgggctggcaagtgtggattggatcacaatgcccacctgagaggaggcctgtcgggtccccaagctgcccctgggccgggccacccacacagcaaggggcaggggccgcctgaaagcaccctgtgctccggcgcggcccagatgcatgctctgttcaggtggcgtagagtccttctgcctcggtgtggccccagggtgggtgcagctcagggaggaggcgcagtgagtccttccctccctcggccgagcagggctttctgccgaagaaggtgtttcccgtcagcgatgaagaagtaagttcgatgctgtggaaatggattctctgattaaaaccaaaaagcaaatccagcccacccggccatgtgcagggctgtctcccacataacctggtacttggtggtggacggaggagcggcctcaccagagcacagggtgggtgcagcacttgctgctggagacgctgccccgtgtgacacggggtgcacggaagccccaccgtggaagtcacggctagttcctgccagcagcgagtagcagccagcatttaaagacacgcctgggggttgagcccaatttattgtctttattaaaaaggatattgtagtagcctgttttcacactgctataaagacatacccgagactgggtaatttataaagaaaagagacttaattgactcacagttccacatggctgaggaggcctcaggaaacttacaatcacgatggaagggaaagagacaggtcttacacggtggcaggcgagagagaagagtgtgtgagagtgcagggacaactaccatttataaaaccatcagatctcatgagaattcactcattatcgtgagaacagcatgggagaaactgcccccgtaatccaatcatttcccaccaggtctctcccttaacacctggggattacaattcaagatgagatttgggtggggacacaaagcctaaccatacaggtatcaagtgttccatgctgccctttgttgaaaactgacttttatggccctgccatgtgaccatgggtgacaaatgctattccctcccagcttggggccacggtttctccagcctgtacattaaagcctcatctgttcttcctccccaggcctggagggctcaccggcccgtgagccctgtgacattacttcccctgggcagactcagggcaccatgaagcttcccaccgggtaggcactcactatgtctgttacgccgggcgccggcccgagtcctaaagataggcagccctgagggcagaggcactcactggagctcgtgcacacacgtgcacacacgcaaacagccgggcatgtgcacaggaacacaagcacacatccacacgtaactgtgtgcacacacatacacacatgcacaatccccactgtgcacctgagcatcattgtacacatgggaaatacatccacaaacacacacacccataaccaggcacatgacccggggctgccagtgccagagtgatgccagctgcgtaggccacacctcagtctgacatataccttcctggttcatcagccccatgaggaccccaactccaggatgtacagcagaaaggagtcttcacctgcttcacagattaggacaccgaggctcagagagggttgagtggctgcctgaggtcacacagcaggcaaggcagggaacggcactgctgcccctcattttctgctgaggaaaaggtggacggggtgccagccgcagtgaagcccacaggcccccaggtgccacctatcttcatagcctggcttatcgtcaccccaggaggaggaagggccttaactatggcttccacatcagatgccagcccaccctgggttaagcatctgcatggagcccagcgatggggacgcgatgaccacgggcctcagaagcacccacagcctcgaaggggccaggactggctgcacacagcgccagtgacgacaactgctgctggcggggaccggacgctcaagccccagatacactgtagcacgtccccagagaagctggactcagagctcacacttccctagagacgctcacgtccaaggcaggatgcaggtgtgcagtgcagagccgctcagagcacctgagctggtggaactggccgggggtccagggtccactcaaggacgttctccatgtgcagctgccagtgactcctgggggctgccgggcctgatccagtgagagggtggcctcccccaagactagtgcagtagacaaggccctttcccgtcagccaccggagcgagctcactgagcacaggccatctccagggcggtttcagaccttccggcccctttcagggacagccaggcctttgtgcccaggaccgctgccctccagacagctccctgtcatgttcacgtccagcgctggctctgcagacactgggggccgccttcactcctggggacccccttccctgcctcccgcctctctccaggcacctgtcccttagtacaggagctcacagctcaccatgctgcccagcacccaggctgtaccgcccacagctgtgcaggcactcacagccaagtacggagccttgcggaaattcccccagatcctggcccttcacccacacagatcggaccctcaggggacatcggccaccaataaaggagccagcctagatgtcattgcagctgagcccccatggccagctcctcgggtcacggcagctccatagcaagggctcctctcatcccaatccactggggccactgccaagaggaggacacagccttggccatcgagggggatgctcaggtaccaggacccaggatgcggacagactccagggtctccaaggttcctgctcagaggttggcagggtgcttgtctccagaatgatgcccacctggcgataagtctcagcagagccccctgcagagtggccctggggctgggttcggccccagacgacctgaggaagctgccaggtaacaaagctgtcggcatccccagagcccagcgggcaaagatagccaagaatctaccaccaactggcagccaagattgcctgtgggtcatgcagcaggttcacgtccctgttttaacttttaagaaaccaccttagtaaaggttgtactgataaaccgagcaaagactgggcccgtgcccctgccccagcggactacagcctgaaggaggggccctggaaacccaggagctcctgtgccagctccgggcacttgaccatcgcccaccaggtttgtcccctcggctccttccttccgtgcctcacggtcggccttcgccttgacgtgcatgccaggatgcatgaccactgggcaggcaagtgcacccctgggtgcggcaggaagaaatggccccttgtaaatcccacaggcgaggaggccacactcgtgcgggggtggggcccacagagggaagcagggccatagaggaggcggggccacaggggaggcagggcctgaggggaggaggggcctggatggggaggcggggccccaggggaggcggggccttagaggagacacggcccggagaggtggcagggcccagaaagaaggcagggccacaggggaggcggggcccagaggggaggcagggcccagagaggaggcggggccacaggggaggcggggcccagaggggaggcggggcccagaggggaggcgggtcccggaggggaggcgggtcccggaggggaggcgggtcccggaggggaggcagggccacaggggaggcagggcccagagaggaggcggggccacaggggaggcgggtcccggaggggaggcgggtcccggaggggaggcagggccacaggggaggcagggcctagaggggaggcggggcccagaggggaggcagggccacaggggaggcggggcccggaggggtggcagggcccagagagaaggcggggccacaggggaggcggggcccagaggggaggcggggccacaggggaggcggggcccggaggggtggcagggcccagagaggaggcggggccacaggggaggcagggcctgaggggaggaggggcctggatggggaggcggggccccaggggaggcagggccttagaggagacagggcccggagaggtggcagggcccggagaggtggcagggcccagagaggaggcagggcccagaaagaaggcagggccacaggggaggcggggcccagaggggaggcagggcccagagaggaggcggggccacaggggaggcggggcccagaggggaggcggggccacaggggaggcggggcccggaggggtggcagggcccagagaggaggcggggccacaggggaggcggggcccagaggggaggcggggcccagaggggaggcgggtcccggaggggaggcgggtcccggaggggaggcagggccacaggggaggcagggcccagagagaaggcggggccacaggggaggcggggcccagaggggaggcggggcccggaggggtggcagggcccagagaggaggcggggccataggggaggcggggcccagaggggaggcggggcccagagggggcggtagccccgccaagtcttgggggcctctcttgctgccaagcaggaggcctgggctggctgctctgtctctggaatgcgctgttcccaccacttggcaacgcctcagagggcaacacggccctgcccagtggggagagggctccagctgcccaccctctggccctgggtaggggaggatgaaggtggcctggcttccccgtaggaccagatgccaaaaggtaactgtcccctaaagagcagtgagggcctacttgctgatgaaaagcctaatcaagacatttttttgagacggaggctctgtcgcccaggctggagtgcagtggcgtgatctcagctcactgcaacctctgcctcccaggttcaagtgattctcgtgcctcagcctcccgagtagctgggagtatcggagcctgccaccacacccgggtaatttttgtatttttagtagagacaaggtttcaccatgttggccaggttagtctcaaactcctgacctagtgatccactcacctcggcctcccaaagtgctgggattataggcgtgagacaccacgcccgaccctaatcaagactttttaaaaacatgaatcaaaaagacacactttaattaataggcagtgaattaaaagactgctgactttggaaaaatcgttttctgagttcaagatcggtgacgctggattagcctaattgatctgaacttgttggtttgggattcaagggcaagtttggttccttagtggctggctgtgttgtgtccagattgatgttcccaggtggggggcaggagccctggaaacaacagccagaccctgggcagccggccccggcgaagaggggtccaagccctgtctcatgtctcccttggggtacatttgaggcctggacaccccaaccccgggaggtggggagtgggtcaggctggatatgagcaatgacactgagaagactcaggggcctcgccagacactagccccaggaggcccggcggtgtcccaaaaactggccatctgttagacaaaccaaaagaaactcaaaagaggtaaacagtacaaatctcactcgatcaaaattaataaaaatagaaataaaaattccccaatttattttaagttacatgaccaagaaataagtaccccatgcctaggagagtgggtggggtttggccaggctgagctcagggaaaggtacgtggccttgaacttcatattccagatgaatattaagatgaatggaatgaatacagtcgcccaagtcattcaagaaaagtaacaaataaagagaagatggggaaaagtcaaagctgatgaattagggagaaaagctacggaatttgagtccaacaactggttctttggaaagttgtaagaagtgagtgttccaatcattttcctggtcaaaacattcggcctcactggtggcctgagaaatcgcttaaatgtcatcagagtagaacagaaatcagggcaggaaagagcatgggcagagagggaggggagccccagggcgtctccggtgcgctcagacacaggttcaatatgtaaaacagtgttattgagctgtcgctcacatggtataccagtcgcccatctacagcacacaactcgatggtctgagtgtgttccttcacagagttgtgcaaccatcaccacggtcaattttagaacattttcatcacctcaaaaagaaaccctgtccccattagcagtcactccccactgcccccaccacacccccaacccctggcaactgcaaatctgtttcctgtctctcctggtttgcctgttacagacatttcccatcagtggaatcacacaatatatgttgttttgtgtctagcttctttcatttaacaaaatgttttcacggctcacccgtgtggtagcatacatctgtgcctcattctttttgatggcggcataatattccattgcacagaggagccacattttgccagcccgttcatcagtagacgggcagtgccttgtttccacttcttgactatcatgaataatgttgctatgaacattcatgggaaggttttatgtgaaggtatgttttcatttctcttgggtacatacctagaattggaattgttagataacatggtaattccatgtttaaccattttgagaaacttccaaactgctttccaaagcagctgcaccatttcatatccccaccagcaatgcatagattctgaacttctctttccacaaacttttgttattaaaaataaattgtttaaagaagggaaaaaacagctctccataataaaacacactgctcttctgaaatctcccttggcgtgtgtctatgagttgatttacagtgtgggtgcaagtccacaagccagcagacacacagggccacagaagggacactgccatgctggcccactaccacgttcacaccgaaggtgactttgcctggctgtggactcagcgaagctgggacaccctcagaggcgactgtccacccaaccctcaccatgcagagacagagaccagcacacttggtctcctccacccagataagctcttggagaggtggccctggcacctgtgaaaatgtaaatggctgtcggcctttgacggtgctgctgacgggtgaccagagttctctcgcggctgcacgttttcccatgagcgccgaggcaggttcaatatggacagctcctccagcccctgcaggtaacccagcccgagctcccacttcctttgtaccaagcagaaacaagggcatggaaaagggaggggtgttttcacatctgaatggcaacattcccgtccaacaccccggactatatcttcaaacagatctgtctgagaagacagtgattgcattgagcccagcgtgctgtcagctgcttgaagccagtttcggcacacgggtattaggttatagaagaaaccttgttgtaaggatcgtcagggaggaagtcactgtatttacttgaagtttgcacagcttcatcagtttcagtggaaataactaaaaatagttaaagacattagttaaaattaaagaaaaggggacgagaaaacaagctacagcctgagagaaaacatttacaaaccacatgcccgacaaaagactcacagaatatattccttaaactctcaaaactcaacagtaaaaacaaacaatcaatccagtgagaaaatgggcagaagagacatttcaccagagaggctgtacacagggaaataaacacaggcaaagacatctaatgtcctctgccagggggaactgcacatttgactcacgatgaaatgtcactacgcacccatcagcatggcggaaataaaaaataacggcaacattaaatgctaacgaggtcatgaagaaacgagatcactcatacactgttggcgggaatctaaaacggggcagccacggtggagacggtgtagcagtgttttgcaaaaccaagcacgtgctcacctacaacccgcaactgcattcctgggcatgcatcccagagaaaggaagactttcattcacacaaaaccctatcacgattactcatagcaactttatttgtaaccacgaagaaccagaaacaaccacatgcccaacaatagatgaatggctatacacgctggggtgctgcacaccctgggactccactcagctgcagagaaagaaccggtgaagcacacaacagctctggcgggtctttggggaaagaccaccgtctaccgccacgcgagggaaagaagccggtctccaaaggtcacaccctgcgtgatttcatttctgtgacattctcaaaatgacgaatttggaggaggttggagtggggaaagagctggaggctgtgactaaaaaggatagcaggaggaagatctttgcagccgcagaggggccctatatcttgactatagtggtcacgcgtgtgataaatggcaaagagcagagacgttgtcggaggcacgtcctggttgcgaggccgtcctctagtggagggatctgggtgaaggatgcatgggctgtctctgtactactgtgtctgtctttgcaacttcctgtacatctacaatcattgcaacagctgcagtgggctccggtgggcctgtactccagcctacgacagagagagactctgtctcttaaaaactactttatttttaaaatggcagcaggcgttgctttgcctcaggagagttggacgccgagcccttttgcgggtactcaccagaggcatttgtgctgcttggggtctgggcaccctcttgttgtggtgactgtgattcccatatcattttatctcacaacgttatgaaaaaagcctcattgccgtaacagcacagcaagacagcaagcaactgcgatcgccttggcagagaaggagaagcaaggaaaggagaccagagcagcgctcgtacctctgaagtcctctcccgcaatgcgacgtattagcccaaagtagaccgtggctatggccggggcggggcagctctgtttgtgagcacggaatcgaggctgggagctgcacactcacctgagcgttcacaaactcatcgtggagggtgtcaaatgcactcacggctgcgtgcacgtgtctgctgccttctctcagggagtacagatgctcccctatgctggggcttcaccttgtgtgtggaggaaaacactgtgggaactatgttggtgctgattttttttttttttttgatacggagtctcactctgttgcccaggctggagtgcagtggtgtgatctcggctcactgccacctctgcctcccaggttcaagtgattcccctgcctcagcctcccgagtagctgggactacaggcgaacgccaccacgcccagctaatttttgtatattttagtagagatggggtttcatcatgttggctaggctggccttgaactcctgacctcaggtgatccacccacctcggcctcccaaagtgctggggttacaggggtgagccaccgcgcccagccagtactgatttttaaatctatctgttcaatcatttcggctggagccatcattatcttgctgaagcagctgttggaatattaacaagaggcagtggtaacaagtggaatgtaattagcactccttgttccagtgaatttgcagttctaactgggaacaatttgcagtgagtttgtgtgtggctgtaattaacttcgcaagcacacaggcagcacagagcccatgggaccacagcccgggctgtgacctgcaggctgatccctctgagtcgcccctgagttcccaccggctgctcccgtgcgcgggtgcccctctctcagcctggcatgtgactgcctcctccaaacacccacctggtgtccaccattctggccctgccagcagctccttcattccatcatttatcccagtgttttccaagcacccaggatgcaccaggctgggacttgcccccagtcccacaaagctctgcactcctgggttccccagtaccccccaggaagactccatgccacacaggtggcaccaccttgctgggctcacgtggggaaaggatgagagagccgcccacctgggcagacaggtgcctgagccgggtgggaggtgggaacggagcccaggaccacacagggggtgccgaggagcttgcacacccaggaggctccctggaagaggaaggtttcaagcagctgccctcaggcaccccacgcgtgttgacagccaagcgtgacttcttgtcaagggcatcgttaaaggagaacatgaggcctgctcgggggctgagaggagagaggtgccagggcaggcgccccccgcacataccctgccactgccatgggatcccggcactgcagcctcctggtgaggcccatgtccagctggggttgcagagggtgcggtggcttcacaccccggattgaactcaccaccctcctctttccctcaagctttggtggctggagaatgacagtcgatggccagtgcctggtttgcagaggccgctcatcagcgtgaatccccctgcgtggtcagggccacctcccctttattgatgagaaactgaggcacaaatacattcagtgcctttagtgagtgtcacgcccagagggtgaccacctgccaaggtggggcataatgcacttggcttcccagcctgcagatgctggactctcacacagatggaccggacggaccggagcccgaggtccccagcgtgagacccattgttgttcttggcagtttattttcacatctttcccggaggcccagattcagcggttcttagacttaacctaagaatctctcaaaaccatgtaataaaatactccatctgcatagattaatttacttgcaatgaatacacagacttggagggcacaatcctatggccttttacaaatgtttacagccatgtgacaacaccccactcaaaatacgcaacacttcatcaccctggaaagttccctcatgccccttgcccagccgccacctaacccccaacaaaccaggcaatgacgttctgatttttatggtcagggagtagctttgcctattctagaacctcaagtaaaggtgattacgtagcgtgcacttctttgggtctggcttctctcactcaacatgatgtctgagagacgcctgttctggggtgagacgtggttctcgccttgttcttgctgagtagtattccactggacggacgtggcacaatggtggcgtttccattcaccatcagagaacacggagcttccttcccgattgaggataccacaaataaagctgctgtgaacatccacgtacaagtctttttgtgggtatgtttttattgctgttgcatgaacacctaggaatggaatcgctggatcctaagggaggtgtttgttttattttatgagaacgaccaactatctttcaaagtgatcaaagtgccttacactctcaacagcaatggattagatttccacttgacggcaggcaggatggccaggcatgtccgcctgggtcattctcacaggcacgcatggccccttgctgtcgttctaatttgcatttccctggtgactaatcgaaaggagcttttcatgtttgtctctttgttatgtcttacagaacctacttctgtattctgcatataagttatttgccaggcatctgaagggacttcaaaaagttcacggaaaaataaaattagaagataaaaataaaaatataaactttatttctcaacataagctccaccaaggtcaagacacttttgtaagtgatgataccagccatttagtccatccctaaggcactgagggtcctgggaatttaaccatctcaatgcagtctttttacattactaactgaagaaaaatgactgttctttaaaaataatttttaagattaggaagaaaaaagccagacggagccaaatcaaaactgtaaggtgggtgccagatgcctccagcatccccaaaacttgccataaccttggctcttgaccagtccacttttgctgtgacttgagcacctccgcctctccatagcctttgctttgattgggcctttccgcctctctgtagccgttgctgtgacttgagcacctcactctctccgtagccgttgctgtgacttgagcacctcagtctctccgtagccgttgctttgattgggctttgtcttcagcatggtactgggaaagccaagtctcctgttacaattcttcaaggaaatgcttcaggatcttgatcccacttgtttaaaatttccacggaaagctctgctcttgtctccagctgatctgggcacaacagttttggcacccatcgagtggaaaatttgcccaactttaatgtttcagtaagaattgtgccagctgaaccaactgagatgtctatggtgttggctattttttctgctgttaatcgctggtcctcttcaatgagggcatgaacaagattaattttttcctcaaaaactgatatggatagtctgccactgaaggcttcatcttcaatattgtcttgtctcttcttaaaacaggttatccacttgtaaactgctgatctcattgggacattgtccccataaactttttgtaaagtatcaatgatttcacattctttcacgaagcttcttcattaatttggtgtttcttctttcttgcttcaattttagcagaattcatgttgctccaataggagctcttttcaaacagatttcttttttttttttttttttttttttttttctgagatggagtttcactcttgttgcctaggctggagagcagtggtgcaatcttggctcactgcaacctctacctcccaggttcaagcacttctcctgcctcagcctcctgagtagctaggactacaggcatgcgccactacacccagctaatttttgtacctttagtagagacggggttatatcatgttgcccaggctggtctcaaactcctgacttcaggcaatccacccacctcggcctcccaaagtgctgggattacaggcttgagccgctgcgcctggcccaaactgatgtcttatccttcttagtgcctcacaccagatcctgttcagacatgttataacaaattagtatgagtttatttttgcacaatttttgacatctatgcatagtttttcacaatacacattttccttaaagggtttgaggacccttttgtgtgactgcagacgcttctacagtctgtgacttgtcttctccttttcctaaaggtggctttgatggtcttttaaaattttgattgaagaacaacttaccaatttaccagtttgggttaattttgggttaacgctttttgtaccttttctagggaatctttgcctatgtcaagatcaaaagcatgtcttggcctagttcataatgttagagggaagctgcaggatttctgtccatgcccttcgtgacacggaggtagatccaggtaccagtcgaattgaaattttcggtctgcatctgtttagatgatcatatagatttctcctttacgttaatatggtaaaaataaaatcactgatttttgaatattgaaccaatcttgcattctagagataaatattcctcggtcataatgcataatccttgtgttatattgctggatttgacttgttaatacatttggccctccatatctacaggtttctcattcacagattcagccaacctgagatggaaagtattcaaaagtaagataaataaaaaatgaagatacaaccataaaaaataatacagtataacaactatttacacagcatttacattctattaggtatataaataatctagggatggtttaaagtatatgggtggatatgggtatactatgcaaatacatactatgtgcaaatactgtgccattttatatgagtgacttgagcatcattggattttggtacccacaggggctcctgaaaccattcccccgcatgtgcatgtcaagggactgtaaagatggtctctgacttaaaatatttttactttaccatggtatgaaagcgataccggtaagtgctcaacttatgatggagttacatctggatgaacccaccgtaagtcaaaaatcctataagttgaaggcttagctggacatagccctatcgtaagttgaggagcacctgtattttgttaagggtttctatgtctttgttcataaggaatatttgctctgtaatgtcatttacttggaatgtcttcatcatcaactctggtatcaggattatgctggccttggtatgcaggagccaactcaccatggcccccaggggccaactgtgtgcatctctccccacctcacacaccagtgtcacgttggtagtgacgtcagccatggtgcaagtatgtacatcactggaattggcaaacactgcaaatcatacgtttcccccagaaagctaattgttaaatatttaccagtgaaccattggctggcctcataaaacaaatcatttttcttcatcctctattttctgagtttgtgtgagatttataatatctcttccttaagtgtttgacagaattcaccagtgaagccagctgtgcctggagtcttccttgtgctaatgtctggttgttaggaattcagtttatttaacagatgtgggtctattctctttcttctcatgtcagtttttgttagttgtgtttttctagggatttttctattttatccacattatctaatctattggcataaagttgttcataatactctcttattacccatctaatctttagaatactattcctgatgtagaaaatgtgtgttttatcttttgttcttgatcactcttgctaagggtttatcaactttatttatgttttcaaagagctaacttttggctgtgttttctctattgtttgcctattttctgcctcattgctttcttttcttaccattgtttttctcttccttctacttgttttaagtagagttgagtttaatttgctcttattttcctatcttcttagatggaaacttaaataactgattttagacattcagacctttctgcttttctaatataaacatttaaagctttcttgggagcactgctttagctgtatcccacaaattctgatatgttatatttttatttcatttcactagaaatatttcttggcttccattatggtcttttcttgaccccatgggatattcagaagtgcattgcttaatttccaaatattgagggctttcctaaatatcaaataaatttcttagttaattcttttgtaataatagaatatactcttaaagattccaaacttttgaaatgtattgaggcttatgttaaagtataacatatgatccgtcttagtgaattctccaaatatttgaaaaaaagtggatattctgcagcatttggtgtagggttctattaatgccaattaggtcaagttcattggtggtgttatctatatcttattactaatgttttgtctacttgttctatcaaagactgagaaaagggtgttaaaatctccaactatgattgtgagtttgtctatttctctctttaattatgtcagttttgtgtatggtcacatatttttaaattctcttattatgtgctacatatttttaaattctgttattatgtgctacatatttatgactgatgtcctgatgaaatgggccttttttcattgtgaaatatacctccttatctctgttgatgctacttgtcttagaccccaccctgtctggtatggatgcagccaccttggctttcctgtgctcactctttgtgtcacacgcacctgtccatctttgtaccttctaccaccctgggtcttccaagtgtgtctcctgggcacagcatgctgtcgggtcttgcttctttgatccagtgtgaccatttctgcctctgaacttgagggtataatccatctacatttgatacaattaggatacgtatggttcagtttaagtctaccatcttgctatttgttttctttttgttccacatggtttttgatcctatgttctactcctatcttcttttgggtaaataaaatgttttttagtattttattttatctcctctattgacttattataaataaaactttttagtcgttgctgtaggagttacaacagcatttttataacagacccttttacaattattaatcctgaaccactttatatacaacttaagtttatagcagtataatttcagaggccacttaaaattaatcctgaatcactttatatacaacttaagtttatagcaatgtaatttcatttactcaccccttgtttttggtgctattgttgacaaatacacttacttccacatatgttataaatttgacaatacttatggactcaaaatgtttacctttttcaatgcttttcattccctcctatggatattaaattacatctggtttcatttcactgcagcctggagaactttatttaatatttctggtagtttatgtctcctggcaatagattttcttggctttaaaaaaactcaaaatgtctttatttaaccctcatttatgaaggatagcttttattgaatatgttgcttgacaagctttttttccaaactaagcacttttaaggtattattccattgtcttcaggaatccattgtttaaaacgaatatcagctgtttccctgtgcctaggtgtcctttttctctgactgcttttaagattttctccttcttttcagtttgtggcagtttaccatgatatgcctctgtttggttttcttcgtatttgtcctgtttcttacacctgtgcattaatatttttcaccaaatttgggaaatatttggttattagtttttcaaattttttgctacctttttctctctctcctctttttgggattataattacatatatattaggccactttatatgttagttccatatattaacatataacatatattatccccacaggtcactaagactttattctttttatctattcttccaactggataatttcaattgatctctcctcaaatttactgatattttcttctgctgttaagccacacagtgaattcccatctgttcactcacatcctcaaaaatatttagaatgcattccaaagttcctgtctgcaaatgtcaacatctgtaccgttgcaagttctatttctatcttctgcattttttctttctttttttgtatttcaacatgtgtatgtttcatgtgtaactgctgtactgagatataacttacgtaccacgcagttcgctcacttaataaaagcatcattcaatggtgcgtggtatactcagagctgcgaaactatcctcacagtcaatttaagaacattttcatcatccccatcctcatgcccggcagcactccctcatcccctcccaggccctggcagccgagaatccactctgtgtctctgtggatttgcctgctccatgcatcctctatcaatggagtcatcggtcttttgtgtgtggcttctttcgtgttatatcatcttttcaaggctaattcgcattgtagcatgtgtctgaacaccactcgtttttaaggtgaataatactccatggtgcaaacagacttcgtgtgcccatccgttcctctgctgatgagcatttgggttgctgggaccatctgggccatctgaaaccccctggagcctgtgctgctgattctgacatcagtggtcccgagcacacacttggcaatcctgaagtctctgatagaacagcggctggcatcacccgggcacctgccacgtgccaagcatgcagctaaatgtcactcacgtggccccgcctgacctcacacagatgggctgggccgctgatggccccgtttgtcagatgaggagactggaggcagctccaggtcacagagctgcgagataacaggcaggagcccccagcgagtccagagctcaccctcccaggccccacctcccatggcctgcatcttcaatttccaggtcccaagcagctcaggactaggctgcttctggcttctgggtcctcccgggaagtcacagcctggcactgagaccaccagtcccagcatctgttttcccagcagccccgtgctggtgttttctgcagctgcatttgtgttctgttggcaaaagaggaacctgctctgcatggtcccaagcaacggacgggaatgtttaacttgtgtattgatctggcagctctccagtgacttgggatttgccacaataattcactttccacctgggtttgtttgtttgtttttgagagagggtctcgctctgctgcctaggctagagtacagtggcacaatcacggctcactgcagcctccacctcctgggctcaaatgatcttcccacttcagcctcctgagtagctgggactacaggcgtgtgccgccacacccagctaattcatattttgttttttgtagagacagggcctcactatgctgcccaggctggtcttaaactccctcctggcctccagcaatcctcctgcctagggcttacaaagcactggacctacaggcgtgagccaccacaccagcctgtctgggcattttgacatcatgcagacgcagcacagaactgacctgagggatccaacagctcacccgccctgaggtttctgggtctgcagctgggcccaggcctgcagtgcacacagctgttcccagcacgtgcctgtcccttcgactcagtgcacacaagaaaccagatgagcccacgactgctgggaccgaggctgcctcgagtcccccacaaccgaaatgtcccctccagacagaggcctggaacaaacaaggctcaactaaaaatagacttaagcatgagagattcagaggaaggcagctatttttggtttggtgtgtttttgcaaggaaagatgagaaaaagaggctccctcgaggctggagagggaagtgtgtaagaggggcacaggggacttggggagaagccacagctccttttgtctgtcctgggctgactcgtctgcctgaaatgttgaaatcccgacccccaggactgctaggggagctctagttggaagcagagtccttgcagatgttatcggttaagatggggtgacactggattggggggacctcaaattcagtaactgtccttataagaagtgggagatacggagacacaggtagaagccacgtgagatggggtgacagtgatgcggccaccagccaacggcagcagatttctctggtcgtttctctggctagagaaataacacctccccgagctgcatgtggtgcagcgggacccacacggtgaccccggctgtgcgtctgggagggcggtgggtgctggacccctccccaccaggagatgaaacacgtgcaatgacagcaacccaggcaagtccccggggagactcagagccccgggcggggaagggtggggaagggctgtcccaggaggaggcacttgccaaagaggcagtcgccatgctgttggctgcaggtcggggggagactgagacccacccaggtcagcaggggctgggagcgcgggtcagcagaacgccccagggaaaccgggtgggtgcagcatctgggaggggatttgccctgcgaggctcctcgtggggccctttaagccaccaggtctcccagtgggatcagagcaggatcccatggcctgaggtggggctgcgtctggctccagcccccacccctcatctgtgcccacgtgcaccccagcccagaccacgcccagctgatcacaggccgggcgagcttgaaggtgcttggagaggtcagagtccagccaggctgggtctcagagcgacccccgtctctagcctcagacaaggtgcccctctccagccctcagacactggcctggcctgatgagagggacatggctggcagaggtttcttcccaggtttgatcagagccagagcaggggaaagtttccctgttgggggtgtcgatactttgggaaaatgggttcctggtcccaaggttgacgtccccctggcagagtgggccgcaccgaggtcaggacacgaagggtcttctcctgggtctgctggagtcgggggcaacctgcagccttaggggtggggggtgcgggtgtcatggacgtcagccccacctcctctcctgcagccacctgaggcccacccacctcctcatccctgtgcccaaacccgcaccctggtgcccagcacttgggggcgcccacagatgtgtccgtgaccaccttgggaagtggctatgcgtgtgccgcagccccaccggggtggctgggaggtgccctcggaatgattcatgcagtgacttccctgtggcctggcccatggcaagtgctctggggacgtgatggtggtgcagggaacatcgccccgggcctgcagctcccgcccacgagctgtgcccaaacctcccctcaggcctgcagctcccgcccacgagctgtgcccaaacttccgctaaggccttgggcccagctggatgcagggagcagggggtgcgctgggcagagaggggtctccaggcagggaccttaaaaaaggatcccttccgtgctgccggtcaggcccctccaagtactctctggaaaaggatttcaaagtccagccccgtgccgtccacccaggcttccctgagagccacgccccagggccctgtttcttgagaaaatcccagcatgaaaaacagttgggaggaaaacagtttgctgggtctccaaggcccctcggagagcaccctcccgaggaggcctctgagccacctggtgccaccggaacagctgcagccgcctggagagccagagggagccgggtggggcccgggggtggcgctggcatcgcggaacacccccgcccgcgttccaaacgaaagcacatcacccccaagcgacgcgacctaggggcgagttttaaaaggagcacttacttatttttagagtgtgcttttcactcaggatcacacgacggagctaaattgcaataaaaatagtgcaatcccgccagcaagaagcccattcggcaacgtgtccttttgttcaaaataaagtgcaaaatgatttctcgcaataacaccagcaaccggcttcaaaggccagctgggttggctcaggataaatgactaagcgtacgccgagccctgcggaggaagctcagccggccggggctttgctccagagcttccttttccaaaacagatgcttgggaccaagatggagccagggaagccgggttgggtgacggcgtccgggttcctaggctggcaggctcggaggccagagggcaggcgtcccttcgggtactgactcctggggcaggcaacagattcctcctgggaggcccaggcggaggcagcacagcatctctctgttttcctgcaggccgacggggatcctcagtgtggtccgctaggaagatgagtgagccccagagctgagtgtgtttgggctgtggattgtgatgcagctggaaaaacacaaccaggaccacccagcaggaagcacaggaagactaaggcacagagagggtcaagaactggccaaggtcacacagcaggtgtgtggggagctgggatttgaacccagctccagagtgtgtgccttgacccctcactgccgtccacaaggggaccaatgagggtcccttcccccagcaagtgccagacgagtcctactttactgctccttgcggtgctcccccctcggcacacctgagccgcctggagccactcgggcaaacctcaggcgttccactccgataagggtgtcagggaagagcgagggactgtgcttcagggggagagctcaggctgagagaggagagccaggcccgggggtagggtggcgaggggccacccaagggggccacaccacctccctgcttgccactgcgggctggacccgctctgcccgcctatctcctccaccgcctgggagaagacccatcctgggggcccagagggtggggcagggtggaagtggcctcggtcctctgctcccgagagtcctgcctgtgcccagtgtggctgaagtgacccagagcccgggaggacgtggaggacaaggctggcccagtgcctctcgagtcctgggctttggcttctccagaagcagcccctccacagaggaggcctctgacgtgtccaaggcctcagctatgtcccaggaaagcgggtttctgggtgagctattcctcctctggggagaatggaagccagcctgccctatggggctgaggtggctgagccagacccacaccctgagctgtcccgtctgggacgtgagcaggactcttggagaaacaacccttgcagatgctctgtggatgacagtgaggggtcatggcacacactctggagccaggtggccagactcaaaccccagctccctacacatgtgctgtgtgaccctggacctgttctttagcctttctgtgccttagtcaccgcacctgcaaaacgaggctgcagcagcttactcagagaggaataaaggctgaggacctgggtctttacctgctggctctcctggccccccccggggctctgagacacaaagtcgcacaggggtgggtcccactggaggaggggtcagtgtagaggtcccattttgctaatggataaaactttttctcattttgattaataatgactaaaaactgtgtttattattcctttgttttctgtcctgctgggacttcagtcaaaaaatgattctcatagactctgagtcaaggtgccggagggacagggtctttctaaacggcatttcgcaaggcccgccggaggaggtgcagtgccaagatgcaaaacagaaccagcaataattcaactctgaatattttgcctttaattacaataaactaataaagatttcagatgctctcattttaatagaatgaggagttataattggtgacctattttaggcaatttaatttccaatgacctgttttccaaattaacatagtaatcaaggccagggtgccgttcagggagtcagaccctccaagggtcccacacctgcaccgcgtacaggcgcatctcttactaacgtgctcatagaaggaggtgctaaattatggaaaggttcctttctacagcatctaatgagcctggatttttaaatcaaagcataatcaaagaaaatgagcaaggacatcttgagcatctgtaaaatcactgttgaagccacaaccctcaatgacttcgaagctcttctcaggactggagtgtatgtcctccccgaggtagagatcgctctcagaggctccttcaaaaacccccaggcaggagggagggtgagtcgcacacctcggcctcaggtgccctcccgctgcctcccagggaccaccgtgcagggccaccaagaacaggcaggggggagggggagcaaggtggggaaggtggggcagaagagagaagcaggaaggagggagaggaaagagaagagggagatggactggcctcagccaccccggagtacagggatgtcatcacaccagccctccagcggctgaaagagccagtgagaggcaggtgggggtgtggatcaggcctgatctcccctagtctcctcctgcaatgcccagattcttgcccccgtccttccttctccctcctcccttcctcctccctcctcttccctccctcctgcttcctccctctgccctccctcctccctcttcctccctcctcctccttcctgcttcctccctctgccctccctcctccctcttcctccctcctcctcccctctcctctttcctcctccctctcccttcctcctcctcccccctttcccaccctcctccccctttccctccctcctcccgactccctctccccttctccctcttctcatcccttcctcctcctccctcctcccttcctcctcctccctccttcctccctcctccctcctccccacactgtccatttgcaggctgcctggtcctagcccatatccaagggcctgtctcagctacaaagttctgctctctgcttttaaatgaggacacaaggtggtttccaaaacacatgtacaaggcagaaattgctcttgaaacagcagacaagcaagacacagccctccctcctgttcacattagaggctgcaggcaaccccagttgtctcagaaatgggaacaagccccctgctcagcagagctggtttcccatggatagagctgttggctttctggaaacctttttctccccaccctagaccccaaacatccttggggttgtgtaagaaggaaggggatgtcccaggctggaggctggcagggcagctggaatacgggagtgggaggggagggaggaggcgagcagggagcagggccagttctcctacatgccttcttccggcctcttcttccccactcggggttctcacaggtcccgcccttggtgccagtgatgtctcttctgcacctgctaaagggcagaggggccccttggaggcagctccatccaggcctggctgagatgtccaagaggcagcagggtacaggggtgcaggttaaccctgccccagagtctctgtccaggagcagcaggagcaggctcaggacggcttcagctccatggctgccctgggtggaagtcaggctggatacagaggccaggtctacggaccctgcaggcctcagaggaggaagttctgttttgggagcccactggttcctggggcccatgagccccacctacttcccaccagcagcatcttccccttgccccactgcagcccctggacacagtacagcacagggcggagtgagggctgggagggcctttgtggagtcccactggcttcaggtgaagatagtggccctggctgaccccaagcctgatccccagtgggcctgctcctctcttctcaccccgccacttctctgggccttttccaagccaaactctgctccctcattcaataaaatctctcccgcaagccagccccctgggcctccacccgcccatggcctccgcagtggccaggagcctgcgggagaaggtggcatctcttcccttccgtaaaatctccccgccctatttacaggagaaacaatgctctgtggctcccagccagccctgtctcccctgaccttgagcacctttgtctaaagggatgccctccttaattctgtgctgagctggattaatttttaaagatgaagctcctggctcgtgtgtgctgctatttgtggtggcgaggtcaggcagagtgccggcccggggagcaggaggtattagcgggcactaattccctggggacagcaggccgggattatcgctgtgtgcccagcccttgccagccctgctggctgccagctgctggcaggggcctcactgtgccaggctggtggcagcccacagtgcactggccacatggagcgcactgggtcacggagctctggattcaggtgggattatgccccccaccgccaaagccatccttcctggcagcaaaggcctgtgggctgtggctgcacctctttcctgggtccagtttccccccagggattcaaagttcctggcccttttgtggctagggtgaccacagatgactcacttggggcgctagctggggaggctaaggagtcctccatcagccccccagcgcttcctgcagagcccattgggcgtcctatgacggagggccctgcaatgatgccaggtttcaaggtgtgcaaggggaggctcctgccttgggcaggtttgtctgtctagagaaataacacctccctgtgccaacaacagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagcgagggaaactgacggggtgagatgcacgttacagcagggagggaaactgacggggtgagatgcacgttacagcagggagggaaactgacggggtgagatgcacgttacagcagcgagggctggaagagtgcagcgcaggcgcctggtccctgggcttctccaaaacagtgtagtgtcagcctctcccaggagctcctcagaaacagaatcctaggcctcacctcagaccctcttcatccaagtccacattttcacaagacctccaggcaactcaaacacacatttatgtttgagaagtgctgctgccctgttaggctcctgggggaggtcagtcctagaggtgggggccttgcagatgggcagagccacgtgggaagcagtgtgtggtccctgagccagagggtcatcagggcctgaagctcccccaagcacaagagggcgccggtgcagccatcgccccatcacactcctcctttagaaagcaaaagaggccgggcgcggtggctcacacctgtaatccgagcactttgggaggccgaggcaggcagatcacgaggtcaggagttcgagaccagcctggccaatatggtgaaaccccgtttctactaaaaatacaaaaatttgccaggcgtggtggcacatgcttgtaatcccagctactctggaggctgaggtaggagaatcgtttgaacccaggaggcggcgcttgcagtaagccgagatcatgccattgcactccagcctgggtgacagggtgagactccgtctcaaaaaaaaaaagcaaaagagctcccaggaaggtgctcacgctcctgaacgagggtgggaaggtgcccacgctcctgaacgagggtgggaaggtgcccacgctcctgagtgagggtgggaaggtgcccacactcctgagtgagcgtgcacatgcttacaactgcgtttcccctgctcaagatcctcacagcacttagaggacaggagggttgtcagcgctgagtcctgatcacacaggcttagtgttcagcaggtggttggggaacacgtggatggataggtgaatgactgggtgggtgggtggaaggatgaatgaatagaaggacggatgggtaggaggataattcaggggatggatggatggatggatggatggatggatggatggatggtggatagggggtgggtgggttgtggatggggatggatggggatgggtgactggatggtgaatggtggatggatggtgggtggggtgtggatggatggtggctgggtggatgagtaggtgggtgaatggtggatgggggatgggtgaatagatggtgggtgggttgtggatggtggatgggtggtggatggtggatggattgtgggtgggttgtggttggtggatggatggtggatggatggtgggtgggctgtggatggtggatggatggtagctaggtgggtggatagatggtggattggtggtggattgatggtggatgagtggatggtggatggaggattaggtgggtgaatggatgactttagtctccagagagtaagaaaagcaagacgaactctagtacgccactggtgggaatgtgaaatgtcataggtactttgggaaatagtctggcagttcctcaaaacctctggggtaggctgtgaggtccctcccagggctcagccgtggggccccatgtactcaggtggtgctcacccagccctggggggcattcttttggggtaaacacagttacctcgtgacccagcaattctgctcctaggcatgtagcaaggaaaaatgaaaacacgcagccatacaaaagcacgtgcacccacgttcacagcagccatacaaaagcacgtgcacccacgttcacagcagccatacaaaagcacgtgcacccacgttcacagcagccatacaaaaacacgtgcacccacgttcacagcagtttcattcatgacgagccgaaacgtggagacaacccagatgtctatcctgatgaacagatcaggaaaacggggcacacccagacaaagggatgtgatagggtcacaaaaggactgatgtgcagattcatgctacaacgtcagggagcctcgcaaacgtcgtgctcagtgaataaacagacacacacgacagcatgtatcgtgtggttctgtgtgtatgacacatccagaataggcaaatccttccaaagagacagaaggtagaggcgcggtcgctgggacagatgtggggacgggcaaggtaaagcagcacagaccttcctttgggggataaaaatgttctaaagcggatcaggggtgatggctgcacgggcctgtgactatgctggccgggggccggggcgggtggctcacgcctgtaatcccagcactgtgggaggccgaggcaggcggatcacgaggtcaggagttcgagaccagcctggccaacacggtgaaaccctgtctctattaaaaatacaaaaattagctggatgtggtggcgcacgcctgtaatcccagctactggggaggctgaggcagaagatttgcttgaacctgggaggcggaggttgcagtgagccgagattacactactgcactccagcctggcgacagaacgaaactctgtctcaaaaaaaaaaaaacattaaaaaaaagtgaccgtgctaagaattattgaattgtgcggtttgaaagagtgaagtggggcatgtgggttgtatctcagtaaagctattagttacccaagaaaagcacagaaagcgagatggtcaggcccatcaccctgcttcctcccaggggcctgtgggtgaggctcaactcaggagctggggaacaaggacaaggccctgggccgggcgtctgtggggccaccttgcaccatgctgccagccccagcctgctccgctcctcacctctgggcctggccctgcacagactgggtcaccctcttttcacaaggcaggacagcactgtgcttcctgttcagcccaggctgtccatttcccaccagagggaggggagcagtgagcccccccccaggggctcatcagattgggggatcccatgtgcccagggaggcaatctctgagccccgcagccctggcctgtggaagcagcctgatggccatgcatttcagaaacacccactaggagctgggccacacctctcgttaaaagctggacagccaaggccccagggctggccctgggcaagtctcctgtcagctatgggatccactggtagggtctacaggctgatggagccaggagcgggcaaacatcccactttggtcccagagggcactgtgcagcttctgccgtcacaggggacattcccaagtgaccagaggggacatccaccctgagcagctccactgttgggggcctcaggctatgtggctgggctgagctgccagctcccaaacaggacgttggcctcttctgacatccaagctctggcaggggcatgtgtcctgctggatgggactggacaatcctcacgggctaggggaagtatagcccagggcagccaggggaggctcctctccatggagggaggaccccaaggccagggtgctttcctgagcactcaggactgccatgggaaaagcaggcccctgtcagccgtgtgcacagcccctcccacacctgcctgggaaaagtgaggccttagagcccgggaggcaaatctgctccaaccctggaggtgcagagaccaaagccaggggaggcttgctgaggacacctgccgaggggccttgggatctgggccagaactgcagcatggctgggagcccctgggcccatctggaggaggctgagtggtaacaggcgccctagcttcacactagccacccactgccccccactcagtcacctcctctgctgcccatactgagacccggtggctcaaccaagactttggaaggacaaaccggtggtcatgggtcacgtgcccaccgttcaaggccccaagaagccccctccattgctgctctgtcccggaggttcctgcaaggaacacaccttttgcttccatggtgacatttgcggtgctgttttaggcttttccgcctctttccttcacagggtcctggggcaccacaccagggaggcctggccgggcacacacagaggacagtgggaagtaagcaccagggcccggcctcctgcctgaggggtcagccagccgctgaccacgtcctgtagctcctaacgtaagctttgcacccaagaacaaggggcccttccagcccctgactccccagttaacccccaaacactacagagtgttggccacagtcacacacatccagccccaggagggcctctgcctcctcccttgacctccaagtccccttcctgccattccctgccctgggtgcccccactcccgcctttgactcaccccatggccatttgcagacgtggagcccctggcaaggttcacctgcgccaggatcccaccacctcctccgcctccagtggccatgcaggcccgctgaccacatccctactgggcacatgttggaccccaaatttcctgtccaccagaccctcagactatgagcttatctggaataagggtctttgcagacataacgaagggaaagatactgaaatgaggccaccatgcatgagggtgggtcccaaatccagtgagacagagaagcagagatggacacaaattcggagaagaacaccacgtgaagaggggagccgaggctggagcgaggcagccacaagccaagggacgcttggggccattgaaagtttgaagaggcaggaaggacatcccccaccaacagagctcctggaggaagcaggccctgtccacaccttgatttcagatccttgatctccagaacatgagggaagaattttctgttgttttctggctccctccacagctcttagcgctgtggggctgcagactggtctcctggctaaccagagagcccgtgctgatagagccactgctcagccctgcctgcacccagcatccagcgtggggcctggaccgtcattgtgtcctggtagatattggtcaaatatggaatgaaagagccttggagtcagacacagggctgaacgagtccttttcaggccatggtctaagctccacacggcacctggagcaccgccgtggcacccgctggggtccacaaacacctcccggcctgaaaaggggaatcccagcctttccatgatctctggagatttgggacacttgtgaatcatgcatcggctttacaggacgctctggggcttagggagttgacaggtcaacagtcggatagaccgtccagggaagctcccaggaagtggagcaagctcgggcgggcagatgccgggtgtctcctgggacctgctgcaaatgccctccccacctgcccaaccccaccccctaccccagacagagagcatagcccctgcctgccaggaagggtgagcgcccagcacaaacagattcagggcctcccgctgccccagaggacctctacattcatcaacccttgacgtggttttcaattagcgtggaggaaccagggtttatcgctcttctccgtcactccatttatatttaatgcatttattgcccacattctatatcaggaacaactgcctagaggctgcccatccccagggagcagggttttattttcctttcctcgcaatcgatcagagattaagttgctgtgtagctttttattggagacacacatttgctgtgtttaacaggaaaccagagaaggaagctcagcgtgggccataaatgattttgcttccattgatcaaagaaaagactgcccacatcagtcatcatcacccaatgcactctctgagggcaccctatatatgctcaggcacacacatgcacacgggcacacactatccaagaggagagagagccttgagatggactcaatggctcctggacactaccctcggctcccccacagcctcctagtggcttcaccaggggtggacatccagactttgtcacagctgaaagccccacctggcctgtgagggagcatctgcagccccggacagctgccctgaagttggccctgtgcagaatggtagaccctttggacccacattggtccatggaatggcagaagcctgttgtccttccgctggctggggcctgagcatcaaagtcatctttgcttcagaatcaaggaacctgggagggctgaaagccaaccctccatcccaccatgctgatggcggccacggctccccagtgactcaggtttggggatcctggttggtgataatgaagtgagcagcacaggatgccctgccagggccaggggtctatgcccccatgtcccctacccctgagcaggtgagctggtaccgagacaggcagcaggtgcactcccaagtctttgagacgctgctggcaggaagtgttcccttccggatctgtcctctcacgcacatgagtgcgcacacacacacacaggcacttgccatggcacagagacatgttccaccagaagcctgtggactactcgcttgggctttaggggaggaaaagggaaaagggaggaattgctaggcaaccagccaggggttgctatggcattttcaagagagcggctgggccaatcaaggctgactgcaggcaggcggaggcgggagccaccatgtcacagcagctcagacagaggggagcacactgctgcacaggcctggggagggctggcgcctcatgaatatgcatcaggctgattgaggcaaagtcaattaacgacttgacggcttgatttcccctggattctactcttctcctttaaccatttggctgacacagggcaggctccccgctttcctgctggccccggagttttctaacaggtccaatttgctttcctaatcctgacctggcccaggggtcctggcattgcttggtgctgtttctactgaaatcttctgccacctatgcaggcagccaggtcgctggtcccacagtgggtcccttggtgccctggcaaggcctgaattcctacctgggaccaggcacagtgcagcagctcctgcaggagatggtccagttaccccccttggacagttaccaactagcgaccacaggcctggccgacacacatctgggcaatgacctcacaacccctgggagcatctaggcacaaccagttttgtgggtggcggttggagaaagctgggggccagcccagggcaggatctccttcctgggctctgcagcagtttctcatctactgcagtggggttctggccagagcagtcagaaagcatgaaggaggcactgctcgcttcctccacgtgactcctggggtgcaagctggggcagggaccccggctctgccagaacccccagggggctagcagggtctttgctggattatatttctccttcatttcattgttctccccagtgaattctggggattctgagaattccattttgccctgaatcatacgcagctcttttgacagcttcagaagtggacgtcctgttgtgtgcagcggggagaatgtcaaccctatgattaacgccccacatggtggtgggaagaggctgggatgcctcaagtcccaggcccagaggatggtgggcctcacaaaacttgggtgcagggtgttgcagaggtccgtgcaagaagggaccccgaagctggaagctaaccgccactggcttctcaggaagtccccttgaccagaacccagtcccagacatatgaatcagtagccaaagagggccacaaactctgggtgctggccccgtgcctggctctgggggcagagacacacgggcccttagggctgagaactcaggtggaggggtctggggtgggagggttagtggcaaggaatgcacgggaagaacacagtcagcggccatggacctggatcctgttcacgcacctcaggcccacacggtgggcaggacgggttagagccgccacctgggtccaatcggccgggtgggggcagcccaggaaggtgttcccaggagcagaccccaggttccctgttgcagcccatcccgtggcccgcaggctgcctaatctccctgctgcagctcccatttgcttggcctgcagaaggttttcaaccacagccgagcaaggtccttaggcaccttcaaggctgagacattcgcccctgatccactgactgtgggctctcgggagagcggccacacccctctcaccatcaacagtcacctgggcctggccctcatgggagacagactcggccagcacctcccactgccccctagttgggaggaaccccactctcacctggggctcccgtctgcaagctccaggtggtaggaccgacctgggtcactctcgaaccccacactcagcttgtggcccccacacatgctcacccacccatcgccgcaaccgtttaaagagcaagggcccacaccgcacactcagagcagaggcggccttccgaagagagggcgggcacacatggaagccactctcttcagcactgaactgaaagacccgggctgccctgagcttgggatgcgggaggcacctggacaagcagggagggcagagccactcacagagctcagggccaagctcatggccagggacaacttctctgggtcctgctgccccgaatcctccattaggcctacaatggacaagggaggcatcacccttgaacccagcttttgagagagccccactcaaggaaggatgagagcgagcacctcctgtccctccccggccccaaagccctcgagctgccccttctgcccaacacctgtggtgcccctgcactcagtaggtgcttcatgtatgctccatggacagggaagtgaacacctgggcatccgcacaaggaggtggcacgcacttatattgggatgagggacgtgtacttccaccagaggccggggctgcccatcggccagcatttcccaaagtgtatcctgggtcgcacctcgaagttgctctgaagaaagaccagggcctcctcctggaagccggtggctcctgggtcttcactgctattgttccctccacatgggagggtgggggctgccaccatgtcatgcacagggtgcaccctcagacagcatgcaccccagggcacacggcaaacggcagagctggcctccaccagggctgtgcggggctgcactagatccagctttccggggctccagggggttcctcaccagctcctctgaacacgctacaggcccagttgactgtcactttcactgttagggagcatgaggcgttagaatcaatcctgtgacaccactgtgttgtcaggaacgggccgtgccaaggggcaccactaggtcaggcctcaaggtctcagctccaggatgcctcacccagagcaagacccaggctgtctgcaggacaaagacgtcggaaggaagaagagggagaagccaggaaggtggaggtctctgagaagatgtggtgacaccagggcccaagggctccccagcttatggtggagggcactgcctgtcttggtgtccatgaaactttggatgaggaacagcaggaggacaggacccaggcaggagcttccagctcagggaacgacacgccaggtggaaagaacggagccccggacgccgaggacgggaacaggatcacgggcacctggatgcaccaggagggcgagagaatcaggaggggaaaggaggaagaaggccttcagttcaggaggagaagggccttgcaatgcagagacctcgcagacgcgccgtcggcctgtggccaaggtcaacacaaatgtgcacggcctgggctgtggcatggaggccttcatctctctgctcttctcccagagacaaattcgctacaggacatccaacagggcacccggccactcccctggaggcccaggtcaccatgcacagggccggtgagaccacggggacagcctcccggtctttcctgcaggggaagactgggaatcggctgctcctgcagccccagtctcatcatctgtgaaacaaagacaaggaaacccgttttatagccacagctcagtctttgactaagtcacatcctcattgctcctgtttccacagagcagacaccgacgtccagacatccagactggctgccaccagctcactggaatggccagcccgtcccgccgaggccagtggacatgccaaatccctcccgcaacaagttgctatccatcccctcgactaatacttaccaaattaattccagatttggagtcactcatggttcccaccagcactcagccccatctcagcccccatctcagcccccaccgcagcctcacctcagtgcccacctcagccccctcctcagcccccacctcagcccccacctccgcccccacctcagcccctcctcagcccccacctccgcccccacctcagaccctcctcagcccctcctcatcccctcctcagcagctgctggaatgggctaccctcaggagttggcaccccacaggctccttcccttcccacctccgccacaccctgacgagggaaaaatggggagctgctgggagggaacttgcaccctgttgggcgccttgtatccccagcctcctctcacaccacaggctgctggggccccgtcagcggagcacggctgcagcgaatgttgaaaccaccagttcccattcctagcagggctgaaagaaggaggacacctggaacctgctttcttgctgctgcccttgggggtggcccactctggcagctgcagcctcgaacctggctcactgaggggtgtgtgggggaactggggggtccctggggtcggtcctaggaggaaaaggtggcagttgtccatgctttctggggacgcccagggaaactccgccctgtggagaccggagcttggctcagcccctccctcctgccctacctctgtcctttccagccagtggcaacaaagcccaggtgtgaggcgcccctggcaggcgtctgggcctggctctgaggggccagcgggcatgggaggggctggcagggcggcccttgtgttctctgctttggaaggagatagaacagtggtgccagcccacccgcagatacggcggcacgcagaggcctcatctgccccttctgaggcaaagcctctggaggagccccacaccgggccccccaggcagcagcacctcctggtcctatcatgtgagacacacagcccgagaggacgcctgaggtccggcggggacagcaggaagcattcagggaaggcgctccccaagatggaccatggtgaggctcccgccccgggtcctcaggtgcagctggctcagggaaggcgctccccaagatggaccatggcgaggctcccgccccaggtcctcaggtgcagctggcaccctcatttcctgggatgtgagacccacgccctggatgacgtccctctgtcctcttcacggtggctcctgccctgtgagaccccagaatcttccagagagactccacagcctgcagcgagcctgtttgctgagctcctggggcaggacagccagaccccgaccaccctgatggtaccactgcagctttgcgaatggcatgtcccctccaaaacctgctgcccagaggggaggagaagggatgcaaggcaggttccaggtgcttctgttttgaattaaaccaaattatgaacaaaacagccccataggaagggccttgggatggcaccagccaccacccaggcctcggcaggccccagccagggacccggggaccccacgtgccagccctggggcagtagcatggcacagacacagcagtgagcgcctccgtggctgccccacccagcctggagcttggcgccctgcaggcatggttccaggtccctcttcagagctgggaatgataagcagactgctgggaccccatcctcacccacacctgcgtggcgggactgctggctgccttgatctacccctacaggggctgatatcctgtggcaccccaagccccccgatgaccctcagccagccagcacacaggagagtccccaaggctcggtgtaggggccctgcaggcagtggtgagatgcagggtctgcgtttcccaggccgggcagtgcaaagccaggagcaaaggcacccctcaccatgtggcacctcctgcccctgctggcagagcccacagatcccaggcacaggatggggagggcagtgtggctccctcccaggcctcagggagtacagggacatctgggcagagggtgggcaggatttcaggcatcctaccccctgctaagggaggcccccggaaatcaggaattggggcctagggagctgagcaagcctggtccattctctagaagtttctcctcctgcagggctggaaagataggttgctcttctggtctgttctctgtaaatgctcccccaacatccctgggtggggtttcctcttcccaaagcctgcagggcctgaagggtgagcccctcacttggtctctgcagcctccatcgtcaaccctcagggctcctgtcctcctctccctgcaccctccctcagcattaggtgggggttcctgtaaagctctggggtcagggtctggccctcaagatccctgtgaatttggcgactgcatcactcttaccactgccaccttccctgttctgctcagggccaggttgctccactctgccctagtctcctggggcagctctgagcttctgcacagtcaccttcggaatgcaggcacctcccagtccccggatctcccagcactgtttcacccctcgttgggtggagctcaggaagggcctaagctctccccatccctgcctctcgccccacccctgcctggcatcctcaacagcctcactggtcccccaccagaaggctcttcccttccatcaacctgcacagagactgttgctggcgggggaaccagggtgaaggtgcctctctgggctcccagagtttcttgccctggtctgaggggcaggaagtcctgccattgatgccttccctcccagtaaagacaactggcaaagaaacagatggtgcccttgagctgaggattgcaggagggtttaacaagtgacacgggcagttgtggggaaacccagggacagaacggcatcctggggctggagaggttgaggctgccacccctccagaccagagggatgtggtgagtagtcctgcaaggggcttgggggctgacactccctcccctcctttccctcacatcctcccctccctcagccaaagccagaggctcagagcccatggtgcagcacaggtggccaccagagccaaggggaggaggggatctctgtgcactggctgggatgcagcacatcttcacagtcagtcattcacacattagtgagaatttgtgtctaagccacttccaagggaagatatagggagaaagaaggcttggaaagacagtgggaaacagagctgcacaaagtggtcctggggatggccaagggatgagaccatggtgcacctccaagggcccagttcatcctttgcctctgctcctccccagcagacacattcagctgcctctcctgagaatgcaggcccacactcccttgtccagcctgagaagcccccagtgacaaggagagtgccccagatagccccagggtcagcccaccccaatctgatgccaactccaggcacaactcccatcaggcgagcgtgggaggaaaatagcagattttcaaaagtcacaaattagagcatgaaatccaatgcttgacataagccttctgtgcagaaaccgtgaggccctccagaagcatggaagcccctgtggcgactgagcccctttcctgacagaagatctcccttctatccactctttcgtttaagtaactgtgttttaaagacagctttctatttccgctattagtggaaaatcactatcacttgccctaaataaacaataccctaaatgaacacaactgcacttaaacaggctcacctgcccctacccacgtcgcacagccactgaaggctctgagcccagcgcctgccctcattgtcaaaacaaggacattctggagtgtctgagactcgaagacaaaccagcactaacaggtcctttctctgcaccctacaggtgcgccatccttagcccccaccccaggataccgccctgttaggtccaccctgcctgctttcccagagctgccccaggcagagggccagccccaggcaggcagctgggcacaaggagcaggctgtgtgtccttccctgcagcaagacccaggacagcacagagacccatgcctctctgcgacccggggaaatcccagggctctcatgccccctccctggagggtctgcactggtcagacaggaggggtgcattctgcctggtgggctgctgttctgctcagccccaggaatccctcccatttcttaagcccatccttccttgggcttgtcctctcctcccctgcccctagatgcctggccccagttacacagggaggtaggcggccctagggcaatggcctggggtggacgctccagtttcttcccagcatggcacactcctgtggcatttgacttagcggtggagggggcatcccccaagagtgaggtaagagaatacccatgtccctaaaagcagacagcagcctgagaagtccctttgatggccctcctttcttgctggagtcattcctgagaggtaaatggaaagagatggagatgagcaagaggaagttgaggaggaagatggtgcagcgatgagagagaaccaagaaaaggcgagatggcaacacatagacctatgggagagacattcagagatgaggagaatcatagaggccagaaggagagatgcagagacaggggagacacagagaccggggagagacagagacagagaccagggaagagacagcgaccaggggagagacagagaccagggaagagacagtgaccaggggagagacagagaccaggggagagacagagaccggggagagacacagagaccaagggagagacacagagaccaaagagagagacagagaccaggggaaagacacagagacagggggagacagagaccaggggagagacacagagaccaggaaagagacagagacggggggagacacagagactgggaggacagagaccagggagagagacacagagacacaggagagacacagagacatgggagagactcagagacaggagagagaaagagacgaggggagagacacagaaaccaggggagacacagagacaggggagagacagagaccggggagagacagagaccaggggagagacagtgaccaggggagagacacagagaccaggggagagacacagaaaccaggggggggcacagagactgggggggacacagagaccagggggagagacacagagacacgggagagacacagagactggcaaaaacacagagaccaggggagagactcagagacaggaaagagacagagaccaggggagagacacagagacccaggggcaggtgctgagagagtgatggggacctgaaccctgagaaaggactggcagatgtgtcctggagggagggacagaacaagggccgttccagccctaccccgggaccatgagctgcaggccatccagcagctgtcagcccagccaaggatggccttgttctctgcaccccgagccaagccacttctgagggagctccacctttggaggattggtgcctgggccagctgggccccacaagcgcctctgtggtggagctccctctggtggggtcctgagtgctggggccgctgagaacatagggggaggggcattgagccaagtcccgcccttgtgaccaggagggggctccatgggggacacctgagggcctgaggaaggagagggcgccctgtcagatgccgcctgctcccacttagaggtcaggctgtaactgaggaggccacacagagtccccaccccatgtggactcagggacaaagagccctcaccctgtggccacgctggccgcatccaactttgctgggtcccatggagggggacccagggctgggagagaccctgccccagctctgcgtaggtctgttctgggtggtcctgaggcccaggttcaaaaggaaagtgccctaaatgggtgtcctgctgcatgcctggggtggccccaaagccaagcaggaggggttcccgctggaggagtcgaggccacaaggccccagagccttctcgaagctcctgctctcaaactcctccatctttctagagaagagagcagtgctggggcaagctgctcacccctcactcctccagggtaatttgctgacaccaagatccctaggtggggccagcaggggccagcctccctaccctccccgcaacacaccctctaggaccctaggctaggcttggaggcaatgggaaggaggcagctgcccaaagccaagaggcgccctgtagagggggccagccctgggcaaggggcgggggccgggggctgctggcccaggctccatatccccaattccccagcaacagtgcatggccagggaggctgggactggccaggttcgcacctcaggctgaaatattggcccctggggaacaaaaggcctattcccgccatgggccaggcacccagctcccctcgctccacactggctcccgcctccctgcccgcccaggcgcagtgcttacctggcctctattctgcccagctctcagcccagtagctctggcgggacccacaaggagttccgcctctgggacggtcagtccaaggtctatgtattccttctcactggggccagggaggagggggccaggccgggagcagagagaaaggggccgtggcctcatttccatgcggaggccccaggccctgtgctatccccaccctattgtgcgcctgggcgggctgacaatcgaggtctttgtggtcggttgctgcactcccaccctcagcgctcaggcaggcggggtccctgccacccgctacaaagggtgaggaggagcaagaccaggagaggccctccctctccccaccaggcacggggccccacgactggcctcgtccagacccaagcccaggggacaggtgtggagggagcacctgcagatggagtctccctgctccctgcaccttgcctctgagtttgtgcgtggggccagttgccatgtttgcactcccaccccctagtcctggggatcaagctgcctggcagtgtccctggagctcctgggggtggaagagggcccctgctaggtgggatgggccttcgggggcccctgctcctcatggcaccaagcatctgcccacctctggaggttaagcctggcgtgggaggaatgggaggcccccttacccacaggggagatgtttggggtcacagtcacagatgctgggtgggagggggacccaggccttgctgcagagccagacagaagtctccgccatccctgggtgaggcactgggtgggggcctctgagctcctttgaccaccccagctggaactgggaagctgtgggccactgggaggcaagggtccccaccccctctgccacccacatctgtactgtgggcacctccatctggccttccacatcctccccacctccgcatgctgcaggggctgggtggggggtggtctgcagcagactccaaaggaggcgagggtcaagggtcaagaggtggtgagccagctgttcccagatgtgggccgcggcctttcctctttctggaggaatgacaggcctcccgcagaggaggagcgggtggtgacgagggagaaggagcggaaagggaggggttctccacgggttctgttgatttgtttaatcccacgctattcggaggctttcacggatggcggacaagagggagggggagggggtgggggtctcggcccgtgtttcctcccctcctcccgctcccgcccccgccggagccacctgacccgtagcgaagttgccggccccgctgcgcgccggcctttgtgcgcaccgaggcggccgccgggaaccgggagcccgagctggcccggcagcgccgccgcccccaccttcgcgccccttttcactcccccactgtccccggagctggcaaataaacaaatccacaaacaaattatccgtgtgctccggagaggcggcggcgtgggcggcggcggagagaaggcgccgggcaaggcgagactaggcccccgcggagcgggggaagcacagaccccagcccgggcccggcagcagtaagttgacttttatgaaacctacgaagctcgcggggccaccgaaaaggtccccaccggagcggactctgcggggcgggcggggcagaggctgcaggcgggctccccttcccgcgcggctcctaccggccggctccgcccccaagccctggacggcccttcccccagcccgcctggctgggggccgctgcacaccgggggtggaagtggggagccggggaccccgatcgctactcaggactccaagaggggccgggttcttctagggatgtacaaaaatctagggtgacccaagggaagggggcgacccccagccttccaccttacccaccccggcctgccagagagccctccgccaaaggtaaagtgggaaggacgaaggtgctccgccaggtgagggaacaggtctgccaggggcggcgatccaccctgccccaggtggagccggtcctgtacggaaaagagacccaaagaaagatttggggtccccgaagccaaggtaccgatggggggtgctaaggagtctttccccttagaatgggaacaagctccaaggagctggaatcccgaggcgtcctggacccgtccaggaagctaagggtgggggacgggaggggagggggccgggagccggcctccctggccccaacccttggtgagaagagggctgggggtataaagtccgaaagtgaggcggaggtttcagggttccgtttcaacaccatggacagcggatgcctcagactgggagcctaggaccgccctggggactgcccccgtttcattagggtgagggtccgattccgaccactggaggccaagggcaactgtctccaatgaagcggggctgctgcagcctggcctccccagccctccagcccctccagcgtccggcttgcacctgctgaggctgccggcacccgcaggcttggggcagcttccagagctttgcgcttggaacagaaggttccccttgggctgtggaggagtagagggcttgtgcgtgacctgtgagaaagaaagattgtccctgacacttgcgaagggcgaggaattgcggctgggaagggtcaggttgaagccgcaccaaagggggaggggcgtcctgatggttgaggaccggcggagtcggtgcgggcagaaccaacccgagttcctgccgcccttcctaaccggctgtccatgggctgggcagtgctggagagggtggaaaaggaaggaagcaggacctgctcccagggaggcccaggctctgctccgagggcagatggcgcaggggctgggttggccctaggaggaaggagatggggacagaggcctgccggccgcgccggcctgcgctccttgcagtctaaacaaaggccagcgggggaggctccggacggtgaggcttggggaagccactgatccctggccctagagggccagatcgggggcgccccaaggaccctatcgagctggcagtgactgcagtcgggccgtggagtgtcgcctgtgattccgtggtccctacgggcaagagctcccatcccggtctgaaactgtgagaaccgcaagctccgatgggggcggggaaggacgacctttaattcccaccccactgtacggagcccagcagggccatccgcaggaggccggcgggacccttgcctttctcaggactgagaggcttggaggaccgcggtgtgagctgcgcggcagagtgcgttctgcaggcgccagacaggagacgcgaacccgcggtcagggcccgagtgcgggtgcgtgtctgcgggtgccgctgggctgcgtgccggcgaggcgtgcgcgtggcgaggcgtgcgcgtggcggggtgtggctagaggtgtcaatgtgcagctggaggggctgcgcgcgtgggtgcaggagggccatgtgaggggctggagtgtgtgggagacaggcgtttccttgggtctccgtgtggccgccgggcgcagggcacggtcgagggcgctcgatggctgagtccgcgtgagccgaggagcgcgcggggcgggacgcggtgcgaatgcgcgggaggcacgaggcgcgcagtgcgtgtgtgcgcgtgtgcgcggcgcgcgtgccccgcagttctcaaggacacctcggggaggcagcggcggggccggtgtccgggtgacgtcaccgcgcgccccagtgataatcggccggtgccggagcggagcgcggatacgcgcggaggcaacggcgacggcggcggcggcggcgggcgcggggacagttgcatcggggccgggccgggctagcaggagctgggcgcctgcagcgtggaccccgtggacactcggctcgcagccggcctgcggcgctcggggacttgcctggctcccttctcggggttcccgcgcccttctccgcccagggcagcagcgcgcggggcccccgggagccgaagagcaggcgggaactggcggcggcgcgggaggcgcagggagcggaggcggcagcagcggctcccgccgggactggtaattacgctcggggccgggccggggcgagccgggcaagcggcctctctgggtctccccgtctttctctccacgaacagctcgagcgccttctcgcgggcccgctgcgcgcggagaggacgagctcgctgggttgtaaaaagagacgagttttcatctttgagcatcgagattcgttcttttaaccgcattcggtgcgcgctcctgggtcggcacgggcagggcgacggcaggggaaggcagctgcggaggagctcgcgccgcccagtcggagcggttctgcgcccctcggagccccgcgggaggcggccgggtgcgcacgcgctcaccacccccacccccggaatccgtcttcgcgattcccgggcgccccagctccaggaacgcccggagggacgcacttgggggcccactctctgccgcggaaaggggagaagtgtgggctcctccgagtcgggggcggactgggacagcacagtcggctgagcgcagcgcccccgccctgcccgccacgcggcgaagacgcctgagcgttcgcgcccctcgggcgaggaccccacgcaagcccgagccggtcccgaccctggccccgacgctcgccgcccgccccagccctgagggcccctctgcgtgttcacagcggaccttgatttaatgtctatacaattaaggcacgcggtgaatgccaagagaggcgcctccgccgctcctttctcatggaaatggcccgcgagcccgtccggcccagcgcccctcccgcgggaggaaggcgagcccggcccccggcggccattcgcgccgcggacaaatccggcgaacaatgcgcccgcccagagtgcggcccagctgccgggccggggatctggccgcgggacacaaaggggcccgcacgcctctggcgtcgcggggcgggtgggggcggccgagggcggccgaggggggagcctgcggccggggccaggctgcggccagccggcccccggccacgtgtgtccgcagcgcggagcgcccaggcgcccgcagagggcggcggggcccgggagacaaagggagggtccacggggagcggcgggcgggtgcgtggggcggcgggctagggtgcggcgctgtccgcggtgctggcggcggggcggcccccgcgggacgggagggcggccaagtgcggccctcgcccccacagcgggcgccctggacagttgccacggcaacgtgggaggaggtggggcagggtctgaggtcaccgctaagtctgcccttcctcgggccgctgcgccgcggggcggggcggaggcggcgctcgctgtggccccagagcagcccccgcagcccaggaccaggcttgcatggggacgggggtctgcgtccgcgtccagggtccaaacgagggcggtggacacgccggaccgcatcccgcccccaaagccggctctgggctgtgcaggaccaggcacgtgagactccgcagcccagggagaaaatgacaaatccctcccccgccgccatctgcagccgcagtgacacccactcgggtttgctgcaggggttttttttctgtccccggaagccagcgccacctgctgacgcccggcaccgcctctgcgccgcctcccccgcgcccatcccaggccccggctgggctgtgatgccccggtaacagtcagaggacgaccccctccccaaaagcccccttcccctggggcgagtgccagacctggctttgcagctttgcctctttcctcttaaccaggtagaggctgagcctctcctccccggcttcaatccgaggcaggagtctgagtcacctgaagttctcccagctccaggcccaaggcagggagcagaagatcaggataaaaggaaccatttgagtttcaggcagtggcatctccacccccaccaccgccgctgcagggccacaaagggaacctgcctctgcggctgtcctcagcacagacctccagcccctccacccaagtcgcctgctgcagacacaagcaggagccactggtgcctccatcttcccacccccaccccagtcagccaggcagagtcagaacacggtccaccagtctcctcaggggcaggttccccctggagggcacagaagtggcataggcagccccagcaagccccggcctgaccacaacactgaccccggggcttggcgtccccttcttccttcctcccgctgtgaggggacaggcagcatcccccaggggcacttctggtcctagagaaggggaaggggccccaggatcgttccaggacaacaccaaagggactggtgggagtggggtgttccttcggggtacaagatgtggccctagcctagctggagcttcctcttggagctctgacctccagcctggcccttccctcggagggaaggtggcccctggctgctccctcctctggggccagagatgggggctggggctttgttcttgtaccactttccttcctggggaggggacttggctcctagccagaatggaccttccatgtcagtagcctggggagggggacacttgagagctggtgggagcgcatgggcaaactgcccttggcactgtccctagacagtcagtctctgtggggtctcctaggaagagcttcctggactctgtcacggtcagggagctacctctcctgatgcctgcccccagtggtgcacctgggccccagcccccagggcagacttgtggcttctgggctggagctcagggggtcacaggaaggtgggcagcccagtaggtatggggcacacggggggaagctcactgcgaaggagctgcagagctgagtgcgcaccttcttgggccaggccttaccatagctgtagcaccgtctgccgcagtgcggggagggccccatgtgccacagggtccactcggacctgcagcagctgagctgctggcctcagtgagaggcccttggggcaggggccaccatcaccatgctttgcagccaacatggactgccctgcatgtccagctcagcctctcctcctcctgctcacacccgcagccacagtcacagacatgctcacacagtctcacctcccacgcacacacagacactgcccgcctccactcaggaagagctgggcacatacccccaactgaatcctcagcacccagcctgcattgggtcggctgccaggcagtggtcctggtggacagcaaacttgagccaagggcttgggacaccctctgaccagaccatgacacccagcaaggccagctcagggctatccagcagggccctccccagtgtgggaccagaggaagacatcccttccctgacccaaagatttttattctgaataaaacctaataaagctgctgaggctgaagccacaggccccacagtcccctctgaaattcctccaaatcccccggtccacgagcagcagaggtgggaggagctgcaggggccaggccacaatcagcaggggccagggcagccagtccctctattctgcagcccctggtctccaccttgatctcacctccaggtagggctccctgtgtggccattggccaggagcccccaccctccttcccctcaagtccaagccccctggcaggtctctggccagggcagagattaggagctggctctcagcctccctgcccctggctgcctcctggccgtgcccataagccgggctcctggcagtgatgaccccagagttcagaccctcacagcccagccttcacccctggtgcccagaccagctgctattttggggctgtgggtgccaggaacagttggcagctgggtggggtggggcataggggataatgtttgggaatgaattaaaaactaaaaaatgaaatgatacagggtgactccctccagcttattagagggatggagaggccttgcccgacagtgagagcacagagcagagaagtctgcctctgcttggtgaccctgtcccgaggtgccaggaaggtagcagggtcttctcaagtcaccgctagccagggacatgggccagaggcagccctggaatccagcaggcttggcattggtcctgggaccactcatgacatgcacgtgcacacacagacaccctggagccttatgtcctgtggcccccagggctgccacagagccagaaagcaggaccctccctcacgggcaccgccagaaagcaggaccctccctcacgggcaccgccagaaagcaggaccctccctcacatgcaccgccagaaagcaggaccctccctcacatgcaccaccagaaagcaggaccctccctcaaatgcatcgccatagccacactcctccaccctggactctggcctggcctgacggaggctgctggttattcaccagatggaggcccaggctccatgtcttcagccaccgtgccctgccccagcatcaagttccctccgcactctatttcctccttggtagaggggaaaaataaagccagtgtctcccacggttgcctcggggtaaccggtggcaacaccatgaatgagatcaagaagaggctctccaggggaagctgaggccagggtggggcccagcccggggctggggatgtgtttcagggggagcacggccaggcacccgcccccctccccccgcccctccttgccatcctcatccctgcagggctgagacacgcaggtcattccggctccttttctggaactcagcatcagccaagccatgatcgccacagagatggccacacccctcctcttctcagctttgcaacccccaccccagctggccaggccagatcccagaaggcagccctcaccacccagaagactcacagcaggaatacagggatacaggggcggaaataggccctagtgctggggaacaggactgtttcaggggagactcccccaccacaagccatttccacagatgctctgatggagccatggggttgggggccagctcaaagccgagggcagctgagccccctcctcagggccatgagtggtaaaactgagccagatggaaacatacagcccctctgcatcctcagcagatctcagcagacctggtcgggttgctcctgagatgctgtggcctctgcagctccttcattccctggctccccagccccgagtcactgccagctgggaacatgggccagaggcgccccagaatccagtgggccgggcattccagcctggtccgggggccgctctgccacacaagtttatgccaccacctctgaacacttgggaggcatgtgggctgggctagggcacagccactctggaccctcctgctgagagccccagctgagacacagacccttggccaaccccaggaatgtccagccctgtgagcaggatctgagccccacacgaacaaacgaccaagaccaggctggggaccaggcttccaggcccaggctgcacccagtccacacacacagcacatagggtcagtgctccatagtgggcacgtctctgcagggacaggatggagatgtccacgcagcacacagaccaagctgaggtaaagtctcaaagtacaaccatgtggcacacaaccatccacctaggggcacaggcagaactccccaacacacctcttggctacctcggtatgtgtggccaggccctcctgcaggtgcctgtacttaccacgtgagggcgccctggagctgccacaggatcctgcacctggacaggaatggggagacccctggcagaatcaggccccagaaggacctggagcattgcacagacacgaatgccgtctgcatgagcaatgtgtagaggcaggcccctccccacggggagactgccctttgccccacacacctcagaccaggggaggagggacacacgggggcccttgcacatcaggatgctctttgttcattcattcgttcattcaacagatatttctgagcccttcctaggaatggtgccacaagcaccaccaaggtccaggtgggcctgcagggacaggacctccatgggtagagagggtagtctgggctctgcctggaacccacctggaacagagtctggaacagagcgggagcatcctggtcacagtgggtgggaaggcggggccccctcagccattggtacaaggacacaagggcatgtctcagactcctggagtcaagacttcaccgctctgtgcttcccttctggaagctggagggtaagtttagacatgttcgttcagtaaatgtcagcggtcatcatcaccataattactgccaccatcagtaccatcaccaccattatcatcagtaacatcaccaccatcaacataaccattgccaccatcatcattgttatcatcagtagcagcagtggcaggagcaccatcaccatggaccctgcagagtggggccatttaaactccctctggctggtcctgttttcagttctttgaagcagtggggatgtgggagagatgcagatccactgaactgtggccacccaaaggtcactccatagacccatatacttctaggagggtgactgcatgctgaggacacaggaggggaagctacagggcctcagtgccatatcagcctggtgatgctcaggtccccgactccacataaggacagccctcctctggccacagaggccctggtcatcaccacctaagcagcccctgaaccagctaaccttggacagtctccagtgtcccttccccacaagtcttcccaaatgtctagagaatacccctgtcttggcccccaaaaggtatttccgtgacttcacacccagagaagtgcagaatctgctgggggcaggtagtcctgcttagaagacatagtggctaccctgggagagtggcaccccctgtcagagcccacctgccaaaaggctggagatgtcccaagagcctaaggaccaaacagcccacagaaaagcccatttccagccaaaccccacctttcctcatgtgcagaccccccaagaattacagacctgaggaggtgctgtggcttgcacccagacagagcagaaggcggatccttcccaaggggctcctgtttatctgggaccattatcatctttacattagttttacacggcccatgtgtgtgcacctgtgtgtggctgtatgcatatgtgcatgtgtgtattcatttgtgtgcgtgtgtgcgtgcatgcctggggatgcctgtgggcatatggtcatgcgtgtcagtgtgtgcccatggtagggcatatgatcatgtgtgtttgtgcattcctatggtaaggcacatgatcgtgtgtgtcggtgcacgtccatggtagggcacatgatcacgtgtgtcggtgtgtgcccatgttagggcatatgatcgcgtgtgtcagtgtgtgtccatggtagggcacatgatcacacatgttcggtgcatgcccattttagggcatatgaccatgcatgtctgtgcgtccccatgttagggcatatgatcacacgtgtctatgcctgctcatgttagggcatataatcacgtgtgtcagtgtgtgcccatggtagggcatatgatcacgtgtctgtgtatccccatggaaggacacatggtcatacatgtcggtgcatccccatgttagggcacatgatcacgtgtgtcggtgtgtgcccatggtagggcatatgatcacgtgtgtcggtgtgtgcccgttatggcatatgatcatgtgtgtcagtgtgtgtccatggtagggcatatgatcatgtgtgtctgtgcattcctatggtaaggcacatgatcgtgtgtgtcggtgcgtgtccatggtagggcacacgatcacgtgtgtcagtgtgtgcccatgttagggcatgtgatcacacgtatcagtgcgtgcccatggtagggcatatgatcgcgtgtgtcagtgtgtgtccatggtagggcacatgatcacacatgttcggcacatgcccattttagggcatatgaccatgcatgtctatgcgtccccatgttagggcatatgatcacacgtgtctatgcctgctcatgttagggcatatgatcacgtgtgtcggtgtgtgcctatggtaggcacatgatcaagcgtgtcggcatgtgcccatggtagggcatatgatcatgtgtctgtgtatccccatggaaggacacatgctcatacatgtcggtgcatccccatgttagggcacatgatcacgtgtgtcggtgcgtgcccacggtagggcatatgatcacgcatatctgtacgtgcccatgttagggcatatgatcacacgtgtctatgcctgctcatgttagggcatataatcacatgtgtcggtgtgtgcccatggaaggacacatgatcatacatgtcggtgcatccccatgttagggcacatgatcacgtgtgtcagtgcacgcccatgttagggcatatgatcacacgtgtctgtgtgcccatgacaggcatgtgtgttgtatgcacgtgtttgttgtatgttctctgtacatgtgtgcatgtatgtgcctgtgtgcacccagatgctcatgcatgtatgtgtgcttttgtgtgcacctgtgcatttgtgtgtgggggagtgctgaggtacagagagcagctccaaggtaggaaagaaccaccctgggccctccggactcccagaatgctcaggccctcctgcctggcagtctttgcccatgaggatgttccggctggaaggctcttctcatgctcccacatccctttcccaactcatccttcaggtcccaacttggtctgtctcagagaccaccatgtgcgtcaaagctctggcactcctggggcatgggctccccttggcctccacttcccaaagccgccccactctcaagtccctcaccagccactaggggtggtgactggcaaggagaggccagacagggattagtcaccgggtgcggctagtccacctccttctccaaccaggatccaccctcccaggccaggcaggtcctcctccaccccattctgacatctgcttggtggcatccctccccagatagcagcctgaggacctgtggagggggcaagagcagagcagagcaggctctacactgcctcatgcagggacccccggctgagtgtggcccagagtggtcagcccccaacatcagctgctccccatatggccctggggccaagacaccctcagggatgtcttccatcccaggaaggccaggtgggacaatttgccttccgggcaacacacattcctgcctcccagtaccctgtgtcccctgggcctccacccactgtgtagcacaagcatgtgtcaacagaaccctgtggccaggcccctgagtgtcaggaagtcccctagaagactgagctgcctgcccctggctcacagagaggtggggggcaaatgggggtctgcttggagcagggcagtggcagagagaaggaccagccccgaggggcttgggcatggcagggattgggcctgccctccaggtctctctggacactcttaccccagcccctggcctcctcaatgccacacttaaccaagtccccctcagaccacaaccccatgccctcgcctgctcctgaccctcagacacaggtgcccagctgccaatgctgttcccgcctcctgaaccccaaagtcccctcacctcctgccctgccctgacttgatgtggcctcacatcccagcctctgctctctctcccgtgctgtgcctgccccacccccacctcctgcaccccaaagtcctctcacctcctgccctgatgtaggctcacatcccagcctctgcagtctctccagtgctgtgtctgccatcaccctgccacctgcctccccgcctgttggacaacaagcaactgtgcttgttggggagactgcagacttcaggccccaccccagggctcagcagcctccagcctggccctcacacacccccacctccttgggaaaggctccaggacacatacggtccacaccagcctcctcctctgagctgccgtggccagccgtccttggcctcagatcatgttctgtcagtcctggtcccctggccccactcccttgaaggcagccagtgaccagagccccagaaggttcagttgcaggttccaagtgaatttagggatggggagactggggaggccctgctggagctgcataaaggcactttcagtgactgggggcctccatgctggccatggtgctgcctgtacttcatgcagcccagggtcctgcactctgggccctttcctgggggaggaaagaaacccagacatcagccctggggaggtggaaggaccccaaaaggggctgagccccagccactagccactcaccgatccaccggtgagcggggctggaaatcggcctccggcgggatcgtctcaggctcaggcacgaagcacaggggccctgtcgtaagtggaacctccatctgcagcaggtgctgggtgtggagaagccagtctcccgagggtggggcagggggtacggatggctgtcactcagaaggacttcccacccgggatggtcagtctcacaaacgacaaggagactaccctaggcttacacagaccccagggggcagggcccctcagtgcctctcaggaaggcagaaggggctgtggtcctggcccagttcctgggactcctgcctcaggctgcaggcactccctttactctgtgcacttgcagggatgaaacccacctccaactccacggactctactgcccagggcttccccagccacaaaggagagcttgtgcctgggacagcgaccacccccaggacagaaacaccccctcccgggactcctctaggacccactgtcccatgtgggaccgttccacaggtgctactcttccagggcgcaaatcccagcgtgctcctggccacacccacatcccaaagctctccggctgtccccaggcctgcagtctgctgcaccgtgctcccacagtggggcccacttccctgctccgccaggctgctccacacagccctggcaccccttgccccctgcccacacccctccaacctcgtacacaggcagaggccccgcccagcctccacccaagcacacccccggcctggtccacctgcaaaaccaaacctgctggactcgtcatttcccccaaccagcctggcttctccatgaacaacccccccaagttggggactgctctccttggtgatgacaagggtcccccactggtgtggcccctccagaccttgccacgacctcagtgacccccccattgtctccccatcctgcaacttgggatgttgaggcttttaagttgtcaaactagaacaactcgagatgaggacctcggcaggggggctggtgacaggaggatggatcgccaggaggatgatcgccaggaggatggatggcccagagctcagaagaggtggttgagggcccagccccaggggacccagcaggaagaagccagacaacttctgaggctcccactgaacccagaccccaccaggctgaggggcttgcacctgcggaggaggagggaggagtcaccctctgcagtaggcaggggagaggggtggagagcagtggctttgcatcctcctgttcttgcccagggctcccaaaacaaatgccaccccagcacacaaaccacacaggcacacagacacacatgcacacacaccacacaggcacacacctgtgcacaacacaccacagacataccacacaggcacacacacaggcacacacgtgcacacaccacacgggcacacacaggcaaacacaattgcacacacgttctcacacagacacacacgggcatacatacatgtatctacacatatacacgcatgcacataagcatcacagtacatgcacaaacatgcaatacacatgcagacacatacacagcaaccaaatgatcaaggaaagggatcaaaatattaacaataagtgaatctgggtgaagagtattctctatactatgcttactcttgcaatttttctgtatatttgactttatttccaaagtaagttttttaaaaaaggaatgccgtcacctcaccagccaccaccccataccaccccctcgaatacacctcaagcagctcttcttgatgttgggaccagagtccctctctcaccgctcctctgcagggatgcagtgtccccagctagtgaagacagacacctgtgcccccaccccagccccaagctgctgcttgtccctgcacctccaggtgctcacgcccagccccagggtgcagcaagcttcccaaaatataagggggagggggaagggaggccatcccatccctgaggcctggcagagcaagttggcctagggacctggtattctgaggccccgtcaaggccaccctcctgcacacctgtacccagactgaggaatgacctcacctgccacctgccaccatctttggagaaggctagggctacgttagcccagcttggacgagcccaagcagcaaactgcaccttgaggtctcctcccgtgatgagaacatcacggcagaagccggcacttgggggaggcaggggaaccatgacaccagctctggacgtcccctcctgtctgggctggacaccgaacccaggcacttctcaccccgaagcacaccattgcccacccctgtgccctggaccctccacagggccaagcgggggacgctgtcccagagaacctggagcctccacagggccaagcgggggacgctgtcccagagaacctggagcctccacagggccaagcgggggacgctgtcccagagaacctggaccctccacagggccaagcgggggatgctgttccagagaaacagctgctgcccacccacagaaagtctcctcttccaagcctgacagttccacaggactgaggcaacactcttcctggtctcacaagtggtggccaaagcccaaagccgccaagggcctcatcacctgtgcaccacctactccactcccgtcccctcggaagctgccctggggctgcccagcctgcaggggcccagccctgtccgtggcagcatgtcaaggctgccctcggccctgaaggagacccttcctaccccacagcttctcctggcaccaagcagtggcgctgcggtgtccgagctccccgtctgcccataggagccccgccatcacccacgggaagcagcactgcaatctccgagcctcaccctccgcaggacaccaggagcgtcagcatgctgccatccacagagccccgtgacgggcaagtgctgggctatggcttcccatagcttaggaccgacttcgggcggctcgccctctccacggccacagagctcggaggagtgcccaagaggcgcctctgtccaggatacactggaggcccctgtgcccaagctctgcccagacattagcagttgctggtccttctttgactctgggtggccaggacacttgcgggagggagggtgctggccccaaacaaccccacaggccgtgtggactccccaaaggcaaaggggccctgtggcagacctgtcctgagataggagcctcagccctgggccacagcaggaagccagcaggtctggtgggcacccctggaactcactggagttgaggcctggtcctgatgctcattccgacacctgaagcctgattagcttggcaagtctagctccctcttgcacgagctgagcgacgcagcagggcgaggcctggcccgtgcccaacgctgacgcttccgcctggtccagctggtgacaacgtatgagacacctaggcctgtggccggctgccaggaaaggagggaacctagactgctgttcaccatctgaataccccgtgacttaccagcaagcaggccactctctcacacctccaccagggtcgcctcccagataatccttctcagtcataaggaggaactcttgagaagagaccttccagggaggagcctggtggctcgaggagcctctgaaccgggcttttttttgctgtttcttttttttttgagacggagtttcactcttgttgcccaggctggagtgccatggcgcgatctcagctcactgcaacctctgcctccctggttcaagaaattctcctgcctcagcctcccaagtagctgggattacaggtatgcgttaccacgctcggctaatttttttgtattttagtagagacggggtttctccatgttggtcaggctggtctcaaacttctgacctcaggtgattcgcccgcctcggcctcccaaagtgcagggattacaggcgtgagccaccgcacacggctttctcttcttatcattaagcactatgaaggaataagcgagccttttttttttttttttttttttttgagacagagccttgctctgtcacccaggttggagtgcagtggcatgatctcgggtcactgcaacccccgcctcccgggttgatgccattctcctgcctcagcctcccgagtagctgggactacaggtgcctgccaacacatccggctaattttttgtatttttagtagagacggggtttcaccgtgttagccaggatggtctcgatctcctgacctcgtgatctgcccaccttggcctctcaaagtgctgggattacaggcgtgacccaccgcgcccggctgaggcgcttcttttttatttttttttttgagacggagtctcgctctgtcacccaggctggagtgcagtggcacgatctccgctcactgcaagctccgcctcccgggttcacgccattcccctgcctcagcctcccgagtagctgggactacaggcgcccaccaccacgcccggctaaatttttgtatttttagtagagagggggtttcaccatgttagccaggatggtctcaatctcctgacctcgtgatccgcctgtcttggcctcccaaagtgctgggattacaagcgtgagccaccgcgcccggcccaggcgcttcttttaactccagatgtgtgcacccgaaagttagccacagttacgtgatggagcaactccaggctgcagggaaacgtgagcgccggccgtggggatgcgcggggaggagggcgggccaccaatgcctcgcccacactgtgtggagtccacaggatggagacggatactgagggaagccatgagttgtggtctggtgactgaagtcacagagtaacggggctgccccaagctgggagccaaggtgcggactcctttctcacgggcctcctatggtgagatcacagcagaagccggcctgggcttacagctggtctccggccagagagggcatttctgtcctaccaaagactgcaacaattctggacagcgaggggcctggagggacaggattcagcccaaagtaccacaggccacacgtttcctccatgtcatcccctagcctggccatttaagacccaatgcagacagcaacctgcagagccagcctgtaacccaccagaagcccagagcacacttgggcttgcacctgagctaccacccagcccctccaaggaaacttctacaggcagaggcacctcaaactgtaaatccagctgaaggcttttccaatagcttgcaatttattatgacatttaagaattctagcataggccaggtgcacgggctcacgcctgtaatcccagtactttgggaggccgagacgggtgggttacctgaggtcaggagttcgagatcagcctggccgacatggtgaaaccccatctctactaaaaatacaaaaattagccgggtgtggtggcacgtgcctgtaatcccagctacctgggaggctaaggcaggagaatcacttgaaaccgggaggcggaggttacactgagctgaggttgcactccagcactccaccatgggtgacaagagcaaaactccatctcaaaaaaaaaaagaaaagagaattctagcatggtgggctttggggaggggaagagggaaaaaggaatagggctcatgtggctggcttttagggaggcaggtgtgagaaatactaacaacttacagctctttataaagcaaaatgagatgaaatccctcccccgcccccccaattctcactccacaaacctatgcctttcggttctcccttcccctggtaggcctggctccttgcctggcattaccatgcaccacgaatgcaggcaggaggccccaaacacccagacacggtgtcagttctacaaaactttccaagttggcagaaggagaagccactgcctcctccggtttggaggcctcaggggaggtgttgtctagaccgcccaatccactatccattcacaagccagtcagcaactaccacttgccagagtccctgccaccacctcccactctgtggggacaacagcatccacttcttccacaacaacgaaacaacaaagataaagcatggcacctgtcgtcatgcttgccacctttcagcacctctcggctcagcattctgaaagccgggaactcatctttaaaggaggccaggacttgaatacaagcaagaaaatggcataaaatgaaggaattagccactcgaggttgaaaacacacttccctaaaatgacagcagcatttggagctgcaggtgggagcacacagcctacctctaactggcctgtcagaacagacacgttttcccgttctcattttgtgtttccttaaaccaactactaacttctggcagaggtggtgactgcctgggaaagatgccatcctcatctggcccccttatctatcaagatgcaaactaataaaaccagcgggcgggacacccatttaacctgaaacctcctcttttgttaaaaatggactgaatgtgtcttccggttaataataaactttgctgggcactggaataaccaccagcctcctcaaccgtggctgctctcaaaagcagatgtggtgttccctgtcccgagaaggctccagagtatttggattaaggacctggatatgcagatcctactcttaagaattaacatttcctccctacccctcaaatgtaaaactggaaaaattaagaactctgtattttgcattgcattctcttaaaaattctgttaaaaaaatctcttcacagactgggtgtggtggctcgtgcctgtaatcctagtactttgggaggccaaggcgggcggattgcctgagctcaggattttctgggctgaggctaatattgcataactttatcacatacttgtcaacttctgcagatgtacacaatgtgcatttcactgcttataaattttacctcaaaaggaaaacaaactaaacaggtattaaactcttattgcataaataataagaggcattggaggatgaatggagagagacggtgaggagccaagtccagaaagggggtagcggtgcccaggtgctgcacgcaccgctgcgtctgcacattcatgtgatgaggggtgggtgacggtgccatgtagtttatagtcttaaggaaattaacagctccctcttccaaagcgagggaacgagaatcccacaccttgagaaacacagggctttctacggtgactccccgaatggctctgcagcttaaaaagctccaacacataaactcatcaagtagggtgaagaatgaggtgacaccaagtttgctaaatagtattgtttattaaggcttgtattctcctagaggaaaaacccaatgtcgtccaggactccattcaggcagtaacagttcagaggaagtgacacgctctaaatacaagtctaatgatacagctgaaacgttaactcagagggtcttttggagcaagtagttttcagaaagcgtctgctctctaggacggtaaggatcctctacaagggcacgtgcagatccaggcgctggagcgtcaggcatgggcaccattttcatgcttcaactcaaactccaggtggtagtgagctcaacggtccctcattccacaaaacatgacagcaaattcatcttctaaaaaaagttttgttttgtttttacccattcaacaggaaaaaaaattagacacacacgatgaaatttacaaccagcagcatcatccatcacactgtctgtactaccagatcctacacttaaagctcagcattattggtataaaaacttaagacggcattagaattcttaagaaaaggtgtaaaatttaaaaagatgtgcaaacaacaaagaatgcccgaccctgaaccagacctaaagcaccttccagttcctccacacatcatgccccaacaccatccagcccaatcggacaccaggacagtgagggacgggtggctgttcagtgggcaacagatctggaaggaaagattttcaaaaaaaaaaaaaaagtgtctgccaaatttgaaaaattaaaagttatctgtctagcagaaaaatcaaatgggtaaattagcactttagaccgataacagataataaaatgacaaatcagaatgaacaaaaaatcattaaccttttgatttcagtattttcaagagattttatcagaatactctaaatgacaaaatgactcatggtttcttatgtttgctaaaaagcaataaagggatgagaaatatgaagtctcacagaatatcaaatgactgaatttaagaacacaatttctgccaaaatagatgctttgtttttaaggatacttacatttcacattagatcagtctgattgataagctgacaaaaaaaatactcctttattagtgacttctacaggattataatacatagaaaaagtacaaataaatgcagatccatctgggcaaaaatcaacgacaagaaaggcaaagatgcaacactcaacccccgcacgggacgacacactggagctgaccaagcacacgtgttttaaactgttttcaaagtcaaacgttagaacatgtaagaaactggttcgccctcattgtttgtttcgactctgccgttcctgtaaaaagaaaaaacaaaagttgaacgcagagtaaccacaccaatgaatccctcccaaaagtgagatccgaggctgccccttagcagcacctgcaaatctggaggcgggaccctgaatggtacccaagccacaccagcacacaactctgagctgcactggggcctgctctgtgggggactggccacactgggcatggcattctccccaccccctctaccaggagaaaagcatcaaccacaacggtcacatgggccacctgtctgctgggaagcctcacttcccacagctgtctttccctcatgtgccactatcattccacatggaaagacacttagcaatgtgaaattctctgcactcagagggaggagctggcacgcaccaggctctcaaggaggccagggagacagaagctgttcttctgtattttatctcatttaaacttctcagtggcacaaaggacaccaaaatccttccaactggctaacaaggtgctgtgtcatgtggctaatgaagggcaggaggaccggtgtgggcctgtccagttcaggcccttcccactccccagctcactcccacgccaaggggaagagcatgcccctccccactcccccacggctagactggctcaaggcaaagctcctctgaccaggtttgctgcccactcccgtaagagaatcatcttttccagagtgtatgtgacacacaagcttgagacttacacccgaatcttttcccacactggcctccctgagtagcagggtctagaagccccttcagtctccttacaaggcagcatacaaagatgaaaatgtgcgatctaaggagcacacgctgcaccactctgctagagaggtgtcccaggccgagtgtggtggcgcaccctgtaatcccagctattcgggaggctgaggcgagaggatcgcttgagcccatgagttttcggctgcagtgagctattatctgccctgcactccagcctgggcaacagagagagaccctatctcgaaataaaaacaaaacaaaaagatgcatcccaggcacatccaccctcatctggccatctatcaagatgcaaactaataaagaaaaccagcgggcaggacacccaaacatttaacctgaaacctcctcttttgctaaaaatggactgaatgtgtcttccggttaataataaactttgctgggcactggaataaacaccagcctcctcaactgtggctgctctcagaagcagatgtggtgttccctgtcccgagaaggctccagagtatttggattaaggacctggataggcaggtcctactcttaagaattaacatttcctccctaccctcaaatgtaaaactggaaaaattaagaactctgtattttacattctcttaaacattctccgttaaaaaaaatctcttcccaggctgggtgtggtggctcatgcctgtaatcctagcactttgggaggccaaggtgggtggattgcctgagctcaggaatttgagaccagcttggtcaacatggtaaaaccccacctctactaaaaatacaaaaaaaaaaaaaaaatttggcagggcatggtgaccggcgcctgtaatcccagccactctgaaggctgaggcacaagaattacttgaacctaggacgcagaggttgcagtgagctgagattgtgccacttcactccagcctgggggagacagcgaaactctcaatcaatcaatctcttaacaaaagaggtactgctgttcctaaaaagcaaataccaatctcttgagttcaaatagctgatgttaaagccactcacaggtaaactccccagatccccatctcccttcagcccttataaacagctacaaagtttactatgtgctctttaaaaaatactattcctcataaaatttctcaaaaaaaaaaaaaatgacgaagcacagctcgttcttttgaggaatgctcaacaagcatccaggaaatgcttatggcctaagattctctatgctctttcttaatttccaaagtcaaagagccactctgctgagccggcctggaggtcgaagtggggtcaggtcaggggcacctgccgccagggcaaggacagtcagtctgaggaactaagcaatgctcacagtgtgggacgctcaccactttcactgttttaagctaagaagtggccgtttctaggtttttttaaaaccaaaaaatgtatcaacccaggacttggtctgactctgctgccataaaagctactgccatcctaagaaatcagtatgtttctaaatttatagctggacagcaatcttgcaaaatgctaactctacttcactttctcaacactcaacttgtttatgacctttacagcaatggggccaaactctaaatgataaagaaaaggtgggtctgttcttcgaagtcctgagagaaccttgagaaaaccgcccgggggctctaccagcacaggcgcacaaccctctcctcggcacactactttgttcttaaaactgcactgactcggccgggcgcagtggctcacgcctgtaatcccagcactttgggaggccaaagcgggcggatcacgaggtcaggagatcgagaccatcctggctaacacggtgaaaccccatctctactaaaagcacaaaaaattcgctgggcgtggtggcaagggcctgtagtcccagctacccgggaggctgaggcaggagaattgtgtgaacccaggaggcagagcttgcagtgagccgagatcacaccactacactccagactgggcaacagtgcaagattctgtcttaaaaaaaaaaaaaacaaaacaaaactgcactgactcttcatgggaaacccagagggagaaagcattagacacccagagtctcagcctcaagacacctaagactccaatcctggatgagccactagcccagcccgttaagcacaaggcctagagcaccttcgcaggcagggagagccagcagcgaagtccagtctggggacctcctcaaggaccacttccatttctctacactgcccaataagcttaaaagatatttgacgccgggcacagtggctcattcctataatcccagcactttgtgaagccaaggtgggaagactgtttgagcccaggagttcaagaccagcctgggcaacatagcaagacactgattctacaaaaaaatacaaaaattagccaggcgtggtggtgcacgcctgtagctactcaggaggctgaggcaggaagaccgcttgagcccaggaggtcaaggctacaacaagctgtgattaagtcactgcactccagcccggcagacggagaaagacctgtctcaaaaacaaaaacaaaaagctatttgaggcggggcacggtggctcacacctgtaatcccagcactttgggaggctgaggtgggcagatcacttgaggtcaagagatcgagaccagcctggccaacatggtgaaaccctatctctactaaaaatacaaaatttagctgggtgcagtggtgggcgcctatgatcccagctacttgggaggctgaggcaggaaaatggcctgaacctcggaggttgaggttgcagtgagccaaaattgcactactgcactccagcctggctgacggtgagattggctcaaaaaaaaaaaagctatttgaaattccaccaaacattaacaaaccaggttctcatttgtcactttcaataaaatgaattaatgttaacactgacccatatgggcccagagttctccagcttggctaacagtttaggggagggttaccaagttccttccaatgatgctccaccagcggctctgttggactcgccttggagcacccagtggtttgaggaacacttggatcttgcctgcaggcagatgcccacagaccctgcaggccgcttaccaagatgcttaacccataacccgacacacaaaagcagttatctagatcaagtttttataatgcaagttgtaggacactagagttttaaaaacaccaaccaggtcaggagtccgcacactttatgaaaacccaagtattacggtatttaagaagaaaaactgtgcgcgcacacacacacagccagcttccagtttagccagctaaggacctaaagcttcattagcaattatccctgcaactttagcaattcagtattcattttatacctaaaagtctgtaatccgagctattgtctgtaatcccagctacctggaaggctaaggcaggacaatcactcgaacccaggaggtggaggttgcagtgagccgagattgcgccactgcactccagcctgggcaacagagcaaaactccatttaaaaaaaaaaaaaagacctaaaacacagaatttcagtaactaattcagaattcagtaactggaaataaatgacatccacttcttttctcacaaaagagagggactgatacttttccaaagttctacaagccccaagttgttcaggacttgcataatgtaagactgcagacagtgcaggcggctctactctatacatccctatatatgccatgtacacgcctttctgcccaaaatacattaggacacttggtgctcacaggtgaataattcctttaacatagagaactgaaaaaaacactgaaaacccatctattatcaactgacatttcaggaagggatattttttaaaaagcaggagagaatctcaggatgaactctctcgaataaaggaagcattatgaagtatgtcagcatcatcattttcccattgctggtgccagtttacgggcatctgagcccttctgaagagcaaacacactcaatcccgtcagacatcacatgacagcacagactcaggagtttggctacaagtatcccaggaaatcaggactgtctcaaaaaggcccagtcaatgaatttttgatataggatccatatttgtcattataaaatgtctggattccaaacctaccccaccaccaccattttctttacgacctagatggagtgagtttgtttccaaaaactgcaggatactgggtttttaaaagaaaaataaagcaacgacctccagatcaaagaccagagattcccaactactgagggacagtgccctgggaagcaagggcccttggccaggtggggtctcgatgccctacgtgcccaccgcagtgcttcgtgaatatcacctaagtgttcctcatggacggaggctgggaagcactgttccagaaagtatcacaattcaaaaaggagaggagaaagttaccctcaaattctttgtaacagaaaaacagaatgtgtacactgtggtcccaattattcaattataattggaaagtgatcaaagtcgttcggtgacatctacccaaataccatcactggttactagcagtactctccgcagggaaagcccacgaggctgccaggacctgggcccgcccacctgcggccaactgggagctgcctgtcacgagactcagctcggcggacctgccgcatctgctcaccaccgggccacctggtctaagtacggcaccaaggacacatctgcatggcagttgcctgcaacacccagcctcaccttgcgcaccacctcctcctcctcctggcgcttctcgtagtgagcaaagtcgtcgaagatggaggttgtgtgcttgtaggaactgataattttcagcacttgcttggctttttctaagggcacctcctgggtgtcccgggagtttgtgaccggtttgttgtcgttattctccagcctgatgtgccggagctggttattgggtacatccttaacaaaaatccactggacatcaaacttccccttccacttgtcctgagaccagaccccggcactggtgccgtagtccacgggggacttcatctcggccaccccacaaaaatgcccactcccattgacgctgaagagcaggtagacgggccccttgctgctcatgcagcggaaggcgctgtccaggcgcttgttgccgtgctctgtgctacaccagatggagtacttaatggagcggtggatgtcgtcctcagagtagctcttgatgatgaacacacgcccgcttttcagattccactcaaactctttcgggttgtagctgtgagcagccttcagtttttcaaggacggggtgggattcgacgctgggggcagaattaggctggacgtttccaggagagttgctatcgctgccagcccctccgctctgcccaaacgccgcgtttctgttgcgtggggcaacccagcgggtctggggtggctgctgagggctctgatactgcggttgagccaaagctgggggctgtgctgggagaggctgagccacctgctggggctgtggggcagcctgtggagagggtgcctgctgggggactggggccttcggcacaggccccttgttatcccaggtgccaatgtccatgttatgctttatgggtggagggggcagcccaccccccatgacaggcccgctctttgttttcattttaggctgtggttttgcaggcttgctggcaatggcagcccacgaggtcggctttgaaactggcatgttcacatttgtcccaccgttgccagaaaggacaccagtcagtgccacgctgctgacgacagagcccaccgtcttgacggcggaggagctgacgtccccaatcttcaggccaaccatgccctgctccaggctgttcatcccgggggccttgctgagggtgtcgctgtgaaagcctggctgcccatcaaccaccgtgccacccagggagctcggggggtaggtgtagctgctcccatacgcggagctctgggtctgctgaccttgagacccacttgtcccccatgctgagaacgcagggttttcagggaaaaaattgaacctgtgctgatagatgttgttccccaggcccccaggctgcccaaaaacagcatcgtgcataaaatgatggtctccgttactgagctgtccgtaggtggtgaggtatggaatcggagggtcccctgcagtagaccacggagcctcattgagggagtaaggaaatccaatggacggcgggtaatagctggacaggtaggggtcgctcattgaggggtaactgttactctgcaaaagcaaacgtgacaagttacaccacttctacaacacgagatgctgagaatgccaaccgcctcttgcttaagcacaggtggagcaaaaacaaaacctgcacagcatggggctactccttccagaaagaaagctgtagtcgccaatgtgagaaccaaatcaagacagagaaattaataacgaacacaaaccagggtgccgtctcaaaatacgaagcatcattggcaaggctctgaattcaggctaaatgacgaagctatgcctctctagaactggcaaggtagcagccccctctactcttacctgcaaaggaatccagaggtagaggagtaaacccctgcctgctgacgacaacgcttatgacagacacggacggcatcatgggaactgaaacagctttgtaaggcagagatatttccattggcaaaccaggatgtgcagggccgtgaggcagtttgctccagagaacagaccccaagctcgctgattactcagcaggccctgggcgcccacctctgggccttgacattcctcctgggacactctcccatacctggaccaaagctctcccagaatccttcaagggtgcttcagaggctccttccacacacccttcctagcagatggcccctgcctctaagtccaagggggttcacattcccatgatttcctgggcacagcgttgggctcttgcagtaggcccctgcacagagggccctggctggctccagctcctcagccaagagaaagcatccgaagtgtggactctgtgctccgggtgcagagcagccctcactctggatgccaactcacctgggcttccttatgaaaacatgtctgtgtagtgactggaacctcagagagtggttttaaagtgacggaaccatgaggcaaaaaggtctgctagagaaggtgagtgcctgagtgccccatcgtaggggtctctgaagagctgcccagggcacaaatttagactgagggtcagcagttctgggacggcatctccttggagagactcaactaagggtctggtcatgattgggtccctccaacactgccttaaaatgactttcgtgtgaggtgtgtctgtatgtgtgtgcgcacacacacctgtacacaggccggtgagacggggtccagtgtgaggtaagaaggctcccacctagacgcatcgtctgagagtgccaagatgctattacagaaaacagagccggaagtaaaacacggggctctccagtctgtgacgcccgtttttggatttttagttttcccgctccccgccccccagtcccccaagtaaccagaaggttctacataaagagaatatgctccagacctcatctcacaacctcatccctgccacattgacctttcatgttggcatcaaaggctacactatgaaggataacagcacccagtcggggacaccaggtgggaaagtagctgaggcaatgagggagactgtgggatcccagacaatgaaacaggcctgcttcactggaggggtgaccacaagcagctctccctgggggcagtgccccaacaccagccaacactggtggactaatgaaccaatgacccggccaccacttcctgcctcctgctcccatcctagaatactgagggcttcagaaatccaatttattttctaattttcttcctgttgacttctccacttgtgagcagacaattccagaaccccccccttttttttttgggacgaagtctcactttgtcgcccaggctgcagtgcagtggcacgatctcagctcactgcaacctccgcctcccaggttcaagcgattctcatgcctcagcctcccaagtagctgggattacagacacccaccaccacacccggttaatttttgtatttttagtagagacaggatttcatcatctttgccaggctggtctcgaactcccaacctcaggtgatccacccgcctcggcctcccaaagtgctggaattacaggcatgagccacagcgcctggccccagaatcatcttttaaaatgcactaactgctgtttccccgtaatataaatttgagattctgggggtataagaagacaagtgggatgctatcagtgttccacaaacatgagattaatctgagcttattctccctcaaaacagtttccatgatgctggctcctttgctgcagcctttccctcgggtgctgccctggccaacaggcccagactgggggggtgagcgaatcaggggggcggtctgtgcacaggacttgctcctcgagtcactggccgcaggtgccttcaaggacggcaggcaaggggacagtcccccccacagggaagccagccctcctcctcccattagctggacacgtgctcctcagcagcgctgcaatcacaacacatcttccttccacgcaaaaagagcagatgggaaaaaaagacctcgatggctgtgtggtattctaatccacttggccccaacaccaaccagaggagtcaggccacagaaacagatgcccagggacacttctgacttacacctaaagccttaactaagacaggacatcacttaccacatgaaaaaatccacattacatgaggcatgtaacattcctgaaaatccgttttaagtattaaatggacacacctagcacacacgctgcacagacagagagcccataaatgacccatccagcttccctctacccaaggtgcagggcctgcagttctagccagtactctgcaaatccttcagctccagatcaccaccattcacatcctgagccacagaagacggtgacgctaatcagctctgctggcagccctaaaccctcctgatactttctgtgctcaccgggttccacggccacacaggcaggctggatacagtgacctggggttctgtgggccggatttccatttttacctcaatctcactgacagcccatttcctattacatctgccatctttcctccaaaactctgaaggtaaagaagcaggttaatttgtaaagctatgtgaagtcagtcattctgtacataagaaaacctggagatgctgtcctctgccttctttatgagccacatgtcaggctgctgccccacactccttccctggtgagggaagctgtcccattcacagtcctggtcacagtgcgtgggagacaactggaaacgcacagttcgggctgcctggaaaacacatgcagcctcctttcagggcctttgatctccctttgtctcccgcacagccaggcacaggttcagcgctcactcgctgccaagtgctggaggcgagctgtgctgctccctcaacattccttagtgccacggctccatgggcactgagttatgagtgtgaaagtttacttctcagggatacagctgcattaaccccgggcacggtgactcatgcctgtaatcccagcactttgggaggctgaggtggacggatcacaaggtcaggagatcaagaccatcctggctaacactgtaaaacccccctctctactaaaaacacaaaaaattagccgggcgtggtggtgggtgcctgtagtcccagctactcaggaggctgaggcaggagaatggcgtgaacccgggaggcggagcttgcagtgagccgagatcgagccactgcactccagcctgggtgacagagcaagactctgtcccccccacccccctccaaaaaaaagaacaaattcaaagcttgttcttaacacattactacctctgagcaagcatattttggtcctcgtaaatgagtggcataaacagatcttttaaggacaatacaagcaaaaccatgatcctgttactctgcagccgcctccacagaagactgctgaacacttccacatgctaggcgcctcactgcagcccctgcggagaactgacgacctcatcgaagaaaggctaacacatttttagccgggcacagtggctctggcctgtaatcccagcactttgggaggccgaggcaggtgaatcacaaggtcaggagttcgagactagtctgatcaatatggttaaaccccgtctctactaaaccgggtatggtggcaggcacctgtagtcccagctactccggagcctgaggcaggagaatcgcttgaacctgggaggtgaaggctgccatgagccaagatcacgccactgcactccagcctgggtgacagagtgagactccgtctcaaaaaaaaaaaaacaaaaacaaacaaaaaagaactaagagcagttttacatatttactcaaatttaaccacattaaaaaaaagaaacttccatccgaatgaccagaaccatttaagttgaagttcaatggttaagtttacttcctatatccatttttctgagatggagttggaatgaccaaaaggagagactagagggagaagcagaaaggatcccttcagaagcccaagaggaacagagagaagcatttgcttaataaaaacaaacaaacaaaacaaaataattaattatgtaaaatggaaaagtattaagggtactgctgaaaagtgagggagtgatatggctcctgggaagcagctctgacccaggactgggaacaggcctaccaggatgacctgttcttcaggagaagccttagggagcacagagaaaatgttagaggaaaataaccgaaaaaccctaatttacttacttggctgctcacttttcagatctgttttcaggactggtccctctgaggctgcaatttcagcccctcagctggtggcatcaatatgcagagacagcagtttctgacagaatttctgcatttgtttcagcaacttgccagtaagaagcacgttaagatcccactatgtccttccagctgcgtttctgggaagccgttgtgatggcaaatgcctacttagcaggcgctgccactgggtattttaaggaagcccatatttttagatgcagccacaagaaactgacactcccctgctggccctcaggtcaccccgggcccaccagagctgcccaggcacagcaggaagccctgtgccaagcatctccaggctgttctcaaagaagtcctagatgctctgatgaggcattgtgttcagtgaaaaaaaaccacccaaaacctgatgagcaatttcgtcactgtgtgatcagtgtcctcacacaaacagagacgtgtgagcatggaggcagtatccttaccacacactgaggccgtaacctgtacagtgtgtaactgtactgaataatggaagtaactgtacatcaatgataagtatctgtgtgtctaaacattatctaaacacagaaaaggtacagtaaaaatacggtataagaaatcaagaacgggacacctgtacagagcacttacggtgaatggagcaggtaggcctgagttgcactgggtgagtcagggagagaatgtgaaggcctgggccctcactggacaccactgtcacctttagaaacaccgtccacttaacactacactcaatttttaaattttcctttcttcaataataaaccctagcctactatggcttttttactttacaaactacttttttaaaagctttaaggtttttgactcttttgtaaacacaaatatatcatatagctgtacaaaaattttttttgttatatccttattccataagcttttttctattaaattttttttaactttttgaacttttttgttataaatgaagacacggccaggcacagtggctcatgcctataatcccagccctctgggaggccgaggcaggaggactgcttcagcccaggatttcgagaacagcccaggcaacacagtgagaccccatctctacaaaaaatcaaaaataaggcaggaagatcacttgggcccaggaggtcaaggctgcaatgagtcatgactgcacttccgcccaggtgagggagagaccctgcctcaaaacaaaacaaaacaaaaaaaccaaaaacccaaaaagacacaaaaaacacatattagcctaggcctacacagggtctggatcttccacctccacatcttgccccactggaaggtattcaggggcaacaacacacatggagctgtcatctcctgtcacaccaattgccttcttctggattcctcctgaagaacctgcctgaggctgctttacagttgactttgtttctagtaagtaggcagaatatgctcttaaaagtatagcaaatacacaaagtagtaacagtcgtttatcatcaattattacgtactgtatggtactgtacgtaactgtaggtgtatactctggtatgactggggcagtaggtttggtcacacctactgcagcaccacagacacgagtaatacactgccctcaacatggtagctccaacgtcaccaggtgccaggaatttttcagcaccatcatagtcttatgggaccactatcatattgtggtctgttgctgaccaaactgcatccggcagcacaggtacaggcatgcccagatggccttggtaatttctgtcagtgggatcacagcaaacacactcagtctgttggtcagggagtgtgcaggaagcctggggggccagcggcatctattcccaactcaggcatcatgccaagacagtgtcttctaaactctgagtaggaactgttctgggtcatttcacagtctttcctttcagaaaacaacagagaactgggaaaccagaagtccccgagcaggaaaagcctcaaaagagagaatcggcggggcactgtggctcatgcttgtaatcccagcactgtgggaggctgaggcagggggatcaccagaggtcgggagttcgagaccagcctgaccaacatggagaaaccccgtccctactaaaaataccaaaaaaaattagccaggcgtggtggcgcgtgcctgtaatcccagctactcgggaggctgaggcaggagaatcacttgagccagggaggtggaggctgcagtgagctgagatcgcgccactgcactccatcctgggcaacaagagcgaaactccatctcaaaaaacaaaaaaagagagaaaatcacaacaatcaagcccaacccagagcccttcactcccagttcctctgctcccccaactcccattcaagtcacagactagaagacagatactgagcggctacagtcgcaagcgcctcaggggcaactaggactgaaactctagcaccagaagcacagcaaggcgggtgaggcctctctgagggaaggacccccaccacacggcaacaacccctcacagcccattacaagttaaaccaacctaacaggcaggcattctcctaagactttctaaaccattctaagtatgacagtttcacacaaaacacggtagcctccaactggctactacaaaccatatctagatttttctcttttaagtacccagggttaggttgggcactagtggctcatgcctataatcctagcactttgggaggctgatgcgtgtggattgcttgagcccatgagttcaagaccagcctgggcaacacagcaatatttcatgtctactaaaaatttaaaaattagctgggcgtggtggcacatgcctgtagtcctagctacttgggaggttgaggtgggagaatcacctgagcctgggaagtcgaggctgcagtgagccatgatcacatcatgcactccagcctgggcaatggagtgagaccctgtctccaacaaaaaaggacccagagctattgatatgcccactatcttaactgtggccatggctccaaaggtatgtctgtgtaaatcaaaagttataaaaccatactgtatactctacatatggagctaagacacccactgacataaaaataatcgatttgtaaagaaatcctcccaaacaacacaaaagctccgactttataaaaatatttttggctgggcacagtggctcatacctgtaatcctagcactttgggaggccaaagcaggaagatcacttgagcccagaagttcaagactagcctgagcaacacaaagagaccctgtgtctacaaccaaccaatcaatcaatcaccaggtgtagtggtgcatgcctgtagtcccagctattcaggaggctgaggcaggaggattgcttaagcccaggaatttgaggctacagtgagctataatcatgcccctgaactctagcttgggtaacagcaggaccctgtctccaaaatacacacacacacacacacacacacacacacacacacacacacacacacttttaagtgtactgatgcaacctccctccccctttattggctaaaattcagtacataataccattaaagtactaaaataataagaacacactagaaaacaagaaattcaaaaaattagttaacttcctgccattacctctatccaaaggcccatcactaaagtcaagtcagttctgcccagaggaagggcagattctcagaaggcaaccaagagacaagaaacagaagcagggtcggagcgcggggcagcgctgccgaggctccacctgtacaaggtttcttggtctctaagctgcttgattcgccaagtgcagtaggagggagggggatgaaggaacattctaagaagttctaagacacctcagaaaagggcagactagttttattccttcacagagaagaggtgaagcctggttttactttaaagtaaacatgcccagtagctgagggctacttggagtggcggaggaaggaatgtgaatcacagcacacgaaatggagcactcagagcatctgctttgtgctgccccatgaggcctgctcaccaaagtgaggagctcacagaggtgcagcccctcatccaagccaacggcctggaggtaggaaagtgaggcaggggaagtctgattcccgagttggactcttagacataaacagataccgcttctcttgggagttttgctgcaacagcagcacagaggagagagagcagctcccagtagattttaaccagggcaactgtatcccccaaaaaacatccaccaagacagttttgcttgctacaactggggatggggagaaggagttgctaatggcatctagtgggtgggaagccagggaggctgctaaacatccaacaatgcacaggacagcccccaaaacagaatgttcccgtgcaaaatgtccacagtgccaaggcagagaaagcctgaattacctaagaaaacagggcagctatgactcactgggccctgctgtatcaggtactgtctcagcgctttatgtgcaccatctgatgtcatcctcccaacaattctacaaacagttactactctctctcttctacagaaaaggaaattgaggcaagagaaggcaagccatggacacaggccagtcagtggtggagttaaaattgaaaccaggctgggcgcggtgcctcacgcctataatcccagcactctgggaggccgaggcgggtggatcacctgaggtcaggagtttgagaccagcctggccaacatggtgaaaccccgtctctactaaaaatacaaaaattagctagacgtggtagtgggtgcctgcaattccagctactcccgaggctgaggcaggaggaatgcttgaacccgggaggcagaggctgcagcaggctgagatcacgccattgcgctccagcctgggtggcaagagtgagacgctgtctcaaaaaaaggactgaaacccaggcggcctctggctccacagtcgctccacagcccagctcttagctgcctccccagaccacaattccaatcatccagagctaagaataaccaggaagcttcagaaacacacacacacctccactgcgtcaaaggcaagacacaccactgacccacaaacactagagccaactagacctgtttgcatcccagccccagtgggatgccgcctcctccacagggaaaatcattttcaccccactgatgcccaaggttaacaggagtcacatcttcatgagcagtctatcattcctaatactttatagtctgctgctttgttgtttaggataatttaaaaatcagaaatgacagtaaaggtacaaaacaattaaaaccaacttaaaaacaaatatatgctaacaaaataaactcacctgatttgactgtccagtaaggtagggctcaaagtcattgtcatgaactgtatccttctgatgtaacgaaccattttgtactagaacaaaaagttgcaaaatattaccctcaaattttaaaagattacttttaagcttggaaggcaaagttagcaaagtctatttccatctatttctagcagaaattatgctttaattttaaaaggagtacaaccagtatagaactgatgtttatacaactaattagaagggggacgggaaactttcaataatttaggataaattttaaataaaggcttaatcgtaatttggtgagattaaccaaatcaagtgttaacacataatgcaaggaacacataaccagggtgaaaactgacatggtctaagaagacttatgtgtggcaaaaagaagtggagcctccaaaagcccaaatgcagaatgtatgcccaaacgtatggagaacggagggaagaaaacttaggagggaaggggctgcaactgaaggactgttgggagctattatctgactctccacagtgaaccccaaatatctgagacaggtctcagttaatttagaaaatttattttgccaaggttaaggacacacccatgatacaacctcaggaggtcttgacaacatgtgcccaaggtagtcgggggacagcttagttttatacattttagggagacatgagaaccatcaatgtaagatgtacattggtttggtccggagaggcgggacaacttgaagcagggagggggcttccaggtcataggtagataagagacaaacggctgcattctttcgagtttctgattagcctttccaaaggaagcaatcagataagcatttatctcagtgagcaggaatgactctgagttctgtcctttgtccaccaggaatttccttgtgggcaaactgtgggggaagtatgtaactttttttgtcttagaagctatctttttcaggaatagaatgggaggcaggtttgccctcagcagttctcagcgtagctttctccctttggctcagtgatttgggtgccccaagactggttttccttttacaccacttaccttcccactgttattatgctcagccagaaaaagcaagcaaaggtaaataaagtgctgggccttttccaatcttaaaacacgatgaaccgtatttggttacacctgagctgacacacaaactggctaaaaaagtgttccaagtaaacgtgaagtgtcacttaacagttttcacatgagtgcgctctgagggtttatcccaagccataatgtcacaggagatgctaacagacttggaaaacgggctgcaactaccggggatgtggagcttagcctgcagaaccttggactgcccctctcctagagcagcccctgctgggcggaaaaaggcaagtcgctcaacccctgcggccatgtccacccggctctcctacctccccttccccaaagcaaatccatgatcatgcggtggggagagacgggcccaaactactctgagcaatcatttattcacttcttgagaagcccctgtcttcgacctgtcaaatctcccagaatcgtcgcacaacctcaagttttatctccctgaagctggcggaagagagaaagtttccggttccagacgcagcttcctggaccgttccttccccgtcctcctccactccagcccgcgccggccgtcccgggactccgctcacctttattatcttgtccttttgttctctgcaccgccgcaggccgggacgtggggtacacacaacccgggggaagagggaaacacaaagttattcaccagagaactggtctccaacgggccgcgagctccgccggccccgacgcgcggtcacgtgcgaccccggccccgagaccccggtcccgcctgggcccggcctccgcgaccccgggctctgcgttccagccccaggacctcaacccagaccccgcgcctcggccccggccgcggcccctgtaacccggccccgctacctgggtgtccacgctggtggccgacatgcttcatgaacaactagacgcggggccggggcgcccgccggctcgggcctcccctagaggccgggcctgtcaccctagctcgcgcggccccgggccccgccgccaattccccgggcgccggccgggcggcggcggcggctgctgggcgcgcgggcccctggcgaggcggcagcggcggtgagcccgggacgcggacgcactgaggaggcgtcgactccaatggcggcggcggcggcgacagcagcggcgacggcggcggcaggggacgagactgcgcggcgtcagcgtgcacgcggggcaggccgggagcgccgcgccgggccgccacacttcgcgcctgcgcgctcccgtcttacgggatggatttcgctctcaggtcccagtctcgtgcggcggggcggggaccgcagccggctgggcggggaagccctgagccggggaagtcacgtggggcgtgtccggaggcgccgcggggcctggcgggaaggggctggcgggctgctgccaggtgtacagccgcccacacacaccccggccacagccgcacccccgacgcgctaccggcactgaggcctctgtagttttccccaaggtccgaagactaaacgctgttctggtccgacagctgggctacgggtctgtccggggtcggtctgcccttcccccgcgcgcaaacacctgcccgcccagagctccgagcccccgcgtgttccaggtcgcgcgcctcggcccttgccgcgggacctgcgggctttgttcgctttgcggccctggccttcagccgcagcggagccctgggcccggtcccggaggtcagctgttgtgtggatgcacccctggacctgcgagaggctcgccggcttataaccaagttctcatgttagattcttgaccccgatttcatcaccaggaggaaaagcagtgctctgtgccccagcctaggccgggccaggggacttgtcatctttgttcgaggatggacagccccttcttagcagcaactgtgcaaagagagcccagttctcagttcctaacccctcagcatccccaacctggacgcccttctggtcaaggtgttgaatttcgctccctgcagccagtatccaatcctgccacccttgtggctaactccctacagaggcttccaggttgatatttttctttccagctctggcagctgtaacatcttcacgtggcctggatctgggtcctgctaaaggagaaagacctggaatggggtgtcaggcaggttgacgtcaaatgagtgttttccacaaagtgggcccgggcagatgcgctaagcagggtgaacagtgacagcagggacggcaatggagtcccaagacggctccaagcctggacatccgcatcagtggggtagcagacagcctctcacactgctgcaggaggaggtggaaactgcccccagcaggccggtcagccacagagaggactgctgctccaagttgctccaggtctccctggagccctgcctcgcctaaagctggggaaagcgggctgggcttgtttccctggaacagagctgggggatgtctggtgccctgaggatgaatctggatcccctgggactttgatgtgtttgggccatgggcagacatctcaggccaggatgaaatctgtgcatttggggtacatccgaaaatgaacagcacgtttccaggatggtggcccacatggagaagatgtgtggggattgtagggacagtggggtccctgggggcaccctgccacctgcttctgtgtgataaggcctgcgcatcctgggcaggccctgagtgcctgcttcccaggacactgaactgtttggcggccaagactgcagcaagggggtgtctgggtggtcagagtagacactcggactcttggagcccctgtctgtcttctcacccagctcccatccctgggccaggacggtgcagtggtcaccactggagttcagagcctcacagccagttacagggccttcagcctcaggcctactttcctcctccgtggtgggttaattactcccctttcacaggatgagtgtgtggaagaaactgggtatgcagcccttggcgtcaggccagggctctgtcaacactggctgttacctgctgccttcacccacaaatgcccagccagtcacaggaggcagcactggccctgcgggaagtggccactccgagcttaggggccttcttagatggctgagtgccggcaatgcaggaccctggaggtgtttcagtttcctggagctatctcaacaaagtacccggaactggggggcttaaaataacggcaatttattctctcccagttctggaggccagaagtctcagatcagtattgctgggctgaagtggagacagaagctccttccagggccctcggggaggatcctagcctcctccagcctccggtggaggccgcagcccttcctggtctttcctcctcgcctccgtcacctcatggccttttcctctgtgcctgtgtctcttcttataaggacactcatctggatttagagcccaccctaatccaggataacctcatcgtcttgtgattatatctgcaaagaacctatttctaaataaagtcacgcaggtaccaggtggacatgagttttgggggtacactcttcagctcactacagagatcactggggaggcctcacagtgatgcctatggagagattttggagggtgactcctggggctgagtaggttctactcacaaatgtagatggaaggagaggcccccacagtgaggcctgaggaggcaccaccatgccagcctagccccactggccagggaagaggctggcaggatcccacagccactgcccggacccacccaggcttttgctgtgaactccagaaggctccatgctgaccctgacatggaaggagactgggggctgcccaggggcaggacaggtctggttggcgggaacagggggccctaaagtgaattgaatgcagggggtgtggcaccagcagggggtgctgaggtccccaggccagctctggggggaaagcctttatcttggccaggcctgaggacctgggagggtgtcacagaaaaccaggagttgagctgcctgtaaccttggagggccacgtccactgcccagcctgcccaggttcacaccccagcccagctctcggccaggaaaagggaggtcacccagcaccgaatgtcaggggacaactgtctctccctcacagggagcaggcagctcctcatgtcatggatggaaacggatcagagggctttggccactcctctgggtggcccagcggtcttgagacaaagcctgccatttctaagcctgtgccgtcaatgacagacaagagcccatcccctgtgggccgtctgccttcagacgggaaccttcttgctcggggaacctgttgctcatccaagagcccttcctagcagtacccgctcctggcagcaccctcaagtggtatgggattgtctaaacatgactagcattaggaaggtttgggtttttatttatttgaaagtcacacaggcgcatggttaaaaagctatctttgcactcaaaggatataaggtgggaagcaaaaaccaccacccccaaacccctcagagagggagccctccagatgcctgcctgtgcatgcaagcatgagtctctgtctccactatctgcccttgcatctcacgtgttgggaaaccgcactttggggatccacagtgctgctgagtatcaacacccgccgtccacccacctcgtccctctccagggagggcatgggctccagcctcatccagtgagtgtcctggccccaacacacatgcacacgtgtgcgaagacacctggcaggaggctcctgcccatggaatcactgggccaaaggcgcttacactggccattgtgctgatgttgccagatggcccccaaggaggctgtaccaaaacccccagccaagaggaggtttctgagctgggtgcagggtccaaacgctgtgggccctgaattcagatgatccctggctgaaccaaacccctcctgagtgctggacacagctcaccctgcagctggcctctgggggctctcagtgaagatacccatctgtctcgatggacaccagccactcacgcagctgccctctccacgaatgctgtctcaggtcctcatctcctccctcacctcaaccccgggctcatccccagtcggcaggcctccttccaaaaccgctccccaccgtactccctggcggggctgctttgtccttgatgaaactggctcctgctctcttggttcctcctgcctccctgtgccttgggagtgcactgacatggagtgtgctgacgtggagtgtgtggagtgcgctgacgtggagtgcgctgatgagtgtgtggagtgggctgacatggagtgggctggcatggagtgtgtggagtgggctgacgtggagtgcgctgacgagtgtgtggagtgcgctgacgtggagtgggctggcgtggagtgtgtggagtgggctggcgtggagtgtgtggagtgggctgacatggaggagtgtgtggagtgcgctgatgtggagtgtggggagtgggctgacgtggagtgtgtggagtgcgctgacgtggagtgcgctgacgtgcctcccatgatgcacggcactttacagttttcaaaccttctctctctaagcttctcattggaccattcaccccacaagtgtgaactgagcacatacttattatgtgtatggggcgtgggggcacgaggtggcccctgcccagcagagctcctggtgctgggaccttccatagccctacaaaggttcatctagcttcactgagcacctgctgttctccacacacggggacagaacaggccaggtgctgctcctgcaacccagatgggaggcagaggtagatgggtcactgtagatctgagctgtgatggaggcaggacagagaggagcccagagactcaggataggcaggcactcaccaaatgaggatgcaggcaggtgggcagggtgccccaggtggatggacagcaggaggcaggacacagcaacacctgcctgcccactggaaggtcaggtccctgagcaggtcccctcgtgtccactgccgagtgcaggtacagggaagacggctcagcacgtggaaggaagctctgcattgcatccagagagccgagggagttagagcaactctggattgctggagcagctaagcctctgagaagttaatgaaagtgtccaggccgcatagttactctggcagctccctgagctctcacctggtcctgagccctggcacctgccctgtccttggccctgctccatcggcatgacatcccccaggggccagcaacccagcctgaacagtaaagctcctagccccggtcctgctggtctgcaggcctcagctccctccctgcttttccaggagttgaaacagggcctctcctaactccactttgccaagagcctcttctcccactgcagagaactgtcatctgcctgtaagtaccagtgccaggtgctctggggccgatgtctccgttagccccaaggtggaggctcagggagcagatgtgagcgtgccttgctcatcgcagtagcttcggactgcagggattgcagggactgcagggattgcagggattgcagggattgcagggactgcagggattgcagggactgcagggactgcagggactgcagggactgcagggactgcagggattgcagggattgcagggattgcagggactgcagggattgcagggactgcagggactgcagggattgcagggactgcagggactgcagggactgcagggattgcagggattgcagggactgcagggactgcattgctcttgcagcaccacccgcctccgtggacaccttcagcagtgagacaatgcaggctctgctacaagaggtgcttactgggctctgctctggtgaggagaggcctcgcctggcagccagacagagtcccagcagggcaagatgaaaattcggggccctcgttcaaacagcaagagaaggctctttccttccttccagcgcccctccctgcacctgtgatggtgtttttatttgttatttaacgtcatgtgctcttgggcaaggggaggggaaactctcacaggcacctgaacctgtccctgtggctccatgcatgggccatgcccctgatccctctgtgcccacacccaggtccctgctgggatgagggttggcaggggtcactgggtggctaaacaccattcctgggggtggggggaggagggttgtgccaagccaggctcccagaccccaagtgcaggcgcatgccaccatctcatcagatggcactcacaaaacacagattcagacaaaagtgttaatatcaagatggtgacgacagcaccctctgggtgtggggccgcttgggtcacatcctatgaggccagccctgggtctgaaagacaccagaggagtccctggatgccaccaggactctggggctctaccagaggtcttcaaagagggggaccatggggacgactcaggctagaaagtggggaggaaaccatgccaggagggggaccagagagtaaccaacatgatcagatgacacagataggcacctgcaggctcaggcttcacagctagagctgcaggtggcccagaaagggaggccccacaatggctggatctacctgggccaggtgcctggggagggccacaggtgggacaggaatgagaatgggcagggctagctctggagaacaggacctggggttgggcggtgctacagggaggcgtgccgggtgctgagtactgtgctagcaaaagacgctgctgatttcatctgcccttgcaaacagcagcctctccccaggggagcacctgtcccaggatgaggaaggccacctggactctcccacccttccacgtggcttgctagctgtcttgggtgactctactggcctgcccggcatgtagctcccttcagttgagtgaccacattcctgatattctttcagggcgtcccctcctcaacccctgtggttggggatggatgcctcacctgggcctgatgccagtccagagagggagaagcaagtgaatgaagatgcttgaacaccaggatccagctgagtctgaaatggtccacttctgtgcttttggttgggtgaagcaatacatttcatttttagctttgagtttctgtcacctgcagctgagtgtcctgaccatagggacaagcataacatacgaacctcgggcctggcccacagttccacagaggaggagtgtgtctggacagtccagccctgctcagatccctcccttgttcccagcgcctcttggaccaggggctccaggtacccgtgcgctagccccacacacctctgcacccctgtctgcctacagtccccaggatgccagccacatgcacatcccccagggccacgctgttccctctgcctgaagccgcctgcttcacctcctctccaaagcttcgtgtggctcctcgagatctcatgctcaccctggggacacctgggaccactgggtcatcacttgtctgtagggacagctccaaggcccctggtgtcacctctgtgctgtcacctgctttatgtccagcagagggagctctgaatcaggagttaggtccttggtgtgcaccttccagctccccagggacctgcctcagtttccccagctgggaggcagcatgtggaagggagcgccagaggggctcaccccacctggtgggcattctgtaacttgtggcctgctgtgtccagcaggtgctgctattgaacctttgaaattgagaaactgccctttcaattttatttaattaaattccagcagacacacgcagctagtggctaatgtctttgacggccaagctcagactccaggcactgatactcaacgctgatccttcacactcccagaaagctttaattaacacacatgtccacccctctgccccccaccgacccccagcagagaaatcaaagtagtctggggtggagttggtgacctacatggtcaggaggcctctggttgagcctgaaacctccaggtgagcctgatggctgcacatgtgcctagcactctgcgaggttggcaagctcctaagacctgctcacccaccctgctccctctgctgcgtggagctggggagtgttcagtggcccctctcactctgcgtgtggagctggggagtgctcactggcccctctcactctgcatgtggagctggggagtgctcactggccctgctcactctgcgtgtggagctggagagtgcagtgtccagtttgcctcttgcagcctcttgcttccccttccctctccagagtcctccctgtggtcccagagctccctgatctagcctttcctaaagctgactcaaccacctcctggattcccaggctggaatctggggccagagatggtgcatctcatgttttcaaatgatgcccagaagctcacagatagcagggctgttcggtggatgtctgggctctgcaggattgcgggaacagaggcctgctgctctcatcctcccgccctccccattaatacaggccttctgtccatccctggccctaggtggcctctcagctcaacttcacaagccacaggggcttgggaagctgcaggaaggagccaggcacagctgtactaaataagcttctccccacccctgcccccaacaggcctgggccaggcatgccaggaaaataaatcagactaacggacccaggtggggccacagccacgggaggtgtggtccagacagctgccgtggcactgaggaatgctgaccatccagactgagacccatggtcgggtcagcatccagcccagcccagtccagcaggtggggagaagcccgtggtggggcctgctctgggcccacgctggtcttctcaggacgctccctgctggcctcttgcaactctgcctgtggctctctaggcgctggctgggagccagcgctcaccgcagccaaagcccagagggatggacttgcgccaggatgctggccccttggcaggatacctggggagtccctgggctctgggaggccctcagcggggtgcccagggcagtgacccctcgggaacatacctactgctcatttttgttttggggtctgctctggagagctccacctaagactcggggaggaagctgtaaaccaaaaagcatgagaggcagggctcagtcgatcgagacgtttattttgccaaggttaaggacatgcctagaagaaaagcacatggagtcacatgtccttttagtctgtggtctgtgcctttctccaaagatgcttttgagggctccaccatttaaagggggggaaagcaggctggaggggcaagagggaggccttggtaatcacatgctgcaagagaagaggagcaggcaggggaatcgtcagctgtgtgttcctctcatgctcggaaacctgcacttgtatgaaataaggtgaacgtctcctgtagagatgcttcacctgttatctgtaactacctgcttaggaacaaaaagaaaggcagcttctcacatgacttagcttttagtttaatttttttcttgtggcagagtgaattggggtcctgagtttgtttttgtttttgtttttgtttttgttttgaaacagagtttcgctcttgttgcccaggctggagtgcaatggcgtgatctcagctcaccacaacctccgcctccagggttcaagcgattctcctgcctcagcctcccaagtggctgggattacaggcatgcgccaccacgcctggctaattttgtatttttagtagagatggggtttcttcatgttggccaggctggtctcaaactcccaacctcaggtgatccgcccgccttggcctcccaaaatgctgggattacaggcgtgagccactgcactggccttgttttgcgatggagtcttgctcttgttgcccaggctggagtgccgtggtgcagtctcagctcactacaacctccgcctcctgggttcaagcgattctcccacctcagattcccgagtagctgggattacaggcgcgcgccaccccacccagctaatttttttagtagagacggggttttgccatgttggccaggctggtctccaactcctggcttcaagtgatccccacctgcttcagccttccaaagtgctgggattacaggtgtgagtcaccgcgcccagcccctccagaccatctgaaaacaggaaactagccagcctgcctgtctcacttcgagcttcttaatgccgttgccagcctcagaagctggaagcccctcctgtgggcctctgatgcacttgtccggagccctgcggtcccctggagtccttgctctgtggccacagggagggttgctccagtgctggcaggctctggccccccaagctgaggaggaggggaccggctcagccacttttggtgagggcacttagggttgttcagcaggagtggggctgggtgcgggagggttgcctgtcacaggggttaccggcccaccttgcccagcatacacctgctgagcttcctgggaacccaggcctgaggcctggacaggaattggagcttctcctcctccctcccacctctttcctcctcttccctcccacccctttcctcctcctccctcccacccctttcctcctcctccctcccacccctttcctccttctcctcagcttatgtgggctccaggtccagcctcattccagccggcacggcccggaggtgagcaggacctggcctcatgtgactgcaaccacaagcccagactttcgttgcagccactgacccagaatcccaggactgccaggactggacggcccagacgcagtggttgtggggcccacaggtggaggcaggctggaccccgccccaaggttttcccgccacaaacagatctctaagcaggacatgggcaagggtggggaagggaacccgagatcctgcagtaccacaccaggcccccaaggcccctctgtcccaggccctcgtcaggcagatctgggtgtggggcatggccatgccacagcaggccaggatggtgaagcagcccggcgaatttcaccccaaaatacgtgtgacaaaaagagccaaactctgtacaatatttaaagggtttattctgagcctaataccggtggccatggcctgaggtacagtcttattatgtcttgagcacatgtgtcccggtggttgggtgacagcttggttttataccttttagggagacatcggcatcagttagtacatgtgaggtgtacattgctcaggttcaggaaggcagaacgactcaaagcagggggtggggccttacgggtcctgggtgggggcttatgggccctaggtggggctttacgtgtcctgagtgggggcttacgtgtcctgggtggagccttacaggtcctaggtgggggcttacgggtcctagttgggggcttacaggtcctaggtgggggcttacgggtcctgggtggattgtggattcaaagatcttctgattggcagttggttgaaagagttaagttattatctaaagaccaataggaaggagcatctgggttaagataaggggttgtggagactgaggttcttactatgaagatgaagtcccataggtgtctgtccttaaagacagtagatggcaaatgtttcctatgcagacctttagaaggtgctggaccctcaggtaacctcttcaggattgggagggcctggaaggggaaagagctagttatgttaatagagattccttacagacacaaattttcccccacacaagatggctttgcagggccttttctttctttcttttctttcttttttttttttttttttttctttgagatggagttttgctcttgttgcccaggctggagtgcaatgacgtgatctgggctcactgccacctgtgcctcctgggttcaagcgattctcctgcctcagcctccgaagtggctgggattacagccatgcaccaccacacctggctaattttgtatctttggtaaggacagggtttctccacgttggtcaggctggtctcgaactcctgacctcaggtggtctgcctcccttggcctctcaaagtgctgggattataggtgtgagccaccgtgcccggtcttgattttttttttttttttttttgacggagtctcactctgtcgcccaggctggagtgcagtggtgcgatctccgcccactgaaacctcagcctcccaggttctagcaattctcctgcctcagcctcccgagtagctgggactacaggcacacgctgccacgcccggctacgtttctgtattttagtagagacagggtttcaccgtgttgcccaggctggtcttgaactcccgagctcaggcaatccacccgcctcagcctcccagagtactaggattacaggcgtgagccaccacgcccggccaatagggcctttccaaactatggcaaagaaatgtatttggggataaaatatttttctttccttgtttgtcatgtgatattatgccagagtcaggctggcattcgggatcttacagtctgtttagtcagtttggtgttttttttttttttttttttttggagataggatctccctctgtcatcctggctggagttcagtggcccagctcagtgcagcttggacctttctggctcaagcgatcctcctgcctctacctcctgagtagctgggaggacaggtgcacaccaccacacctggctaatttgttcttttgtttgttttgagagatgaggtctcattatgttccccaggctggtcttgaactcctgagctcaggagagcctctggcctcagcctccgaaagtgctgggataacaggcgtgagccactgcgcctggcctgttttgtcaggcttaagagctcgattttaatgttaacgctggtcagtcgttcctgaactccaaaaggaggagggtctcacgaggcctgtctggcccccaccttcctgtcatgggctgaacttgtttttcagatttccttgagtaccgttggccaagagggggctccattcagtcaactaggggcttggaatttttttttggctcacatatggtgcccgggcgtactcactgctctaagtcagaggccactgaagggcggcagatgctggaagaggctctgctgtgattttcccttttctgccttagggccggccccaccatggggaagcgcagtcaccttccaccgcttccctgaaaccccttttctgccttaggccgggccccaccatggagaagcgcagtcaccttccaccccttccctgaaacctcagaaaagagggcagcagcaatgcagccttacctggacggacctgtgccccagataatgtctcctctggaggtcattcgaattccaaagggaatcacttacaagttagttcctgtctctggagtccctcccttctccccgaagatcactcatgccccatcaaaagaaccgtccacactccccgtctcccctccctgatgaagaagggtacaggagcactggcctcccggcaggttctcaggccatcgccctcctgcggccccaccccacgcgtggggatcatgtctcccccggcagcggctgccgctgcctccctggacaggcttcctggccctccatctccgctctcagccaactcattgtgcccctctctgagcctcggtttcctcacctctgaaataagctctgtgcccatctcgaagggtaactgaggagatcagtgagggaatgtgggtgatggccttagcatagggcttggcacactgtcctggttgggaccctcccagtgaatcccaaagcaagctgacatctagctgtcagagaggagaccattccttatattgtcttatacttaatttcttgtttgctgaaaaagtagaagttagaattggcagaagtgaaaaatcacagacaactggggaccacatttcagacctggtgttaaaattcaacctctgacctcagggcttgtgctatctatggattcagacattgtgtaaaaaagcatcatgaaactccctgttctgttctgtttcgttctgatcattggtgcatgcagcccccagtcacataccccttgcttgctcaatagatcacgacccccgcccccacagcccctttagagttgtgagcccttaaaagggacaggaatcacttattcggagagctcggtttctaggacgtgagtctgccgacgatcccagctgaataaagctctttccttccacaatccagtgtctgaggaattttgtctatgactcctcctgctacagctggagggaaactctcttccttcctagccccagttgtctctttgtaactatgatagtttgctgccgatggacacggcaagtctgtatgctgagatgctgggttgcagcaaagaaggggttaatcatagggtcactaaagaagttgctgggagggaacctcaaatccatctcccagaggaatctggggctggggtttgttgttgttgttgtttggtgtctgtttggtgtttgtttgtttgttttttgagacagtcccacgctggaattcaagggcacaatcatagtgaaatggcaaagatttccttgtccccttgcagggcctgcgatggggactggctcgcttctttggggccccgctgctcaaacccctaggggagcatatagatgggcagggagccccacggcagcttctaggggtgaatgtttacagctgaacctccagtgggcatgtgctacagggcactctcttagtttagccgtccgtaggtggcttgtgttaaccagctcagttaggcctctgccttaccgcaaggacagagggctttctgtatcccagggttcttgctgtgccggaagaatcagatcacacatgggcttggagaatgagtgcaaagtttgattgagtggaagtagctctcggcagatgggggagccagaagggagatggctttcccctggaatcaggccgctcagcagccggggctctcctccaaccatcccaaccaaactctgcatcgttccactagctgatcgcctgccggagtctcagtgtgctcttctgccggcgtgctccccctgatggcctctcgacgtccagccgcttgtgtgttctgccaatgggctcctctccgtgtccagggcttaggtgcctgcccgctaggtctcagggtttctataggcaccagatgggggcgtggcagggcagggtggtcttgggaaatgcaacatttggacatgaaggcagggtgtgtctatcctcacctaggtccgtgggcacaggcctgtgcgtggagccctagccagggaccatgccctcctctagccagcacttccctgcccaccactcctgcagccttcaactcctgggctcgcataatcctgctgcctcagcctcctgagtagctgggaccacagttgtgcaccaccatgcccagctatgtttttaaaatttttttgtggagatggagcctcgctatgttgtccaggctggtcttgcactcctgggttcaagcagtcctcctgccttgaggctggggttttccagagttttggagtgggccaaatgtgcagatggttgattagtagaaggttgcagggtgaagccacaggacagagtgaagaagctgttctcatgtggatcccatccctccatgagggtcttcaaactggttgctggaatttggggtctgaaaaacatcttaaggaatcaacaaaagcctcatgactgtaatatcagggatcgcatctgtgggaacacagtggtcacgaccgagggcaacgtggtgatgtttagcagcgagaaagcgggccaccgtgcagtctgattaatgcttaattataataatatttctgtccagaacccgacatgcaattcttgtcagccctgtggagacagttttgttacaggaaaggggtccggatccagaccccaagagagggttcttggatctcctgcaagaaagaattcagggtgagtctgtaaagtgaaagcaagtttcttaggaaagtaaaggaatcaagaatggctactccatagtcagagtagccctgagggctgctggttgcccacttttttggttatctcttgatgatacgctaaacaaggggtggattattcatgcctcccctttttagaccatctagggtaacttcctgatgttgctatggcatttgtaaactgtcctggcgctggtggagagtgaggacgtccagaggtcactctcgtgaccatcctggttttggtgggtttttgtcggcttctttgccacgacctgttttatcagcaaggtctttgtgacctgtattttgtgctgacctcctgtctcatcctgcgacttaaaatgccttcaccgtctgggaatgcagcccggtgggtctcagcctcattttaccattttacccagctcccgttcaacacggagctgctctggttcacatgcctctgacggtttcaccttctgctcagagcatttggacctccacaggctctgactcagccctcttatcccaggctgatcccatccccgtctaaaaatcccactaacttccttctgagaaagttgagagtcttgtttatactaaagtgttaatgactcacaaagcattcccagaggaaaagttaacaggaggagactgtgaggctctggcggtgaaaggtcaggcatgagccctgggggagatgttttcttctctggaggcccctcctgagaccccccatctctgcacaggaagacgaaccctgtgcccagcgggtccacctatctgcccacgtggccccaaccccaggcttcatggagtagagcagggctcattcgtgtggcacccacacgcagtttcagggcgtggactttcccggatggctgggtggctttgggggaggtgtgagctgttggtggagaatgctgagcccggccctgacgacggtcctcttttcctgccttaataggctagtccccatcactgtggggggcaatttggggatattctcctccaactcctgctggttctgaatcttgcagggagctgcaaatcccagtcactgtggggtcttggggcttctaggagtccctgctgggcccagggcttttttctcactgacctggaggcctctccccacggctccccatctgacatcttctcagctgggagacttaattgtaaagactcacagggatccagggggcatcacagggggccctcctaggtactgacagatgtttattcattttgaaaaatgggcaaatagcaaataaagatgtttagggtatgtttggaagaaaacagcaaaatagtaacagcagtgcttaccgctcagcggggagaaggcatatgggttttcccagcttttatttggaaatcattgtagatgcagaattgcaaagaagcctagaggtgtccatgcaccctgccccaccccacggtatcatcctgcaaagctgcagggcaactgccaaatccagacacacacgccccggtgcccacagggatggctcagacatcgaacttcgctttctttatactcccagtattcccgacacttctggaataggcacatgaccattatttttagctccttatttctttttatttaattaaataagcaacatatggatagtccttgttttgagaattttgggccggccgcacacggcaaagcagctgagcgcccctcagcagctccctgcacagttacgcactgggatggcactgcgatgcgtgtggagaaacacctgctgggtttggaggtgcacaggacctcggggcgatcccaccggaggagcggggctcggcttatggcccagctaaccccaactccccagtgggccccagggcctttccttccacttccaggagtgacaccaaccttgtctcctctccgagccccaagcagtgggaagagagggtcccataacaggccatggcagcggcctctgctgcctgcccacctcagagggtccccagcttgagagttcagagcaaacctgggtgctgcatgtgtctctcccctggaagaagcaggctggagacagtggcccctcttcccacctccccggtgcactgcgggcagactgggaaccaggcagcaaatccacccagcttgaggcccacgtcctcctgaaagggccccaggcccacacccggggttttgctgaagtgaccaaaggtaaccgctgtgctgagggggcggtggaggacagggagggggcgaaggcgaggtgggcgctggaggacgtgggggtgaaggcgaggtggtcgctggaggacagggagggggcgaaggtgtggtggacgctggaggacagagagggggcaaaggcgaggtgggcgctggaggacagagagggggtgaaggcgaggtgggcactggaggacagagagggggcgaaggcgaggtgggcactggaggacagagagggggcgaaggcgaggtaccctgagatcatcccagaaaacacactgggaagttctaccttgtgtctagcctaactcctttgctggccctcaggccctttcccgacagccctcccctcctatgcccctgagcttcctgctgcctctccctctgcgccctgcagccctggcttctgggctctatcctcagcagggcctgcagacaccccagaggccttaagagcctgggaggggtttccagccacacccttcactttgatttctgcaggaaaccaggtggctctgggccttgcataggaaagggttgggggtctcgctggggcctggcaacactggcctgagtatgaccagaacagtcaccagaggcctcctgggagggcgggtgcagccccagcccccgccgtgagtgggggtcggggggcaggtgtgaaagtgtggtgggcagcagctgggtctatgcggctcagcagtgggaagagaacgggccaggcttccaggtgagctcagggacggttttcactgcagctaaccctctcctgcccacctgcgctccccgtggcaaccagcggccctgcagcgtgcgactcctctttattcttccaaactctgtgagcctgcacgctcccatccaggacggaacagcaggggagagtggctgaaggatgacagggggcttttagggccagccgggtggatgagctgggtttgctggggttgagggctcagtcgggggttggggggtgtcgaagtctgggccccatccagctgtcctttttgtcccgcccaggtgtccctggggttcctgttctgcccctggcttctctggggttaagtcctcctccctgttccctcactgtggggtttggcagtgtggcacagtgtggagcttggaccggcagccagggtcacagcagacctcaggaactccgattccagtgccaacactgagtactcctcttttgggggcatcagagcctctcccttggctacctggggaggctggtatggagggaggtggagggagatgggggaagggggagcgggaggtgagggcagctcgggcccttctttttgctctgatcttcctggcctgaggacaagagctgctcccagacctgcagaggccccttggggcagagggatgtttcagagaacagccgggtgacctgcctccctgctctgcgtgacgcagccctaggcccctgtgaggctagagtcacccccgcaaggtgggaggtcacggcccctgcctgcacaggcagcacagctcacatgtccttccttgagccttctctgcttccggaggctgccctgggcgcctgaccttggagccatcatctccagctccccaacccctcccccacagccctggggcagacaccagcctggggaggggtctccatgctcagttccttcccgtcttgttcagagagacgtggcctgcccacgtgcagtcagcggcatccgcaaccctgccaggggccccgtgacacgcccccgctgcacagagcatgtgaccccagaggccaccctggccacttccagaaagctgtgggccctgggatactcccctcccagggtgtctggtggcaggcctgtgcctatccctgctgtccccagggtgggccccgggggtcaggagctccagaagggccagctgggcatattctgagattggccatcagcccccatttctgctgcaaacctggtcagagccagtgttccctccatgggacctaaagacagtgccaagtgcctgcaccgtggaccacagccgagccactgggcagccggtgatggtcccacgcaggagcgctgtggaccccgctctctgggcagccctgtcctaggcctggacacctgcagagcctgggaccacgtggatgggcagatcctgggccagctgcggcccctgacagaggaggaagaggaggagggcgccggggccaccttgtccagggggcctgccttccccggcatgggctctgaggagttgcgtctggcctccttctatgactggccgctgactgctgaggtgccacccgagctgctggctgctgccggcttcttccacacaggtcagtcccgggcgggggggccttcctgccgtgggcctgggcacgattctggacccttccagcccagggctctgcctcctccgtagcatccatcccccaacaggaagggtctggcctgatgacggagcagtggtcctgcaagcccctccagtgcccatgggctcgtgcctgacaccctcccccggagtctctgctggctgagtgtttcagaccgtgggatgtgaggaggggctgcctctggccacagtctgagggtctcagctgtggaggccgccagcttggtgcacaagtacccctttgtgatagaagtgggtggggctgacattgcctggggccctcaccttccccgctgctgttctgcacagggagaggagatgtttaaagaacaggatcagggtgaccaaggcaggcagtggtcagccagaaggtcctggatgctcagcctgtggggaatttctccaggccccaacctgcagctactgtctggtcttccccaactgaatcaagtccccggagtacctatcctagtcttggcccgggcctgctcctctgccctacagctgcagaccatgtggtcagacctgagttcaggtcccagctctgccacttcctggctgaaggacagggcagcagggcccaccgagggctttacaaatactggcacagccatggtcattgtcagcagtgggctctggcggggcaccatcctggtaaggctggaccaacttaagacagctggtcggggggacagtggctgggacagtcagaagccgtggcgtgaaggggcaggcccagctcacccacctccctggaagtccaaggctcaggaggcaaaggccaggcaagaggcatggcaggtgcagagccggggtctttggggctggtagaggtccagtgcccgatgcagcccaaacctgtgatgtcagtggcaggtgacgtatcgcatggatgccgatgaggggacggggtcgccaggaggtagagagatgacgggtcccccacccccaaagggaggcatgagttcctaaaagcaagcctggccccagactggccttctagggcagcctcccttcttcttctcactgggaatccatcttggggaagcagagacctggggaggggcccttctggctcctgaagccccagggctatagatgtaccaagccctggggggcccccactgctcactctgggaacaatgcaaatgccagctcagtcctttcctgaacattctcgcccatcctggccggcaccccagtcacccttgtccccttttcacctttgatgctaatgaggtacaagtgacatcccccaccaagccccctgcccaccccctcctccttcttgccacctgggagctcccctccagctgaagctctcatagccttggaaggacacaccgggggcccggggactgggtgggacttggctggggccagcatctctccgcaccccaggccatcaggacaaggtgaggtgcttcttctgctatgggggcctgcagagctggaagcgcggggacgacccctggacggagcatgccaagtggttccccaggtaccggctgcccctgcggggccccgggtctgatcatgggtagggggtgggcccccaacggctctgtcgacccaacaccaggcctgctttgcctccctggccccacagggcactggggaggcccttctgtgggaggtgcttctggccggcaggtacccacttttcctgtgagggccccttttcggaagggctgctgggggcagaaatgcctctcccatgggactaccctgaagccccatggaggcgtctccacagcagccctcctcgcccatgcccacgggcactgcagggtggcgggaggagggggcccaaccctgacccccggggatccaagggcttgaagcagacagtgggggccctgaaccccaacctacatctctggggcatctgcagctgtcagttcctgctccggtcaaaaggaagagactttgtccacagtgtgcaggagactcactcccagctgctgggctcctgggtgagcgccacctctcctcggggctccgggtggcagtggggtcctgcccctcctatttccccaaggcctgatggtctctggctccttccaggacccgtgggaagaaccggaagacgcagcccctgtggccccctccggtgagagctgacaccacccctgctgactccttgtgcgcctgcagcctgtgcttggccaaggccactgggtgtccccaccctcccagacagcagggagagtgacgggcacgtgacagggtgtgacgctgctgcctgggttggcttcagggggctgtgccatgtgagggtgggggcggggcggcaggggcctcccccagtgccaggccccattctgcttctctcccagcttaccccttgggcacagcccattgcctgtcgccataccacccccaacagtgcccagcacacagcatctgcagctactgccagatgggcaggatgtgcagagggcattggacaagggacaggctctctggtggcgcctccaggaagcctctggatcctgttatgctgtgggaggggtgggaagaagtgtcgggagcggggatactctgcagcccctccactcccggccagaactggaccccacaggctgcagacctgtatctgggccggcccagctttctccttgggagttaggcctcaagtctatcctaactgtccacagtccctgcctctgggtaccctgagctgcccacacccaggagagaggtccagtctgaaagtgcccaggagccaggtgcaggcccgggaccccctgggtgagggctggggcaggggagggctgagggaccccgaccttccatggcccatagagggtgggggccagggtgtggggacatttcgcaggcctgtcctcctaggaggggtcagtccagccgaggcccagagggcgtggtgggttcttgagcccccaggagccagggatgtggaggcgcagctgcggcggctgcaggaggagaggacgtgcaaggtgtgcctggaccgcgccgtgtccatcgtctttgtgccgtgcggccacctggtctgtgctgagtgtgcccccggcctgcagctgtgccccatctgcagagcccccgtccgcagccgcgtgcgcaccttcctgtcctaggccaggtgagcgccccagcaccacgcgcagccagccctcctgcggagggggccctgagccggctgtgcccggccctcctgaacccatgcaggcccttcccgggtggcagcgtcagcttgtttttacccggctcccaggtcccgctgatagcgcccatcaatcttactacctcccttgacgcttaggttggggcctggtccttcgggcaccgtgccctggcggccaccatagctctgcctgcctgcattaactgacgcctgctggctcctctcagccttgattttcctcagtggtcaaggaaagccggctttggaggcgtttggggaaacagggtgggccaggttgggcttacacaagcgagacactggcctggcttcaacccggggccaaggcatggtgggaacacctgcacgggaagggggtgtgtgaacctgttcttagagaagtgggtgggataccccatactggccgagggacaggtgctgtgaccgcctcggggctccccagagcctctgtagttacccccgggatgtgtctgaagatctggcaggggacaaagtggtcgggcagggaactctgggatctgaggcccctggctaggtgggccccgtcggttgccattgactcacccacccctcctctccctctaggtgccatggccggccaggtgggctgcagagtgggctccctgcccctctctgcctgttctggactgtgttctgggcctgctgaggatggcagagctggtgtccatccagcactgaccagccctgattccccgaccaccgcccagggtggagaaggaggcccttgcttggcgtgggggatggcttaactgtacctgtttggatgcttctgaatagaaataaagtgggttttccctggaggtacccagcagcctgttccagaccacgagctgcctccccacccacccaacccgacacaggtcaccacctctccaggctggcagggcagcacctgcccaggtccagctggctccaggctgctccccaaacttcccccactcccgcagacaccccccttccaggcccctcacctccttcccctcgcgcttatcctccagtattttaaggactgttggaacgggcaggccgcaggccccacctgagattgtacccctgactgtcccccaagctcggcatcttccacagagtgggtgagggccatgttcctgtttatttaccaacttgatgatacctgggggagcctttgggactgtttgcccaagagccccctttacaagagtactgcctgctcgtcaccaccatgtgccctgccctatgccttggggcctggctctgctgttcctggtcaagcccagcccccaccctagggctccatcagcctcagctcctgggtggggtgggggttcttctggcacgagtttggggttaggaaccctccatgttcaacaggggccctcaccgcttgaggggtctcgggcctcacattgacttcctggggaggctgcatcccagcagcagtgcttgcagcccgagggtccagcagccccaggtgggcacctgagggaggggctcctcgacgagacgacagcctgggggcagagctgtgacccccatgttgccagaggaggtgggcatgtggggttttgccttttcttttgtatgttttcttttcttttttttttttaagagaaaggaaattacaaactctcttgacgctgcagccagccgtggcactgccctgccgccctggctggtgtccagtacttagaacccagggcaggtgctgccggccgcctggggggtgctgggtgggggcgcgtcccaaggcctgggagctcctgtcattgtcactggtcggtcgctgaggctggaggccacaggagcaggatcagctgtttcctcacttacgcaggcctgtggggacaaggtcagagagcacctgggggaacagggctggggcagccactgggggctgccaccccctccccttggagaacctgaaatggaacaaagtccaagcagtggacggcttcaggcctttggcagaaaggagatgggtgggactgaggctctggaaagcccccactgcctctctctgtgccggcaggtcagcgtcttgtgcctgtttgctgacatctcagtggggtctggcctgtggggctgggagtggagagggggctcacccaggggtgtgcctgggtccctggctcagggtctgcgtgtgaccccaccccttcccaggtctttattcccctgttctctgacatgggagctgggctcctgctaccttgaacggcccctgccgggacagccctcatttttaggagagaagagccaggggctacccaggggcgtgccatcaggtgtgtctgggggcctgggcagcccaggggcggtgcagccacctattctgagccccaaactaggattgtgtacggggcgggctgtgtggcaaaagctgtttcagaggaggccaggtgggagccctggcaccccatgccaaagtctggggtttgcagagctgtggacactgcctttcaagaaacaagtctggttctgccagataggaagccagggccccagctcctgccacagagagacccctacagcacccccatgccgcctgctgggaagtggctcttcaggacacccttgcggcccccgactcagagccgactcctggacccaaccccctcccacagtctccatctctgctgggctctgagcttctgggctgggactgggtcctaggtctctgcagccccagtaccaccccagagcctggcatgaagcagatgttagaaaagtgagagtggatggatggacggatggatggcagaacggacaggcaggtgcctggtgaggcccccaaggaaggcagcctctcgctgtgagggccagattggccaggctggccgcagagcaggttctgccagccatacttacaagtacacctgcttggacaagagactggatggcttttcattgacatggtagagaggaaatggatcaaatccaccaatgaaatcaactgaaagaaatcaagacccaaataaaacaaaacctacacaatggaaaagatgtcagagtggaaaacaagcccaaccagacaaagaagcccaaggggtccctgggggcacagacagtgcccaaagccctgacatgacagcagagggaacatggcctggggggacggggggggtgggacacccgggtcctcggcctgtgcggggacggcatcgggggacagtgggggtgggacagcccggatcttcagcctgtgcggggacatggcctggggggacggcaggggtaggacagcccgggtcctcggcctatgtggggatggcctcgggggacagtggggtcaggacagcccgggtcctccagcctgtgcaggggctgcaccgtgttccgcccactctcccgccgccctccgtcatgttcagaccgatggcttccttgacactgtgtctgcacagccagcaggcagcaggggcttgcggggcaaagtcgaggcattttgaaccccaggttcaaatggggttcccatcttaaaatgtttgaatggaaccagtcgtttgcctcctcccaggaagctggctgagctctgagtgatggtttaggatcagcagcagagtggctgagggatgctgggcgctggggaccgaggctctgagggcattcctcgcctctggaatcaggcctggtctgagggtagggtgccctttgacacgtggactgctgaccccatggcccctggagtcctggggacagatggttctgaactggattctgaccccagggagagttctgtccataggaaccaggacccctgggcacacccagaccctgcttggcgtctgcccttccccacccggctctatccttctccacagggtcttcctgtgagaccacaccaggacgaggggacccagcgagggcgcctgagtgtggaccactcgtgttgcaaatcacaggaaagctgacgggctggcgagcaaagggaagatgaaaccctgcccagatgggtccaggctgccaccgagggcctgatgtgagcgtcctggccatgggcccggttccgatctgcctggaggctgcagcggcctggacctgggcagtctgagctcagaccttcctcccgtggccactgcggggatcatgagggcaggcccagcccaaagcacaggagtccttggaccggggggcagctgacccctggagcccccaggctaggacctctgctaatctcttccctggtgtgtggcgagtcctcgctcaggcctacggccgtgagcaaggccctgctgggcgtgaggtcccttccaagtggggaggtctctcgccttgccccagacgggacagactcagagctgccacctctgtagccgtctcccgccccactgcctgcagaggccccatactcacagctgtcctcttcctccgtaaacacgctgaccacctggcagccacagacaaagcccagaagctgaaagacaccacaggcaggggcgtgagtgcggccaggcgagcctgtggggtgtcattgaggcgatgtgggccgaagcactggagcgcccctgaccaccaaggccctgcctctcctggacctcaggttcctcctctgtgacttggagtgggagagctgacccgtgggtatcctcagctctcaagctccggacgcacccctgccttccaccccaccccactcaactgggtagggggcaggtgggtgaggataatggatattgggtggggaagatgagcaggtcagcctgagtggctgcagggagcggggtgaggacacagaagcccaggctggatgaaccccaggccagcacagtcccagccctgcgtcccctcgggcctcttgcctttggccccagcccactccagccagcagccaccaggggttcctcctcctctgtggagcaagccatctgggattctggttttgagcccggcaaagtgcaggagagacaggctgaggactcggggtccagcgggcaactccgggcagagttgggggctggctgctgcctttggggcaggggtcaggcagggagaggggagggactgggagtccagggcagagggcaggccgctgcaaagccccacacacctcgcagacacctgcatccagggccactgagggaaaaagggctctggcaaagggggggcagtgctgccgcagccagaaacaccaacagcatgagcgagagggcctggccaggggcactccaggccacagacaccgagggaggcggcagtgggtctgtgactggagggaccccggaacgaggcaggaaaccttcctggttgcacctcaggccaaccactcagcagccgggtgaccccaaaaattcacttcatcttctggtcttggtttcttcctccatagacttggcccaacagccccccgtgaaggccaccgtgcccaggagaggagacaggacacgcaggccaggccccagggctggacatgcttgggctccgtccccccgacccccgaccccatctggtacaggcaagttggtggttgctttcctggaaatccagctcctttctaggggtcagtcaggggccaggagacctctcttaccaccaagcaggcagacctatctccttgatattgagacaagctcaagaagctgtcccaaatggccatttctggttccatgccacggccagggtgggagcagcggtgagggtgggcaacctccacggctcgtccccctcctcaccccaaaggagcccaagacgcccccatcccggagctggccgtggcgccgaacaggcagccgagcttggggagccattggaagatgccccttccagccggtgccctcctgcctggggacctgcaggccacctctgtcccacacccccatgctccccgccctgcacaccaccgcctcctgcccatcctcctggctccagccccaggtccaccccaaagctctcccctctccctgctgcatggaggcctgggatctgcaggccccgcaccccaacccccagagcctggccttgtcagacgactctcttgccaccaccatttccatccccagcacagctgggcagaggccaaccaagccgccagcctctcccagaccctccaaagcaaacagcaggggcgagatcctagcgaggactagctggctggaatttagaaactacatcctatcaaagaaattcccatccctgggagtcaggataaaagccaacaggaggccccatctccccaaccatgcagagtgcccactcctccagcctcggctcccatagcacgccagccccctccgagagactcttcattcattcccctcaagcttcctttttttttttttgagacagagtctcgctctgtcacccaggctggagtgcagtggcgtgatctctgctcactgcaagctctgcctcccgggttcatgccattctcctgcttcagcctcccgaggagctgggactacaggcgcccgccaccacgcccggctaattgttttgtatttttagtagagacagggtttcaccgtgttagccaggatggtctcagtctcctgacctcgtgatccgcctgcctcggcctcccaaagtgctgggattacaggtgtgagccaccgcacccagcctagcttcttttctgttgcctcctcacaaagcctaatctcaggagctttgatgtgcacacttgggaaattggctctttctcctccagtggcaggcacctgggttccacacattttgggggcaattggggccccctctgtgccttgctgactggctttggtgggagaaacaggccccgactggagctggcagggtgcgtctgtggccccttgctatggggcagcaccttcctggcctgatttcctgcaggaccagagcagagcccaggaaggagccccgggagctcacgaggccacccgcaccgtcacgtgtgctcaggccacgggctccttagatttggaattcagctcccaccgccagccgccggccatggagcctcgctcctggaagccccaggtccacctggtgtgttgcgtcgacaccaccgtgcgcaccaggaaaagccagggagcctcgagatcggtcagaagttcctccagcgacggcaccagccgtgctgcagtcacattggccctgcccccggagctcttgaggtgaaacgctgaccgagcaccctccacacacccgcctcagcttttgcctctttctgagcacttcgaggaaggcactgacaccatctgcattttacagaggcgggagctgaggcacacggaggttgttaggctcacagaggcggcacagcggggaagtggccgtgtggccataccaggagcagcatcgtagcccctgttctctaccaacccgtgcagggccggagaggacggcagagtcccgttcccgcacaagcaacagctgctcctcagcgccacccggggccacagaatccctgtccggtcagacctgggtcacgtggcgccagccttgccagatgcatacgccagggttcccgacaaggctgaggggcttcttgccagcccagcctcaggctctgtccacttcctgtgaccggcatgggctcggggcagccgagggaacaggcgggacacgcatggatgggtttgtcaggaagatgcatgcccctcctccttggggccgtcaaagccagaggcggggtgtctcggcctgatccgattccttcccactccccacagcaaacaccacgctcaacttgagaaagcgcctgggttggccccgcctgggggaggtggtttgcagaggaggcactgaggtgccagccacatgggacccacccgtgataccttaacctctccagcaagggtgggggatgaggaaggcagagacacgcctgaggccaggtcagctggccccgcctcagggagatgagcccccagctccatgtcccctcccccatcaacccatccccacccgggggcccccttccccacgctcaccgcgatcaggatctgcaggcaactgtgtagggcctccacatagctgggctccagggcacagccagcacctgacaccagggcctggccatggggggccccgaggcccactgctggcacctcctcatgcagacagcctggccagcgctcacgccaccaggagcgatgccgggagaggctgaaggtcagtagctcgctgtcctaggggagaggtgcaggagcagggccggttagcaccaggaggtgggcggcctcacccactgcagcctgcggggacgccaccacaccgaggcaaggggaggtcctgtcctctcacctcccctgtcctcccactgcaccccgcccccagggctccagccatggtggggaaaggaataccaaggccctcccagccgctcctgcgcctgccctcgacccacacacctcctcctccaggaaggcctccctgcccagaccccagaactcgctctcaggggcaccgggccccttcctcgtgtcgctggccaaagctgccatgtgacgtgtgtctgcctcgggacagtcttcccggctgcagccccaggtgtggttccaggaagcgggggcccgtctgcctggctgggcacctgccccagtgcccacctgtgctacactggccagagcagagagcccctgggggagaccaaaatccatccaccctggctttaggaccaccctctgagctgtaagcaaagtgcctgaaacagcctcggtcagggtgggctcagcaatggcccccaccctgtttcccctgaacagcctcggtcagggtcggctcagcgatggccttttcccaccccctccccccacgtttcccctggttccctgcattgcaggaggcacgaggctttaccagcctggagggttggtcgggctgggacaaaggaccccacgtggccccaggagggtggtgtccattcacctgcagatctctgccagggtttgcccctgctctgaggcccctcttccccagctggagccccctcgcctgccaatacccacagacgcctttctttcaccaatcaaatcactggtctttccccaaacctttactgagttaccaactacagaccagggctgttctgggtgctggggacagagccatgcacagactgagcccctgcctcagacgacagatgaaaagcaaacacagggggtgttaccaggggcccggcccagaccccagggaaggacctcgcgctgcctcccagtctgcactcacctttaagaggccaccgacttccaggtagaagcagatgatgaagacgttccaggtgacccagacggctgcccacagcgtgtactagggagaggagaggatggggcggcagctgaacacagctcccgggcacacctgcttgcatccagcccccgggggaaggggtcccatgatcgcataggaggggcggcctctgctcctgagtctggcggcccccagatgcacagcatggagaaaggggtcccccaagcccaccctgggacacgtctcagagctttcccacgtgggtgccccgggaatgaggcggtgggacagccagctcaagggagccccagcgcaggtcggcgtacggacacagcatccctggctgagctgccgtgacctgtcctcgcctcaccgggctgacattacacgtggacagcacaggcctccactgcagagcaccccagaagccacccccaagagagcaccccaaagagctgccagctgcttttgtaaataaagttttgcggacacagccacacccatttgtgcacacacagcccagctgcttttgcgttgggactgcacgggccacagcacctaaggtatttaccatctgccctttacaggaaaagtcagctgcaaactactggtctggaccgatgatttggttctgcactgaatgaaaatgctgactgagcagagagacatttttctgaacattttttcagcttctccagaggatgcagcaaggacagtatggccaggggtctgctggggtccaggtcccaccctgggcttccgacagtgattctgtgcctgatttcccatctgtaaagcagggatcgtggcagcacccagatccctggctactgaggggatgaattcgtgaaggcgttcagtgcctggggccccccaatatatgcagctgctccttcaagcagcctcggaaaagcccctccgtccgaaccagaattctagatgtccaggcagcaaagaggtctgaacccaggggtctgggttggcatttgtggggtgttcagtggtgtccaggaaaatatgccaggatggtgccatgggagccgccatcctggtcacctcaacccacctgcccataaagagggccgggcccaggactcaccaccatgacatagcgcagccggtactggatggtgccgaagagtcccaggatgacgatgatgatgtggacaaagttggccaggatgggcgcccactggtagcccaggaagtcaaacacctgcctctccagggcggcgacctaggagcagggcgggcgccatgaagggtggacccgagggaggccccaggcccgccagccaggtactgggccaaggtgacaggatctcagcagggacttcctccccacacccgcccaccacacctttgtttgacgaaggacaccagggctgtaactcctgctctgtgaccaccaccgagcaggcactgagcatctactgtgtgcttggctcttccaagaagaatccccaaatgagcctgacaggcccccttgtgtccccgtgtgtcaccgtctgtccccggtgagcgttcctcccttgagtaggccccatcccctctgtccccagtttcctcatctggagaatgggaacaccaggggctgctctaaatcacgaactgtggggccaggtgacagacacacagcccagaaaacgccactcgggggggtcggatggccgggagggacggacgcgggttcacaagagtactggacgccgaggccccagcctgctgcctgcatctcggccttggggacagggctggtgaggctgctctctggcaggcaggcagcctcccctccacttcaggatattacaggactctgttgaactgccctctacacagggccgagagagaaccaatgagggggggagggaaaggtgcctgaggaatataaagttggtattttatatttaggagaccaagaaaacctgagcaaagccatgaccaggacgctaactgcagggactggcgcactcggcaccacccgtcaccagctccttcccacgtgctggtgaagcacaacccagagaagagaagatgctgtggaacccaccccatcccccaccccagccgccctatcccccaccccagccactccatcccccatcccccatcccagccaaaagacacctgggcccgggggaccactaccaccaagacgcagagaccagtagtggccctgaatgccaggctgtgctgatatttattggatacaagacaaaagggcagggtaaggagtgtgagtcatctccaatgacaggtaaggtcacgtgggtcacatgtccactggccagggggcccttgcctgcctggcagccgaggcagagagagaggagagagagagagagagacagcttacgccattatttctgcttatcagagactttcagtactttcactaatttgctgctgttatctagaaggcagagccaggtgcacaggatggaacatgaaggcggactaggagcgtgaccactgaagcacagcatcacagggagacggttaggcctccggataactgcgggcgggcctgactgatgtcaggtcctccacaagaggtggaggagtagagtcttctctaaactcccccggggaaagggagactccctttcccagtccgctaagtagcaggtgtttttccgtgacactgaggctaccgctagaccacggtccgcttggcaacgggcgtcttcccagacgctggtgtcaccgctagaccaaggagccctctggtggccctgtctgggcgtgacagaaggctcacacttgtcttctggtcacttctcactatgtcccctcagctcctatctctgtatggcctggtttttcctagattatgattgtagagcaaggattattataatacgggaacaaagagtaattgctacaaactaatgatgaatgatattcatatataatcatgtctatgacctatatctagtataactattgttgtattatatattttattatactggaacatctcgtgcccttggtctcttgcctgggcacctgggtggctagccgcccacgaaactcttagtctcaggcctccccatcgtgcccggaggacactaacctacgaggagggatgtctgccctgccggagccccggggggaaggtaagcgagccccccaaggggagcagttcttgccctggcccactttgcctacgccgggcacagttctgtgaggtctgggctggcggctgggacaagctgcacatctcggctaaggggtctcggcctgaggagcagcctcaggtctggctccagaatggagaccctgcagcacagaggggctgggggcgtctttttcatctcgaagccaaggctcccagaggctcagggctccatgacatgtggcgacatgcatgagcagggaggctcatgccaccatggaagcaggtgaccctggtggccctgccaggacccagccccaaaccccttcctgggcctttggctcccagggtctcctcaatgcagcagggcagagcctgggaattggacgcagcacagcccggctcagagccagcaaagttcacactgttctttggggagaaaggcgctcagaagagatgcctgggccctttgtcctgtagcttggtaacacaaaattctcacacttgtcaaaaaaaaaaaggggctatccaacaaccccgcccttcctcccgggccccctacccccatgcagtgactagagctgtggtcaaggactcttcttccccaaggcagaggaggcacagtgggctgccagattgccaacccggccaggacaaaaggcctttgacagctccctgctgcggttcagcagtgacccagaggctggccctgagaggacacggctctgcccagtccctggagagtccccaggtctgctagtgaagccctgcggccctcaagccaggatgactctttccctcttggctgcaaccaaatttccaagggcctgcatgtgcgcccatctgtctactgtccaccgcagaggtgaaacgggaacatgaccccacccgcccctctgcaccctgaggtcacatccgaccagcacagtcgtgcctcaccctgcacctgagactgaagcacccatttctcctgcccaaaccccagcaccatcaaccccagcacatcctcacaccaccttcaacagatggaaaccaatgtcactagtgtcccccaaagcagcctcacttcctgacgctcatgcatcaccagctgccactggccatgctccaaactggggtaccgtccaggctggtgcctgtccttcatgaggtcatccgacgggcactggagtcttcgagtgcccacccttgctctccccattcctgcttccagcccctccccaccagtctcctaagggactcctgccattgaggagccactcactgaaagataccaactgttccaaggcctgggatggtccttgggcccccagcctgttgcaggacctcaggttatctccgcggccccagcgagcctcccaggaaagcgccggaagctccttccttcctgcaggaaggacacgatgcctccgccgtccctaggtccgcccgcaagcctgtgcccctaagccgagcacaggacacccaagctgcacagccacggactccgagggtttcgctgctcaaaactctgaaacagccccttctggcccttctagcttcaagaggaggaggggggcgcgcggtccagctgcgctccgcagcccacaaagcatcgtttcctttttaagacgggagacccagggccaattagcatcgaagcaaagcagcttccccagcctggacaggcgaggcctttgtttagccccctcccccgagggcaccgggctccgggaaagaatccgccccccaggcgtcccagggagcttcggactccggggcagaatggaaacttggccgagggagccccgaccaatcccgacaccgaagacgcccgcgctgcgccccgggcatcggctccagccccttctcgcctccgcgtagctccacgccgggcggaatggggggcggcgggggcgggcggggccggtttgctcgcgggtgggcaggacgttctcaccccccgccccctacactcgcaaactcgcaggcacagcctccgtcatcgccccacccgaatctcagaatcggaacttggccgctcactcggcgcccggggccggctgcgggaaacgctcgcacagacagagacaggcgcgcacccgggggcgcacccggggccacacacgcctccccaggcgatggggtccaggcggccccgcccgaaggcttccgtccggccagcccatccagccgctgccccgcacctgtccccgccgctccggacccgcggccgccccccgcgcacgcacaccggggacgggacccggcgccgcgactccccacgccccgcaggcgacgccaccttcggccgtagcagcccggggtccgaggcatcccccctcggagctggcgcgggacccagcgaacgggccccggggcggagggacgcttcgggaccccacagccgccgtgggtcgggcaccgggggctccaggaggctcgcggaggggtcgccactcaccagctgaaaagcgcagaggacgacgagcgcgcagcggccggagcaggagcccatggtgcccgcctatacaggaggcccccgggtgccccgcgctcggcccccgcccccgctccgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtagcgaggggcggcgccgcggccccaggacagacctgcagctgaggggagcccgccctggacgcggcagggatgaccggcgtccgccccctcctgcaggatgacctgcccagcacctgctcccgccgtgcgccctccggcgtgagatccccatcaaccttccccgtgtggggtctgagcgacccgcatccgcgaggcgttttctctgagagtctcagagattccttggcttggagaagtcctggacccgggtccagagctcagaggtcccctccacgggcgggcgggccgaggactcaggaggagggagtgagccgggctcgcccacctcccacagggagctcctctgctggaaggctgagacctgaaggccaggtctgctccaactgcctggaccggcctcctgcctgcgcgggaggggcctagggagcctcgggttgggacagcctgaggccttgtgcacggtggaggcaggacccagctgcccagggcaggtcctggggtctggatggggctgaaccccgtaaagcctgcgcttccggaagaagcttgcgctggaggcagggaagggtcccagccaggcccgagaggagcaggacgtggatacagtgagccagagtgtcagccggtcggaaagcccatgggggcagaacagcgggagatcagggcaggtggccgggccagggctgccacttggtctttactcagtggcagggcaggctccctgactgccacccaccgcctgaggagcctgagatgggtttcccatggcaacctgaattcctgccccactcgagattttatgaattactgaggattcttgccttcctaattttggttgtgtgtcccacagtcccggggatcaggaggggttaacagaagaccaagggtcaggttttctgcactgcggggagccaccccagatctgtagtccaggctcatgggcgggtgagggggtagcttccaagccccaaaggttagagagcaaaggtgtggccagttgtggagggagggggagcgtcaggttgtttgcagtgctggggagataagaatattcaggaatcagatggtggtgatggttgcacagctctgtgaatatactgcagcccactgagcactacactgtaaaggggtgactattatggtgtgaggattatatcccgatttttaaaagatgtgaaaaaattaatgtttatttatacgatatataagacattgatttttaaatacagcggtaccatccccgtcccccataaccctggttcctccaggcacttggagccattggtggaaggacgtggactcctagaaggtgattcgcaaaggtgccacgtaagcagaggagccgggtaagcagaggcccagtgccacgtaagcagaggaaggcccggagccggctgctgaggtcctgagggagagggaggggcacctgctcagccttgcctgtgtgtgtggatccttctctctcaggggaagctgcctggacatgcgtgcgccttgcagttctgtcctgccaggctgcctgctcttcctcttgaaagcaaaagacttcacttgctgaggatgcaacgatgctctagtgtcccttgcaggagccagtgtcagagccaggagccgtcgtgggcatcccctgctccaaagttacgagttctggtgaaggggtcaggacagcccctttgagagttcagcagagcaggtctgcacaggtcccacgccgtgcacagcccacactccacctgccctggtgcacactgacggcagcagccagccgcggggaccccaggcgcagtgttgcctcgtgaacgttagagcagcctccagaggcgggttcggtctgcacacctggttcgcgggtgacacagttgtgacttggcccaggtcagttgttggggcctggccagctgtgggtggtgaggttttctcggacgcttcatctgctctcgttcttgttcgaattccttctgcctaagaatgacagctttaaaagtgaaatggcagcacgtctccatcattacacagaatcccatgtgggaagaccctagtcggaggcccccacccttgcccggaactggactttggggcagcagcaaactgcagtgagtgtgagtcacacctgaggacaggtgggctgtcttcaggctcccaacaggtctgtcgcttaaggggctggggaatgggggctggaatgccacggcctgcccacctgggggactctgggcagagctggagcagccaggcaggaaaatatcccccagtttccagagagtaaaagctgatggtcctgctgaggtgtgaaggacagtgacggacagtgatggaaggtgatggacagaggaggacagtgatggacagaggagggcagtgatggacagtgacgggcagtgatagacagcaacagagagtggaggacagtgatgaacagcaacagacagtggagggcagtgatggacagtggaggacagtggaggatagcagagggcagtgatggacagtaatggacagcaaaggacagtgagggacagcagaggacagtgatggacagcggaggacagtgatgggcagcggaggacagtgatggacagtggaggacagtgatggagagcagaggacagtgatggacaatggaggacagtggaggacagtgatggacagtggaggacagtgatggacagcggaggacagtgatggcgagcggaggacagtgatggagagcggaggacagtgatggacagcggaggacagtgatggcgagcggaggacagtgatggacagcggaggacagtgatggacagcggaggacagtgatggacagcggaggacagtgatggagaacggaggacagtgatggacagcggaggacagtgatggacagaggaggacagtgatggagagtggaggacagtgatggacagcggaggacagtgatggacagtggaggacagtgatggagaacggaggacagcgatggacagcggaggacagcgatggacagcggatgacagtggaggacagcggatgacagtggaggacagtggaggacagcgatggacagtggaggacagtgatggacagcggaggacagtgatggacagtaatggacagtgatggacagcggaggacagtgatggacagcggaggacagcgatggacagtggaggacagtgatggacagtggaggacagtgatggacagaggaggacagtgaaagacagagaaggacagcaatggaaggacagccaccccagtcagcacaaacgcaggccgagtggggcccatgcattcctgggaggactggcaagctgggaaaggcctccagggcagggaaactcaggagagtgacagcttgttcaggccaggaccttgtgcatcttctccttttttctttcttagtaaacccagtgtattcatttttagcggctgccataacaaattcccataaactagcggcttgaagccacggaagtttattacgtcacagttgtggaggctagacatctaacatccaggtatgggcagggttgcactgccttcgaagctctggggagggtccttcctgcccctcccagctcctgtggctcccagcgtccttagcctgtgggcgttatcgctctggtctttgcctccacctttgcgtgacctcctcctctcctgtgtgtcacttgctatgatgcttgtgatgccatttagggcccacctatgtaatccagcatgctctcatgtcaagatccctaatcacatctgcaaagaaccttgccccaaactcctggcttcaagcaattctcctgccttggcctcccaacatgctgggtttgcaggtgtgagccactgtgccaggcctagatttgggggccaccattcagtcgctgctctcccacacctgcagcagccccagcccgcccgcagggcagaccttccttgtggcagagacaacaggaaaaggaaaggaagaggaacccaggcctgggttcccggcagagctgtccgcagagcctgtgcggggctgcaaaggcccctctgttgtcacaacacccctgtccccgtttcagatgaaaccgggagaactttcaactgcaacaaacactcctggaaaaggagaggccaatccccatggctccacagagagcacagccagaccccttcatccaggcccacaggcaatgttgtcgactctgttcttcctttgaaaaaaaagggtgctggttggtttccagtttactgcagacacacagagaggcccctctctggctcagagcctggcccgggtctctccagtcccagcttctccctcccgaaaggaacgtcctgcccaacaatgcaacacgtgtgtgcactcccagtgtgggaatcaggctgagctggacttcaggggcagcccaggatgcttgcctcgggtggggcgttttcccagaggtttcttgggagctgcctgggagttgccgcagcttcttcccagctggcttcagcccaggcttcctgggtgagattcttgttccctggcccctcacggtacgcgtggtcctgttccccgcaatcccccacccccttgaactccgttcccacactcaggacccacccagatgccagctccccgcagagcagtgcagccccccacttccagccctgacggcacacaccctgccccccaccaccattttggaattgttcttcgccagaaataccgtttcccaccctgtcttcttattctcggaggcagaggcacttcagcttcctgggccgtctgtcactgagtcaccctggtttccattggcagtgccgcctctccctcactcggatgcttctgtgcagccacacgggctgtgtgtgcaacctcaggggacgcatcaaccacgtcctcgggctggccgtagagacatggcctccgcctgagtgtggccgtcagactctccctggtactataagccctcggctgagggggcagaggggcagctaggatcatggccgcagctcccagaggggagcccccatcctccaggccgtcttaccgagcctgctccccagcctgcgcctttcctgacttccctccaggctcctgttgctggcgaccacagaaccagcctcagggctttcctgtccttcctgtcaggggtcctttcccagtgggagctctgggcgggtgggcctgtcccaggagagtcacgtagcttgtttaaggagaagatccccatggctcttgtgtgcacatgtggggcctctctccccaggggctgctgtgagcctgggaagtcccaggtggtgtctcatgccccagagagtagccccctgtgcacctcgcacacgccctcctgcgggtctgctgactttctcctctgcctcagccaagtctcccacgcggagcaggtgggaactgaatgaaggcctcacaggattctgagtccccggtctgacacccacctggctcagcacctgcctcctcagcttccagttgcacgggtggccgcaggcgtcagggtgtgacggcgagcgtggccagtccggtcagaggtctctgcatcctccacacctctggccaggtgagacccagcctgtgtctctcccagctctactgacggacggcaggaagctgagaccccgagcccgtgtgtcctcggttcttggtgctttgcaatgcccctggccctggctgcagccgccccctggctgggccccgagcctgtctgccctgcaacactcacccttcatgaagagggagcctcagccgagaggagagcaaataagtgtaaggggagagggtgcttcctgagacacgcggtgggcccagggctcctgccttggccattccgtccatctgtgggagggccttggcctctctgcttttggagcagggcgctggggctaggggattgcagccacagccactctactgcactggttgggagctcggatcacctgggtgcagaggaagctttgacggcaagggttggtgtggctcatctcgcccaccccacagccatcgccgccccgcagacacctctggatcccggcctgccgtccctcctcccgagcctacattaggctccatccttccccaggccccatgccaccagcaagaacagcccagccaatgcagactgcacccctcggcctcggccgggaccgagcacactgccctgtgtgctctccctggcccctgaggcaggtggcctgacccctgtcttcagaggggaaagctgagtctcgggaaggccacacagccgaggagtgggggcagaaagaacccagctctgcgtcaggctgtgtcaagccgacatttagtgcctagcagcagccacggcctctgcagggcttcctggagcaggtgtgggctcttccagcacagagcatgggctgcaccagcttcggggtgcaccgcgtacaggttagggctgtggctgtggctgctggctgacaccaggagtaaacgtggacaccagaccagcgcagcctagacccagctgggtggcaggtgctgccagtgcgtctcgagggggcagcagggtcagctgcagatgaggctgccccaggactggctgccagccctcaaagagccccctgggtccccccggcacaactctctgcatgaagcccccagcaggagaagggctcactgccctgagcccgacacagtacgagacggaggcctcactgagtccaggccccgcactggccctcccctggatcctgagtccaggccccaagccagcccctcccctggatctccccagaccctctctgtgggaacccaggggctggagccgctcgactacatcttggtagctctcatttgggacctcatctttaatctcagcaactcagggatcaaagagaaaaggccgaggcaggcgaggccagggtttcttgctcaagcattcggatcattaaacaaacgaaaaaaatcaaagagaaggaaagccaggctgctgcctgtggatctgtctgccctccccggaggccagcgccgcacgcccctccctccctctctctccctctcctctctctggctctcctgatggaggccccacatggggttaggattcccaaatgtcacatgaatccagtgtttggggagcgtctcgctccgtttgtgttgctgtaacaaatgccttggactgggttgtgtttaagaactgggtttttctggaggctggaagtccagcactgaggcaggagcagggtcgctgcttggtgagggctgctctctgcttccagaaagcgcctgattgctgcttcctccagagaggacgaaggccgtggcctcacatggtgcaaggtgggagggtgagagggtgctcccttcccctggatcccattcacaaggtgctcgtcccgttctcccagaggccacaggtctaaatgctgttgcgggggggactcgctttcaacacaaattttggaggagatgtcactcaaaccagagcaggaagtgtgaggaaggactcaggagtgccccccggccgcgtcctggctttggaagcacaggaagcgcctggcagcctcgcgttctccttgccctcattagtttgattttgcttgaggaggacacaccagtgccccctccccagtctctgcccctccctcttcctgccagagcccaggaggccccatcctgcactaagaagcccccacagcagccgtagcagggacgtccttccccaccgtcctcccgtcacctcgagggacttccttccgtccccaccgtcctcccgtcacctcgagggacttccttccgtccccaccgtcctcccttcacctcgagggacttccttccgtccccaccgtcctcccatcacctcgagggacttccttccatccccaccgtcctcccttcacctcaagggacttcctttcgtccccaccgtcctcccatcacctcgtttacttttcaagaacccttggaggaagcgaccatccattctcctattctgcagatgaggagacaggggtggtgacgcgctgagtgacttacaggagacgggggtggggacgcgctgagtgacttacaggagacgggggtggggacgcgctgagtgaccctcaggagacgggggtggtgatgcgctgagtgaccctcaggagacgggggtggggacgcgctgagtgaccctcaggagacgggggtggggacgtgctgagtgaccccacagctcagaagtcgaagggctgagtttcattccaggtcctgggacccccagtccccagggttggggctctggcagcgcctcctcaccccggcgtgggagcgaacagcataggacgcctgaactgcaggtgcagagaggacacctggactgcagtacagagagggcgcacctgcagacaggtgggggccctcagtaggagacacctgtgtgcaggcagtaagctgcacctcgtcactagtcacccacggggccacacacagaccctcctgctcccctgaaaccccctcctgctggcccccagtcagtgcttctcccccagaaggagtgtcagagacaaaacaacacatttagtttcaagatcttagttgtgttttatttgctactctagaatcgggcaacacctctttccataaaacagaacgaacgctctcatgagccgaggggaggtcagaggtcggtttcacagacagaagaggcccgaggaaagtagacagaaaccaaaggcgcgctggtcacttcagagttacttttcctgtaaaggttaaagcagaggattaaagcccactcctgtaatcccagcactttgggacgccaaggcgggcagatcacctgaggtcagtggttcaagaccagcctggccaacatggtgaaacccagtttctaccaaaaatacaaaaattagccgggtgtggtggtgggcacctgtaatcccagctactcgggagacaggcaggagaattgcctgaacccgggcggcggcggttgtagtgagctgagattgaaccactgtgctctagcctgggtgacagagtgagactctatctcaaaagaaaaaaaataaaaaaggtgggcgcggtggctcacacctgtaatgccagcactttgggaggccgagatgggcggatcatgaggtcaggagattgagaccatcctggccaacgtggtgaaaccctgtctctactaaaaatacaaaaattagcgggcgtggtggtgcacacttgtagtcccagttactcaggaggctgaggcaggagaatcgcttgaatccaggaggtggaggttgcagtgagccaagatcacgccactgcactccagcctggggacagaatgagactgtctcaaaaaaaacaaaggttaaagcagaggggacttccttatcatgttggcttcttgctggcttctggtggcctgtttggggattcggctgctatctctccctgatttctgggaagggtgggggcggtcagatacagatcttaggaaccacagcatgggtgactccattttggttttgtctgttgggcctcctgcaggagctccgtccaaaccaatgacctctgcattcagttttctttgacaagagcaggcatcggcccctgcccagcactggtgggtctcgcctgttctgggggatccatgtaagtggatggcgcagcccagaccatgtccagtgtggcgtgagactcatctgtgtcctggtggcagtggtctgcttgtttgtgtggctgcgcagtccttaaagacgtggacacctggccgtccacttgccatgcccctgtgcattttctggttgcttcggctgctggctgtagtggggacggcggctgtgagccttctagactgtgctgctcgggaactccagggccaggcacatgcctagctgtccctgtgtctccagcacacgagaggaggcatgtggcttctccaggctcaaaaaaacaccgagtcttcctgctgccgggtctttgcttcccttgcttcctcactaccccgcagcgcccagggcagggccaacgcctgcactggggcccacaagcctgctctttgtggcgctcactgccgtccgtctgatcatcccttgaagggggacactccgagttgtgcctgcccccctacatactcccagcgcagaacctggaaccagcagacgctcaaaaatgtcaatgttgaatgaatcgacactggccgtgttggatgactaattagcaaagtcatctcaaaacagagatgtgagttggggacccagtgagcattcctcaaagtctctaaagaaacagatctcatttctgagacctggcccagctagagctgcctgatatgaacctgggatttcaagagctcctgtttcatccttaaaatgcacttgaatttcactttgtaatgtacttaaggttgttttaatattgaaacaatgttatttttagtttatttttctagatgaagtctcactctgtcgcccaggctggagtacattggtgcgatctcgatcttggctcactgcaacctccacctccccggttcaagcaactctcctgcctcagcctcctgagtacctgggattatgggtacccaccaccatgcctagctaatttttgtttttttggtagagacagtgtcttatcatgttggccaagctggtctcgaactcctgacctcaggtgatctccctgcctcggcctcccaaagtgctgggattgcaggtgtgagccacggcacccagcctgaaacaacattttaaactgctaatcaggcctacagtttatatgcctctgcacaagccctgcccccctttcctgggcaggggtggggtggggagatgtctcagtgcccccatagcccagtcctttctctccccccaccctccctgccccgaccctcacactgccccgtcctgcaggagagaggcatcccagtttgggaagctggtaatgcccaccactcggtcaccagtgttggtaccgctctggctgtcggcaactggctgggcctggggacacatgggaacaactccgatcacacaggaagagtttcccggtccctcgggaccatggaagcccagccacacagcaccggtttgaggcaaggctctcaatacctcgccctccgtgcccaacaccttggtcttctgctaggggtcctcacagtctggggaaactgagtccacatgggcctcagggctggagcttggagcccagggcacccagtcagcacattctatcctcctggccggtgattgtttggaagtggacacatgaccccagctaggcccatcagggtggagcgtgagctttcagctgggatgccggtgcaaggctactttctcttgctggaggcgaatcatgaagcttgcagccttagaagctgccagaagcatcctggggtctcaggatgaagacggaactgcaaacatacacagagaatcctggttctcagcaatagtgctgagctgctggatcaagccacacctgaaattgaactttgttctagaattttcatcacacaaatcaatacattccctttgctaagccatttggggttgagatttttgcctctagcaactagaatctggaaagattcctggctaagatacgcatgggagggtccaaagcaggaggaccctgcgggtccagctgtcacagccccaggatctgagctaccagttctgcaatctgagaagctggcctggtctcagcacattcttagctgtgactccttagccgctgtggccacacgtaattcagcacagctgcaagtttcttggagctcaggacagagcggctcagcattttcgaggaacatttgtacttctgggtgacttacacaccctgacattcttcccatttccttctgtcctgggccccagttcttctggacgccacgcacaggcagcagaagtgggggcagacggggctggaaccagccaggtggagtcccaccatgcagcaggccagaagccaggaccaaggcagcaccgtcgtgggcagccccgggccaaccccacgcgcttctctccaggacccaggcggcaccgtcgtgggcagccccgcactaaccccacgcgcttctctccaggacccaggcggcaccgtcgtgggcagccccgggccaaccccacgcgcttctctccaggacccaggcggcaccgtcgtgggcagccccgggccaaccccacgcgcttctctccaggacccaggcggcaccgtcgtgggcagccccgggccaaccccacgcgcttctctccaggacccaggcggcaccgtcgtgggcagccccgggccaaccccacgcgcttctctccaggacccaggcggcaccgtcgtgggcagccccgggccaacctcacgtgcttctctccagatacaggacaaagctgtttcagaaggacctggtggtggaagatgatcaacaggagacaaaaatgggcagagaaaaacacaggcatccacaggacacaccatggccaggccgtgtttgcttggcctcaccaccattaagatgagaaaattaaacagcgatggcgacgcgtgtgcttagagcccggcggagacagcccccttggtaatggcagccagggaggggacgcaaggaacaggcacactcccatcagcgcatctggcacaggggtttggaggacaatttggtggaatctcccagaacttacctggcacttccacctctagaggtctatgttgtggaaatactcgcacaaacagagagaggtcaccgcacaaagatgtccagtgcaacatcgaaggtaaaacaaagtaatgatgattgtgacaggagagtcctgtcttccaatcagaggccagttagagaacgtaagagacctcagtggttaagatgaacaagcctctgctatagaggggacgcaagaaagccaccaatcaaggtgtgagtagcagggaagcccaggccgtgtgcctgtttatgcagaagacaagatctgggcaggtccaccccaaactgctggccgtgctccctctggaggtcctgcccaggaccaaaggggctttcaagcctccaaggggcacccccatggtgccctggggttgtagaatgcctccttcctgaaagccccacctgcgagtcagctcccctgcctcacttcttccccccgtcaccgctcaagctggctgtgactgtggtggcaatgcaggacccagcagttgagctacaggaatttccctggagctgcctctgtgtgagccctggccggacacaccaagagacagggagagggcgaggggatgagccaaccctccagcaactcccagacaacggggcagggcagggccaggggaatgaccagaattctctcaagtggagggtgcagagggcgtgggtgagtgagcaggggctggaggcccccagcagctgcacgagagggcggggcagagacaagaccagaacccaagttcctaggaggcctggaatgatgagtttattcctgggattttattcctaggatgatggtgctgagcgaggtctgggcagaaagaaggaacttctgggcaggagaacttcaggggactctaccatgaagtgtggagcgctgagcagggaacagcctgagcatggagcagcccagcgagtgtggggctttctggctttggctcaaggtgacctgacttgcaggttgatgctggtgatggagagggttggagagagagaggcgacgatccagaaggatttcccctttgctatgctgctggcctctccccttcacccaaactaagaggtgctggcacccatcacagcacatggcagccggaatgccagctgggagggctgctgtcgtaggtcaggttccctggaggctgaagacagggattgctgtgccagtgattctttgggaggtgcttgtcttaatctgctcaggctgctgtaagaaaatccaccagactgtgtggcttgtgagcaacagaaattcatttctcacagttctggaggccggaagtccaagatcaaggcatggggatattctgggctgggcgagggtctgtgcccaagagccggcacctcctctctgtgtcctcacatgggaaaggcgtcgggtctctctggggccccttttatgagggcactcatcccattcatgagggctctgcctttgacccctcatcacctcccaaaggcctcacctcctgaaaccagcacactggcggttaggatttcaacgtgggaatttacaggaacgccgacattcaggcgtgctccctggagaaaggtgggtggaatgcaggatgggaggagctgagctgggaggggctctcagccacatgcatggccatgtgtgctgggctgagccacaggaatgaacgggctaagcctcagttttcaaggtgagctccgagtccgggggagactaagggctctggtgacgctacggccagatgtgcctctcatgggggcctggagccctggacagttgacgagactaaaagtcatttcaagatgcccattggttctgccatgcaggagggtccaggccactccttagacgagacaacagggcttcccaagagctgcacaaattgctggagtgggagggtgctttgaccgcgcaggggccccgaccctctggctatgctggaggcattccagcaaggctggcccggagcctctggggtgggggtggcctggagccccatctgtgtgctgctgccacccactgtgggactttgggcatgtctctccatagccttagcccctgccctgacagttgtgcaaggtgtggatgcagtgggacctgccttgcaaggaagccctaggagggtggctgcccttggggatgccccataactgacccagtatggtgaccctaagctgatgagcctgaaggcatgtacccatacatgcagtacaaatgtacgcatacacacacatgcacatatacacacattgcacatacatgtgtgtacacaccccagcattgggtagctctagctgttcctcaggctctgccacccctgctgggagctggctggaccctgtagaccaggctgactggctgtgaggcccatacagggtcacagaggacctgtgctcaaggccctgcccactttctctgttccttgtgtttagaatgaaacctctgtggttctcacccctgcaactgacgctgtatctccccatcccagggcccacctggtcctggcccagcggacagctggctccacagaccctccccttctattccgaagactgggtgcaaaccttcacaccaccacttaccatctttttcactttgggcaaattattgaattgtactgtgcctcggtttcctcatctgaacaatgggttcacatcggagtgcacggttgcgcggtttaaatatgctcttcctcatcgagcccagggctgaaattctggcaagtgctcagccagtgtaggcctctggcttgaaagggaaattggagaccttgttccacagatggatgacctgagtctggggaaaggcagtgctttgctgcaggtcccacaacttcacaggtgacctggactcctgcctggctcacagcagcttcgttcctgctcacctgcctgtgccccaggcagctctgcacagccatttactaggaagttctcatttcactgtttttgtattattctgtttgattttattcacatcaagaccttcaagagcctcggggaggaaagcacagagacgatcacattactataactgaaaattaatggactgctggcacttccagaagaaaaacaaattacctaaatattttagatgggaaaatagaacgttttcaattggcagctgcaggttccgccctattccccactccattgccagatcccaccactgtgagcgagctttggcccctctgtgagttggcctctgcaagccttgagattgcagagagaggcgaggctgctgtggatgctgtggggcagcaggctaccctgtctttggaagggccatgcctctaatctgagctttaggaactggggcggccttgctctggggggtggagatagccccagacctcccagagtccgggtgggcctggttgatgagacagcactctgacttacttgctttacaatcagaaaactgcaagttcagcttccactgactgtttggttacccaatgccagatgttggccccaactgtgccccttccaagactgccttcccttttcctctcctccttttcagcttctcaaccttcacagtctgcctcttccaggcagcccactgtgactaatccagcacatggctcccactctctgaactgatggtacccacacagtcctgaccacgagatcggtgctgaaatctacactgttccaactgccacttgtgtagatgctgctggtgcctgtgcacgtcaccttggccctttcctttttgtgcacaccagtggtttcttactgcaagaactggcgactccctcctgagggcaaataaatggcactgagacaccattttgtacccacaaggcctgctgccgtcaaaagactgacaataccaagtgttgacagagatgcagagcagctggacctcacacatcactggcggaagcgtgaaatgcttaccatctttttgttgttgtttagagatgcagtctcactttgtcacccaggctggagtgcagtggagtgatctcagctcactgtaacctttgcctccagggttcaagcaattctcctgcttcagtctcccgagtagctgggattacaggcgtgcacccccaagcccagctaatttttgtatttttagtagagacggggtttcgccatgttggcccggctggtcttgaactcctgacctcgggtgatccacctgcctcagccttcctaagtgttgggattacaggcatgagccactgcgcccgaccacttagcatgttttaataacgttccatacacacttacccaggacccagaaatttcacttctaggtaattacctaagaggaagaaaaaatatgcctacaaaaagacctttcaagacagctttattcatactagccaaaacttagacaccaccccagtgtgcaaagtgtgaataaatgaaggaatgtggcgtgttttccatggcacactactcggcagttacggatacgcacaacgtggctgaatctccgagatatcacgtaaagggaaagaagccatcacgaaagtgtattttgcacgactctatttgtgtgatattccagaacagacaaaactaagatatggggatactggaatcagaagagtggctgcctctgatggaaatgttctataattcactatggtagacgttacctgggggtatgcatttgtcaaaactcattgaactggacgctttgcggtgtgtagcttatatctcaaaaatgtttattctccatcatttcgaaagtcacccagatcaaggaggaatacgtggaatgcacagaaaagtacaaagtaaaaacaaaacaaaaagtgacctgcaattaacctcccacaggtgatcgctttttcagctttgtaccttcctagtgcagactcaggtcccaccagggcgcacctgcgctctggggcgtctgcgtggcaggggtggggacccgcagacgctctcaaccccgccgcctcccaccagggcccaaaggctcgggtggtgggagacagaccccagggcgggagcatgggccccaggacgcaaccctccacccccgcgccggtcccccggtcccctgctgcccactgcctgtgaccctcgcctccctgcctgtcgcccgctgccccagtcctcctacccgagtccccctgccggtccccggctgtcctggcccctctgcccccgccccgtagacctcgctcccctgccggtcctccatggcccccggtcctcctacctgcgtcctcctgcccggctgtcccagccccgcagctcccgccccaggcccccacccgccccgcccccgttgtcggcccccggtgaacgcgccgtcccagaagcacctcagcttggttccgcggatgaacggacgcttctcccgcccggcccccaaaagctgccgtcctccgcggccactacgaccagctgcggtccggggcccggggtgggagttggactgcgtggctgcgcgtccccatggcgaccgggcgggtgcgcgcgtcaggggctggggcctgaggcggaagtcccgcccttgccggctcccgtgagaccttgcaaagcgcaacgtagccggaagctggtggcggctggtgggcgaccgggcgcatcctcattgcagtgcggcggccctacctcggccctggcctgaccccggcggccctgcccgcccctccctccaggtaagcgcgcggctcggcggcgcgggctcggcctgaggccccggctgccgcggcgtcgtccccggccttcgcgggcggacctccctgccgcagcctcctccacccggaccccgctccaccctgaggctgctgccccagagcttgggggcgcccaccctgacctcccccagttccctcggcgctgggcggcggggcccttctcgcgcggacgccccgctgcagccgcccctccgccgtgccgccccccgcccctcgtgcccccttccgtacgaagctgccctccacccgcaccccggatctggaatctcccaccggttacgggagtccagagggtccctgcccacgcacgtcgcctcccggggcgcgagcaggaccctgccccgtccgcttcaacacccttttcccgagctccttcggacccaggactcggcctggacacatcccagtcaggtggcctctgaagcccggtggggcttccaccccctaagaagtgagggtcctaagaaggagatatatttttacatcttggtttcaagcgttcagagtttttgcgttatttttcaagataaactatatttgtacttttgaaggttaggaggtatttgctttcgtgttactaactttaacatttcagggaactagggctcttgaatattcaaaatagtcacgtagaggagttcctcttaaatccaagccaagtcctttcctttttacacactctctccctccggtagttctgtgagtatcctgtatgttttacagttagaaattccagccgtctcctcatggttctgacttttgtttgcctgtgtctgttgaccaatacataagccccgagggcagacgtggtgctatggaaagagtacaggaccgagtatggcgaccaggattggtctcgtcctgctttggcggctcacctcctctccgtgggccgtggcttctgcatgtgccgtggttctgcacagggccctcagtggctgctgtgacaagaatgtgtcccgaggcccttgtaagctcagtcccgctccctgccccgccagggcacctctccccacaggttttccctattccatcctcagtcggctgtataggtggatgctcagtttgatgacggtatccgcctgaatgagtcatgctgggggtccaagtcctgcggtcaggagtgagcattcagatgtctgcctcatgatctgtggttcctggacactcttacagaaggcacagaattatggagcagaagggagcccagggtgaacttttggttttgttttgatgaactgcagaaaacaggtgtttatttcctaactttgaataggtttaaggtgggcactggtcaatactaggagtcatgggcttcagaatttagaaactttggccgtgtggagttgggacccccccccccccccccgcccagtgaatatcttatttctggatacttaagattagaaatgaaatataagacagaggtttttgttttttgttttttaaaagctctgcctacactgtgaataggaaagctggtctacacagtcctcttaaacacagtgaaggagggaagggctggcactgggaaggtcagcagtacacacgtgtgtagcttcccatggcttacagagttcagcgtgttctctgtgtagtgagaggtagagggaacagcacacggctccattcatattgagaggtggatgagcctcagacaacgcactgaggcatgggctggcagggatccaggtctgctgcctccaggctggactatcttctacagtttgctcggtggcgtggtgtgcagggccactgggtcattcccccttgacgctggggttggtaccaccccttcctccggctttgaatcttaactatatcaattttcctggtcctgaattagatgggccaccagttgaagttgtactttgctgaagctaggagagctgcagagacatccataggttttctcttcaccctaaaccttgttgctgctgtcccagtagggtccccgtgagtcactgtggtgggggctgatggtctgaagccactctccttgtcctgcagcagccacactgtcgcccccatgcctcagaatggccccagaaggacctactgcaggtcccccagcaggctggactttccacacactccaggcagcggggcacaggcgggagcctccctgcactgcgttgggaaggtggtggggagggtggagcgcagagtccctgggctccctgtcgttggcagtgatcagcccaagtgtggtgtgtcgccttttaggtggaaaatcgaattttgcagccaatctgtgtgtatttttaaagactaccccttgctgtggatttcaccattagaagacaggactttttataactggtgcagtcttggtgatgaataagcttaagcaaagcggcagcagtaatgatatggtcttcctgatcatcgccctggccgcagcctgggagcctcctgggggtatggggaacagatccttcagtaagtggtccctgcggacccctgctgcgagtggtcctgtgaccggggcttccaagcagctcaacagattgcccctcaggttttctgttgtgtggtgtttttggacagacgttattttcttttttgtagagtagcctgtttgtaagtttaaagtgtttatttttctcctttgcagcatcatggccagcccaagaaccaggaaggttcttaaagaagtcagggtgcaggatgagaacaacgtaagcctctgccccccaccccccgccctaaggcttggtcagggtcagtgagttccgggaagttgtactctgagcctgtagttctgggaccctcctgcagtggatggtggttggcgtggctctggacgtgcatggcttgtgctggctggtggcctgggtggccggctcttagagtggtgccatttctggcgctcatcagtgctggctgtcgggggtgggggcgcctccacatttctcaggtcactcgctctaaggacaggtccgcctcgtcttcccatctgaacattttattacacggaggctctttcccctcacgccttgccctgacccacacccccggccaccctgggcagccctctgcattcgctccttgaggccacctgtcgggtctttggggtccctgggctctgccctgagccacctggtgagtcacttgtggcccctttgcaggtttgttttgagtgtggcgcgttcaatcctcagtgggtcagtgtgacctacggcatctggatctgcctggagtgctcggggagacaccgcgggcttggggttcacctcaggtcagtgtcctgccgctctggctctgcggagagcctgcggccaccccagcatctgttcctgacaccagaggtgctgacgccagggaagcttgggggccacctcccattgcattgccagtgtccactctagtgacgccatggcacagagttccagctgctggccactcagcctccctgcggctgctgcttgctgtgtctaattctcaggacgatgctgggtggagggtgtccctgggtgtccccggtgctggttgatctgctcgatcctctgctttccagctttgtgcgctctgttactatggacaagtggaaggacattgagcttgagaagatgaaagctggtgggaatgctaagttccgagagttcctggagtctcaggaggattacgatccttgctggtccttgcaggagaagtacaacagcagagccgcggccctctttagggataaggtagagatgggcccgattcactcttgcccatggtgtggggctgccctgccgtttgtggcagctggactgtggcctttagtggttctggagtcggttcttctgctggttctgacacacccactgggccacacacaacttgccgccctggagcagaggcttcctgcccagaggggaggcaaatggcttgcggggggagacagaccttccccgcctccaggggagaaagcagctgtgaccgtttattgcctctgtgacatgttgggcacagtgtttctaagaagtctggaggccaaataggtgggtccccctgtgttggaagttggagctgcaccaactaggagctccccagcactgttgttcattgtaaagtgagtcctggcctcgcatccacacctggtctgtgcacctgagcaggggccgtcgagggggccgggaggaggctgcgggtggtgggtgctccaggcgggccgtggggggtgcgctggagtcgacggtgcccgagggcatcgccaggcgcctttatgctctcgaatgccctgtgtctccttgtcaggtggtcgctctggccgaaggcagagagtggtctctggagtcatcacctgcccagaactggaccccacctcagcccaggacgctgccgtccatggtgcaccggtagctgctcctcgtggggccttagtacagtttccactgggtcctgaacttagtagattgggtttcccacagaattctccccttctttgctgttgtgacagctcttttcccagaagtcagtgggaaaaacagctttttaaaattgccaaaacaatacaagcttttagtaaatttagacacccatagagctgtctcagatagcgccccaggtaagctccgcacgccttccaggtgtgcacacagccgtgtctgccgtggcgctgtgggagttcacatctccatctgctcacgggggtgttgtctgcccttccccagagttgcccatctgcctgtggcactggccctggcacccttgaactgaccccgtcatggatgcgtcccacatcccactgcaggaacgtcccgggtggggtgactgggtagcacgaggcctccccacctcatctggagccctgtagtcctgccacatccacgtgcttctgacggaaggctttgcactgcgggcaactccggcttgattccaggccctcggccctcttgcctcacctctccccgctgcctcctgccaacagggagagtgcagagcccactgtggaggcctctcgtgttgcccatgaggctggcattgctggggtttcagcacctgagcccgagcagccactcagagctgaaggccaccctggcctcaggtgctctcaggggtgacgtgaaggcactgcccacgtaggccacatggttctgggggtgcttctggggttacctcagacttcacccagttttggccttaccagccttcgattctcggtttcagagtctctggccagccgcagagtgtgaccgcctcctcggacaaggcttttgaagactggctgaatgatgacctcggctcctatcaagggtaaggacttgagagctggggacgcctggcgtgggccaggcccacagggttcagtctggtgggtagggctgcttcccttggggcctcccatgtgcagtgggtgtgggacccaggcatgcgcggtgcagggtctgattgcagtgagtcccagccagcccagtgtgaattgggggtcttgggtgtattgcagtgagccccagccagcccaggtgtgaattggggggtcttagatgtattgcagtgacccccagctgcccaggtgtgaattgggggtcttgggtgtattgcagtgacccccagctgcccaggtgtgaattgggggtcttgggtgtagagaagcgctaacacttagaagaaaagcataacacattttctgcgtggaatctgctggacctataaatgaatttttatccccaaagctgtcatattaagttgttttgatccttcttctagtacttctgtggctggctttggggacttgctggggaccctgtggtgatgtggcaggagggtctttttaaatgatcagaaagcacatctctctgctgccacaggaggcagcgtgcatgtcctgtgcgtggggacgttggcacgtcccccagagccccagccttgcctgtgttcagggccccacgccctcgggaggagcagggttcatgccagcatcttcggcctcttgtccgctttgttttcagggcccaggggaatcgctacgtggggtttgggaacacgccaccgcctcagaagaaagaagatgacttcctcaacaacgccatgtcctccctgtactcggtgaggacttggccctgcagagcatctcccatgggcagaccccgccctgagggcacgacgggccatagtgggcagtgtggcagtcctggaacatgtgctctttgccttgttctgatctaaggacccctcccttaccttcagcgacgttttctttcaaaaatgtggcttaaatttttcagatcccaaatgtattcaatcacttcctttttttttttttttttaagacggagtcttgctttgtcgcccaggctgcagactggagggcagtggtgcgacctcagctcactgcaacctctgcctcccaggttcaggtgattctcctgcctcagcctcctgagtagctgggattataggcacctactatcacgtcaggctaatttttgtatttttagtagagatgggttttcaccaggttggccaggttggtttcgaactcctgacttcaggtgatctgtccgcctcggcctcccaaagtgctgggattacaggagtgagccaccgtgcccggccatcacttacttctaacacaaaatgtgtgtatttcaaatctaacaacagccattcttccaaggaacccaaggactctgatggcagccacttggccaggttctctgcagaggggagtgctacatgcattgggaagctggctctgtgcttgggtctctggcagcgctgggaagttgctcgggtgctgcctgaggtcactcagggccatttctggtctggggatgcctggaagctccaggtcagatgttcagagtatgacaccctgggcttgttgccattttgctattaacgggaatacattttgttccactttctttttccaaggaaatttttaccatctttaaaaaatgatttttgtaggtgtgatggctcacgcctgtaatcccagcactttgggaggccaaggcgggcggatcacctgaggtcaggagttcgagaccagcctggccaatgtggcgaaaccccgtctctactaaaaaaatataaaaattagccaggcggggtggcatgtgccttgtagccccagctactgaggaagctgaggcaggagaattgcttgaacccgggaggcggaggttgcagagagccgagacagcaccattgcactccgacctgggcgacagagtccgactccatctcagaaaaaaaaaaagatttttattcattgcagcattgttgtccgtgacaccagcaacctgagcctttggccacgggggctgcttaaacgggagcttgcgctgagagccaaggaagggcttattttgttttttgtttttttgtttttgtttcttttggagacgggtcttgctctgttgccagggctggagtacagtggcataatcatagctcactgtggcctggaaccctgggctcaaccatcctcccacctgggcctctcaagttgcttagcctcccagagttctggtattacaggcatgagccaccatgcctggccagaaagggctttttaataactagcatgacaagatcttcaaagtctgttaactggaaataagcaggtttaaagcggatgtcttcatctgcaagagcccccaagtgtgtggagcttccagtcgctcggggtggcctggttgcacctctggccgctgacggccatggttgctagctcttgcagtcattgctacatctttagggaagaaaagcgcatttttccagcctgtgtgtgggcttcatttttgtggcccttccttctgctgccttttgctgggaagctgctctctggggaaggcagctcagcttggtgatctctcaagtgagggtccctttgcacttcctttaggaggaagagggtgagttgtgattgaaatgagacgtttatttttttaaatagctttaattatcttgagaggctcagaaggaaaccctgagcatagatgaaggagagcaggttacgctggtcgtgaccccacacgcctcacctctgcctgttcctctagggaggcaggagggagcgccggccatggggaggggtcctgccctgcagggtgggcttgcttcttgagggtggtgggagccacgggaggctggtttgcgctgtgttgggagcactgcagttggcgaggtgggggtagagggtgcgtttctgttgtgccctgggtccagttgcactcctccagcagcctggagaagcaggcgcggtggggtcaggatgggacgggggcctggggcagcctctgccttggtcctcttccttgctgagatactctgctcagcgccgggttcctgggtcccagtcctgatgtggctgctctttgtcgcctccctcagggctggagcagcttcaccactggagccagccggtttgcctcggcagccaaggagggcgtaagtcactgcccctgccatgccaccgtccccaccaggccctcgggacactggctgctgctggcctggggttctgggagctgcagaagggatgtgggacacagagggtttctgggtgctgtaaccatgggctgtgccaacgcagtaccagccagggtggtcctgagaccttggaggttctgcaggaacacagcagcccaggctgtcaggagctgctcctgtgtcagaccagctgctggcaaaggggtcccgccctgatgaaagtgagggagatgtgagccccattgattcctagactccaccctatccaagcagggcaggtctccggcaccctgtgccctggagcttcttctggggctcaagtcgtgttttgagagcgatttctctctttcgcctgctcctcagcctgaaatgaggggaggatttggggctttcgtcagggcagacagtgaagcatgaggcagagacccaagagcaggcctgacaccaggatggagcatgggcccccgggggctgggctgtggtgttacaggagaaggggaagcccagagcagggcagcgcggggcagctgggtgcctgcagctgcccgcagaagcagccaaggcacctagggtggggctcttgtgagtggaagtcacggtgcgcacctgtcagatgtccccgtggtcaccctggccccgtgtcttcccccgtcacagcgctcacctgtcacatgcccctgtggtcactctggccccgtgtcttcccccgtcacagcgcgcacctgtcacatgcccctgtggtcactctggccccgtgtcttccctgggagaggaaggcctgggagggccctggaaggggcagcaggccaggtgtccacgctccagctcccacggccccgtgactttgccgagcgtcagcttctggttcccgccagggccgccgttttctcgtctgcacgggagggctgcggcctggggaggcccaggtaccttccagccagagtgtcacgaccgggccttttctcctccccccgagctttaaagtgaccaaggtgcctggactgtgctgggcatggagccgtccccacagcagggtagatggggctggggcggtggcactgtccattgaagatagcgctggtgtggcttccccagcccgtcttctgctccagcaggccccggccctgtcctgaagtctggaggatggggttggccctgctgttccctggccttgcacgctgctcacgtgtgccctcaccccaatagcacaccgagctggcctccctctagggagaggccagcatttgtgctaatccagtctctgctgcagctcttctgggcatctcagagttatagggcccgcccagagccgctggcagcccgggggccattgagagacagtcctggacctgagtctgtgggccctgaggaaggatgcctggcagcccatgttaagtctgtcaagccttgtctttgtttttcattttaggctacaaagtttggatcccaagcgagtcagaaggtaacagaggagaagcttctgcaccctggtgcatctgaaactatcctgagtctgacgtcacgtgcagcacctgaagctgcctggttccctcttctcaggccacatgctcagagctgaggggtcccagcgtagaagggggtgttcctgccatgctgttcccctcctcatgcccgggtggctgcctcatggacccactcagggcctgcagggccaaactcgtttcctgttcactggtagctggtaccggtgtgtggccactgcagccggccaccttgttgggagcaggactgcccggcttggcagatggcccacgctggcggtggccgctcagccagaagggccgctgtggttggtgctgtgcctgcggcacactggacgcgtctgcacttcgaggcaacggagcgtctctttgctctggccagggcttcccccagtcggggcagtgtggcctcaggcctttgcatgttttttattctttaggatgtgggtaggggccccgcggttcccacttggtggtcagggctgtgatctggctgtcctcgggttcagaatcacacccaggaggcagtacccatgtgaggctcaccatgaaagctcaggactgcaggcgtggagctgtgcatggctctaggacgcgcctttgccccctgggcgagggtgtcctttctcacgaggtgcccatccgtcacccccgtggcccatatcaccccttcctctctgagggagtctccccacgtgcccacccccagctgcagggacgcccatctggctttttcgtgggcctcccagggtcctgaggtgcagtcgctcgcgcagtttctgaaggtggtggtcagttccagggcagggagcggctgctccagggttgtgttgctgagagcctgcccggtgctgccttagtgttgcggcaccccatggtgggttcgaaggcgctgctggttactaatgccgcccctcaccttgctctctcctcacctgtcttcttgctgtcgggtaaagttttggggtcacaagcagcagccggagccggtaaagcccgtgtctgctcgtgcatgccgcccgcatctccgccgagaatgtgcttggcttcctctgtccctcctgcgtgctgccactgtcttgtgtcacctcacatgtgcgcacgctcagaccctctccctggcctcggtccgtggctctcctttaagatccaggatctgcatcaggcttggctgtgtgtgcctgtcacccctgcgcagtaccactgcgctccccccgggcaaaaaaatgagacccccatctccaaaacacacagacccccaacgcaggcctgctgccggggaggtgctggagggagggcgggggcactgggcgcagagctgctgagcagggtttcctggccacctgcgctcccttgaacgcagtgcaaaggggaggatctttgctctgtgacgagttcttccctttccggcctttgatccgtgctgctccctgcctttgggggaagaggaggcctcacaccacatccccaggtggccgtgtggcctcgactccactgacccaggatcaggagaggctgagctcctttctcagcagcttcttcctatggccccagcctccgtgccctcttccctccaggggggactcggtgcctgcctggggaggaaggagaggcgttgcaggtcagcatggggtggctgcagccggcgttggcctcaggcacaggctccacagggcctgttcccaccagcccggcccggcagggccgcatggtggcgcgtgagggaggaccctggagggggaccttcctgcaagaattggtgggggccgcggtctccgccttctagaggtggcggcctactgcccttcgggtgttgtgtgcaaagccccgtttcctgctccctgcgcttgtatcctgctgccttccctcctgctggtgaagctcgtgctgccctttgctggcctgtgctgccactgccgacccgtgtcccgtggtggagctgtcgtggggctcacgtgacttcccttcctacaggcgtccgagctgggccacagcctgaacgagaacgtcctcaagcctgcgcaggagaaggtaacgggcagctccgggtggttgtgcctggagcccttcactccaggggacgtgggtgtgtcaggggtgttagggggattgtttgtccagcagctgggactcagcgaggccaagcctcacaccccacctctccagcacaggcgtcctcctcggggcctgggctcctcttggaccccccagctggtcccttcccctggcctagggcctcccttgcagtgcccccagcccagcacccccagcccacctccgttcctctgcctcacccctacagctggccccagagcccagcacccccagcccacctccgttcctctgcctcacccccacagctggccgcggagctgtgcccagaggaggctctggtatgggaatgatgcctgccatcctagggggtcaagagccccgccagctccctgcctccttcggggcctgactgggacaagtggggaagacccacctggggcagcgtgggctgtccttaggtcacgttgctatttgtcagcagtggccggcaggggccacgtttgcagacaccaggcctcacagtgacatggtttcttgatgctggaatccctttggggccactgtagaactttctggggctcagcctgatgggtatccacatgcccctgatatttcggatgccctcacccgggggattcctgcactcctgaagctttaagctttcatctctcccgcccccattaatgccgctgtcttcatccgtgcaggtgaaggagggaaagatttttgatgatgtctccagtggggtctctcagttggcgtccaaggtagggagcctgccagatacgcgggcacagtcgaagccagtctccatattccacggccctgggcgtgagagcagggtgtgccccgtgcagccctcagcccagcttggcagtggccgctgtcctctgagacgggaggagagctgcccagcctgacagcccgagggatatggaaacaacttggcccactgcggcccggtcagccactaactgtcacttctccctctgctcttatcttgctgctgctggccttttcctcggtaagtaagtgccagcgccgtctttgctgccatcagtcccactgctctgcgggccatttggggcgtgcattttgtcctgtttcctggcatgaggcgctctgcggacagacggggagggaagagcaggcctcgctcctcccccccaagcatgtggtgggagctcttgaggtctgtgcacgaggctgtcctcgctgccatgtcccgcacacacctggcaccgctgcagagtggccggggcgtctgtgtctgtacgtgtgtgcgaggcaccccttgtttctggattttgcctgggtcttctcagcgggacggcgcgtgccggcttgcgtgtgggggcctcctgaagctgcctgtgccgcgacagggcctgcctaacctctcttcccgtctccttccaggtccagggagtcggtagtaagggatggcgggacgtcaccacctttttttcggggaaagcagagggccccttggacaggtatgctgtgtcccctcctgggccttgcatcccactcccctgccttggccactcctcctacaggctctccaggaggtggctggcatccttgctggggagggaaggggcactgtggaggctctccgggaggtggctggcatccttgctggggagggggcactgtggagcctctccgggaggtggctggcatctttgctggggagggggcactgtggaggctttccgagtgctctgcagctgcagaggcctgtcctgcctgtctctgccctgctgtgtgctctttggaaccctgcaggagctgggctccccaggctagggtgggagggagggtctcacccatatgcccccacgtaggaggagctggcgctgctctgctgttcctctgtctcccagactctgggtggatggagcaggtcgggggccaggggacaggaaggctagggccccagagacctgtcctgggccccatgtccagctctgcccttagtgcttggcaccccagtcgcttctgctggaagctggctgctgttctcggcctctgaccccaacaggggaaccaccggggatctcatcgggcctggccttgtgctgtctactgagaggccagccctggtgggcacagatgcactgcccactaggtgggcccaaattttccctgcagacgccatgtcccttctctccctctgtgtatgtggtttttcagtggtgtgattgcagctgaggacagagggcagggccagatctggggccagcgtagctgagggcgtcgctcgggagggcctgtgtcccggcttgaggccaagcgcccctgcccctccccacttgactaaaccactgttttattgcagcagtttggagctggtagaaaaggaagttttctgtaaaactgtcctccagttggggtggttgataaagagtgggccctggttctccagctccccagcagtttcctctgctctgaagcgggagaaacagatcccacctggtggggctgctgtggaccctgagcgctggcctgggaaggcggtcactgtccaggtgcagagctctcgggggcacagaattcccagtggtggactgagtaacagtcatttagagtcccccttctgtctctttaaaagcccctcggagggccacagttatcagaacagcggtctggaccacttccaaaacagcaacatagaccagagcttctgggagacctttggaagtgctgagcccaccaagacccgcaagtccccgagcagcgacagctggacgtgcgcggacacctccaccgagaggaggagctcggacagctgggaggtgtggggctcggcctccaccaacaggaacagcaacagcgacggcggggagggcggggagggcaccaagaaggcagtgccgccggccgtgcccactgatgatggctgggacaaccagaactggtagggcccactgcgcccccgtccccagcgcccccgggcgacttcgtgtttgcactctgccctcgtcgttcctcctccttccatttgacccaagaatcagcaactgcagtgtgaggacagcgtctcgggaggcaggaccctagggagacccgggtgtgcgccgcctgcgcgtggggagtcttcggtgcgtgggggcggcttgctgtccagcctgtgtgggggccgtcccgtcccacactcccctgggcattcttggactcaaggccggggctctgcgtggcttgctgggaggtgggctgcagcacagaggcctgtgactgcgttccagcggccagttcactacgcagtatctctggggcctgggaccagccacgtgccgagctgtcagcgacgtgaggtgtcccttctcgttgagatatttaactttggttttgctctagttctttctttttgaagagagtgactggagtggtaaagatggaaatgctggaaatgatactggcgctcacgctgccatccgaccaccctcggctcccgagtccacgcctgcctgggcctgtgctgtcagacccgcgtcggtcgtaaccctctgtggctcccctgcatcagcaccgtcccaccaccaagttcaccaggttcaccagacacggcctccacaatagccacacccacacctgagctgttctcagtgctggaacttgaccatcctggaacaccctggaagaaaaaggagcgcagggtgggccctcggccctgatgcaggagggtgcgatagcggacgtggccaggcaggaggggccgggttcaggagctgagcaggggatgcctgtgcgtggtgcctgggtctagggaagctccagccccaggatggggctgccctgcacaccggtgcccgccacatgccaaccctcacctccccgaggactggatgatgtgctgccacgtgtgactcgtctcccttgtctgccctgtgtgaccctcagtcttggccagccatgcatgcgcccgaagctcgtgcagtttgtacgtgaggtgctctcctccctgccaccatgctcatcactctggccttggccatgctccctggtcaccccacttcccggtcgccgtctgcagcactcctggagcagcctgggcccttcagcccctgtgctcgtcccaccctagggactcagccacttgcagaacaggatgggaccgagatttcagcgagccctcctggcgcccggtcctccctgtgggcaccagccctcttggtagctggtgtggagggccggtgtccttggctgccacggagggatttgatcaccgaagcagccacctgctgtagttggacctgaggtcagaggcggggcatcagaggctcaaggtgctgagaagccaccgggaaagcagccagcacaaagggcccaggaagccagcccccgagagctgagcgtgggggtctttgagtgtctttctccaagctgagacgtgggcggccgcgtggtatctcccgagggctgcttggaccctggtgggctgagtgctccgaggaggggtggactccaccttggacagtgggatgtggtgttccacatgtgcctgtttccacgccagcaccttgacttggcagcatggagccaaggtctgtccccgcccaggagggtgccttcctcgggggtagggggacggcccactctgccccagggagtcccttttgatgggaagtgcagtcagcagcgtggaggtgtctgggccaccttcagaaggtggatgtggtggccgagaccccgtccacggagggtgatggcctttcccttctgcaggtgcgggcaggtgggcctgggaccggtgctggggcctctccttgctgtgtgtgagggcccaggtggaaggcgcggacctgacagcattccaataaagcatacgggaacatgcagaatgtctggatgcatcccaaggggccacttccagtgctgtgccagtagggtcatgggacccccgggaaggcaggggtgggacactaggaatcgtgggcgggctccctcactgctcctggccccctccacctagccctcctggggaggccctggcatcaccccatctgagccagagcttctggggagtaggggagcaggcagctgggtgacccagccagggaagagtttacggggtcctggcatgtgcctccggctggccagcgagacactgtggtggggtccagtgacccttggcctggggaggtgggcagtggctcctgtagtagaggatggcaccagggcttgtgtctaggagggctcctgcccctcccagggattcaacaccccctatgctggggacgatcccagcccgtatccaggaaactcaaggtgccacctgatgctggggttggagggcaaggagggtggctgtagccaggagaggcccacagaggtcctggagtctctgtgtctcaactgggtggctcccaagggtcatcctgctctggggcagcgctttagggcaggtgggctgaggtcagaactgccggatggggaagacgaaagtggcgggtcccggccaggctttgtgggcctggggtccgttcttggctgaagcctggtctcggtctctggccagcttggtggggcatgggcagtaacgctgcacagctcccggcctccagcatgcagttccacccccaccgtggctccaggagtccaggctgaccacgctgggcaccttctgccacccgtctcttcccttgagccggcctctgctgtctgtccccagatactggcgtgacccagtggatgctcaaggccagcttctgcccttcccgaaacttttctaagtgcactgggtttcccctggccacccactcatcgcgcctgctggcattgctgtccccctgttgagccttccagggacaagccctgccccatgagccttcattgctggccgacagagggggctgggtgaggctgacggctgtggggcctggccctgctctgttctgacccagccaacacaggcgggggttgggggtcagtccccagagcactgaggcttctcgggggctggaggctgcacaggaggccactggggccatgtccccaattctgggacctgtgggcctgggatcccacctggaaccgggtgatatgtgactggccacaagcatgcggggggttcctgtggggttggggcctcaggccacagtaccctggtgaggagaggacagtggccgacccaggttctgtcctgtccctttgtcgtttgtgaccccggcagctcgccggccctgcctgagccggatcactgccacgtggtctgaggggtgctgcagaggtgtcaggagtccaggagcaggggcggggtgaacaggcagacgggtccgcccttgtggagctcacatttcatgagccaggagtgctgggtgcctgactgcctggtctgtgatgaccctgacgctggcttgcatgtgtgggatgtgggtgcacatacctgttcccaggagcctgtgagccggggctgcacccctgcgcccggtgcctggtgcctggtgcccgtctgccagcctgggcgccctcctctggccatggccaggactgcaggcaccaccggccccctgggagcccgccacggcgacgacctgacaccatctctcaggctgctcctccgggacagccagttggtggatgggctgtgcaagaggtggccatgggtggggtgtggtggctcacacctgtaatcccagcactgtcggaggccgaggcgggtggatcacctgaggtcgggagtttgagaccagcctggccaacatggtgaaaccccatctctactaaaaatacaaaaattagctgggtgtggtggtgggtgcctgtaatctcagctactcatgaggccgaggcaggagaatcgctggaacccgggaggctgaggttgccgtgagccgagattgcggcattgttctctagcccaggtgacaacagcaagactccatctcgagaaaaaggaggtgctcatgaagaggtgtatcctgaatctgaatcggtgtggcccagggatccagggaggtgtggagaggttggcccctctcctccgcagcatccagcctgggcctttgcctccagcaggtgtcacctcttcctctgtggccgctgtgccagcgctggcctctcaccgagcacctccagctcatctcttgcctctggaggctgagcctggggccaggccaagtggtttctcttcagctaccagagcagcaggcagggtcgggagaggctcatcctccctcaggcctcaggcaacccagggtcgggaggcctcgagggggctggccctttcgcactgtcctgagtgcagaggaggcatggacttggggactgggctcacaaggccgacagctgcctccagtggtcctgaagcacccatgcgacgcgtggtattaggctggggtccttaaagacagaggtagggacacgtatttgggtgcactcgggtctatcggggaggcagatgcctcggccggatccaccttgagctgtggacagtgagtgtcttaggaggctgtgcagtgaggccgggatgcccacacttgcgtcaccacccagtcattgggcaagggccgctggggtgcatctgttatctcccaggcagtcccggggcagggacagctgtgagcggtgggccctttatagccagcaggtgctacgggactctgcgctgcctaggtggggccttacgtcacagcacgggtgggacaggggcagggccagggcaggggcagggccagtgttgggctggtccagttgggagcagcccagggtcccgtcgggtcaggggcctgttttccaggcctgggcacctgctgaagctctggttaccggcaccagtctgcaaagtgggttgggtggtggcagccttcaggatgggctgggagggcatactgggggaggggaagggtgaccacatgggtgggggaccaggtgccactgcagcctgctccccacagtgggcagccagaatccctagtgtccagcacccacacgtggcggccttggcatctgagtggctttccctgtgagcccctccttgcaggatggaccctctgggagtgaggagtaaaagtgttgggccgtgcagcccctgcctcctcactggtgggaccctgccctgctgtgcagtggggtccttcgtgctgggatctttgtggtccccgttcttggagagatgcccggggcggcagacaggaagggtggagggcaaagggaggggaggagagagaggcaggccgaggggtgggtcggggggtgggctggggcagtgacttctgtggaggagaagcctttcataagctccagccttcctgtggccacagcaggaccagagtggaccagcacaccccaggagagaggactggggtcccaggagtaggaggaggtgggtgacttccctgtggtcctgaggctgggtggataaggggctgccaggagatccactcagcctgtgatctgagggtgactgactttcagaaaagtctagatagaggccaagtgcccctgtgagccacaggaccggggtgcccagcacgcacagggtgtggccaggaggggccggggcagtgggagcccggggctgcctgagctctcaccaagggctcccttctgggggtctcagacaacatccagggctgtgggggaacgaggagggtgcacatcgagcagagagcggcttgcacttcaggctggatgcctgtggccctggcaggggtcccactgagtcaagccaggtttctggggtgggaggatccagggacttgggggcactcgggctgcccactggtgcctctgtgatcagtttgggagcccagccctcaggtgcctcctgttccaatgcctgggtcttacctgactgcccttggccggccgggcgggcatgaaatccctgatttaagccggtggctttcccgccgggtgaggcctttcccttgcagaggagcagattccctggtggggatactggggtcacacactgggagggggcgtgtattgggggggtctctgttcggctgcagggggtgggagggcctgggtcactcaggaccctagaaccctactgtgtgggaggctggggctcacagaaccagggcctgcactcaagccatgccctcagctcagcacagaggggtaggggcccggcctgccgggagtgctctgtctgctttctgaaggcccgagttggtgcgtggggtgaggggctggcatgagcagtctcggggagcgggagtgcaggggagcggagtgtgaggggagggggagtgcggggggaggggagtgcgggggagggggcgtgcaggggactgggggtgcaggggactgggggtgcaggggaacggagtgcaagtgaacccccggcatttcttcttcagccctgggcgtggtggcaggtggaggactcgggcctggcagctgacatgctccccacctctccgagtggcacctctgggcactggtcactgggttaccctggcctctgagtccccctcagctgctcctcagagcaccccaaatccaacctccactcccagcccctttgagtgggccgggcctggttttttctggtcctccttgtagcccactcagctctccagtggccctggcggcctccctgtctcggcctcagagccgtgtgcccgtggcacacacaccctgcacccccggctggcgtcccccagacccacccgctccccactcctactaggcagctctcactctcctccacaggtctctgatgacccttccgcctccagggcgaggctggggccacagggactccacatgtccagcaatcagacattgcctggagagctcgccccttgcctcagccctccgtggccctcgggagccccacaagcaggaggccccgtgcccgtcccagccacccctgcactgggcgtggggacaactgggggctgggggtcctgttgtcactcagagcagcccccggtggtgtaaatgccaagagtggggtgggagtgggaggcagccccagctctagccttgggtccttgagttttaggcagctgggaggtatcccctagacaacaggttgcaggcctctggtcctcacacatgtgaggggtggagcccggtgtggggacaggctgcctggccctcgaggatttggagaagctctggcgttgtggtcagggagaggacagacggggggacggctgaagggcatggcctcttccctgccacagcccgagcaccatgagctccggagaccctgcacacctcggcctctgcctctggctgtggctgggcgccaccctgggaagagagcaagttcaaggtaaggacactggcagtgggcccctgcttgccccgaggccacgcctgccccaccagtgcccacgcgggacgagccctccgcccctgagccccgtcttcctcctaagttgaatgcgtgctgaattcacagcagctcccacaacaaaggcaagacgggagggagcgtgtgctcccgccaaaccttcagcctcgccttgggagcacatctctgtggtttagttctctgttatattaatgcttggccgagagttattccacgaacacctttcggagcagtctctaggaagcaggaggctggggtaaagatggagccgccttcccttccctcctgcctgcttcccaccgccgcctcccactggtgttttgggcacatagccctctggcttctctcggtgcggcactcgcatttccacgcagcaccaccccctccgtgcgcatccctgggcgacagcaccacgtcctcagaaggcccctccagtctggctgctactggttggggcgtttgggtaacgtagggcaccgcccatggcagcaaagggaaatggcagaggatgctgtgggctcacctgtctgagcagcttcttcctcctgttgagaaatgtgggtttagattgactctaggaaggtgaatttccgtgtctatggagaaggctccggggcctcggccacgctgtaaacttgtccctgggctgggccaacgcggcgcctcccggcacctgcaagctcctgggaggttccgggctcccactgagcgatggttttgttccgctggggtgaaaggcagctcccccttctactgtgcgtttaaagcacccccaccagggcctgacaggccggggcgagggagcctccaggtgccgctgccattgcagaagggcgggtgagatgcgggagccccggtgtagcgtggagccgcctgttgagacccttccgggtttcacggcttgtcttgccatgctgatgtgccaggtttgccctgcacacaggcaacagaccattgcatgagcaggtgccttggtcccctcagctcagacagggtaaccctgccctggggccagtgggggctgagatttcagtttgaaagaagcttgcactgtcaatttgagccaaatcagtaagttgcttctacagaaacaacttgagtttaggcgaaggcaaatctagttctatctagttcaggattcagcatgatggggccacccctcacaagggcctttcgggggccattgagtccctgaggacagccaggtgggctgggggcactgagtccagcccaggacgggtgggagcccacacgctggggcagcccttcccaggatggcccaggctgggtgcggccacagtccagggaggggagcgtggtcctgggtggggcccttcccaccagccgctgtctgcccagtgccctgctcaggccccaacagtgctgtcctccagcagggagctggggaaggggtccctgacgttctcaggcagagtggagcaacagaaggctcttcacaagcaggggctgcgggaggggccctgctcacagctggccttcagagccccctcctcatcccccacacattcctgcctttcagccccatccggagacccggcccagctgctgcctgctctgaatgggtcattgtgtctgccccagtgccccccagcccctgctcttccccccgagccccagctttccggggggcagcccaaagaagcccatctctgtccccattttccaaaaatagctgcccctactgcagagccccggaagctttcagggggcaccaaccctctccagagccctgggaggttggccaggcccctgccgccccctcttcctctcagatggcctggacacccatcccccatcgcgggaggcagcctcgtcttggcatggacgcacacatgtaccaacgtgcacacacgtgccaatgtgcacacacttccagtgtgggattctgcacccacactccccactgaggcggcacgtgcacctggcagtgaccttggcagctaggggtctgcagctgcatggccacttgtcctggggacccagcccaggggactcagcccaggggccccagcccaggggacttagctcaggggacccagcctggggactcagcccaggggccccagctcaggggacttagctcaggggacccagcccaggggacccagctcaggggactcagctcaggggacccagcccaggggactcagcccaggggccccagcccaggggacttagctcaggggacccagcccggggactcagcccaggggccccagctcaggggactcagctcagggccctgggcaggttgccagctgctgtgttggctcggggcctccgatcatcagtggggtggttgctgtcctcccagacatgggcctgagcctcttcctggtgggaggacccccggagagccaggctggggcctccctgggtgggactggactccctctcaccaaagctaccagggtggccctgtgactgcggaccccggggagggccgggttctcctcagcgcccaggcgaggcctcgtatccccaagtggggctgagtccgcctcagacaccctgggtgggcttctgtctcttcggggtcccccgggataggactgtgttcctcccaaatgctgagggcaggatgcctgtacccccacagctgattaggtggatggggaggccaggtcagtcctgaccactatgtcctgtttctgtagcaagcggtctcctgaggctggctgtgctgcctgaggaccggctgcagatgaagtggagagagtcggaggggagcggcctcggctacctggtgcaggtgaagcccatggcaggtgaggacctgcccctcccaggcccccttccccattagcacgtgccgaggacagtcagtgtggtggccgcagccaccactcaggcccacagcatccctcccaccagccccttagtgtcagcacctctctggccttggtctctgctgacccacattcctttcccccgtcacatatgacatggaagagggaatggggctcctctgtccctggcacgcagcccctgcagaaggcattcagtacatacttttaatttttttgatttttaatttcaatttttaattttttttaaaggcagggtcttgctgtgttgcccagactggagtgcagtggtgcgatcacagctccccgcagcctcaatctcccgagctcaggagatcctcccacctcagcctcctgtgtagctgggagtacaggtgcgtgccaccactcctggctaatttttgtattttttgtggagaagaggtttcaccatgttgcccaggctggtcttgaactgggctcaggagatccgcccccctcagcctctcacagtgctgggattacaggcgtgaaccaccatgcccggtccatattttttaaagaaacgactccctcctcagaacgagtctcaatgcgtcaggggcattcagaacagcctggactccgcacagcgaaccccagaagcacctgctccccacgcgttaatccttgtttccaggagcagggccttgaggacaccttttcagggaaccctgttcctagagcaggaacagtcctaacctgacaatgggtgctaattttaaagcttttcaaaactcagatggaaaagcacacaggcataaatgctaactgtatgaatcagcactgtggggtggccaactcaaacccctcctggggtggaaaacgaccgtcccgggtgccccggtgcccttgccaacgtccaccctcccctgctccctggacggccgcctccaacagcatggactagtttgcctgtttcagaacattctctaagtggaatcacaccatggcgactccctcatgtctgtgtctttggtgggcattttgtgaggtttgccccgtggtgtgtaacagccgtccattttctttgctgtatagtattcccctgtgtgatctcttctgctattgatggacatgtggcttgtgtccaggttggctgttgtgtagacgccgtgtgagggatcccgcgtgtgtttctggtgtccgtgcgcctgttctgggtgtaaacccaggagtggaagtgccacagtgtgtgcatagtttcaacgttagtagaaaatgttgaactattttccaaaggggtcgtgccagtgtatactcccgtcaacactgtatgattgcttccgttgcatgacacccttggcaaccaacgcttggcagcctgactggagctactctggtgggtgttcagtggtatcctgtgtttctttgtggagctgtaatttacgtgcagaaatcttcacccttttgagaagaggtctgtgatttgtatttatcacatgaattcaatcctgtagccgctatcacaattgatgtagagaacagttctgttaccccaaggtcagcccttagcccagtgcccgtaaccactgagctgttttctgttttgccttttccagatagatggaccttatcaggttcagtcctgtgctgttcctacgtaaggctgagtttttgtcaagagaatgcattattttttccaaactttttcttcagtgaggtggttattttctcctttatttgattaatgtagtaaactacagtgattgattttttaaatattaaacataatatatacatatatacatatatatgtatatatacgtgtgtgtgtatacatatatacgttgtgtgtatatatatatgtacgtgtgtgtgtgtgtgtatatatatatgtataccttaagagacagggtctcactctgtcacccgggctggagtgcacagtgcagtggcacagtcatagctcactgcagcctccatctcctggcctcaagcagtcttctcaccttgacctcccaaagcactgggattacaggggtgagccactgtacctggcctatccccttttatatgttattaaatcaatttgcaaatatttcatttaagatttttatacttatattcatgagggaatattggccaataactaccctttcttataaagtccttttaaagtttggtatcagctttatacctcataagatgaggtggggaaggattcctcttattctgttttctggaagagtttgtgtaatgttggtggtatttttttccttaaatgtttgctagaattcactggtactgacttctgggcttgtggtgtgtgtgtatgtgtgtaaatacttcacataattgattcaatttccttaacagacataggactactcagattttctaatttttttggtcagttttggtaagttagttttttaaacaggaatttgtattttatataaatttcctgattagttggcataatgtttttcatattaccccatagactctatagttatagcacccttttcattcccgttattgattgaatcttctctctgctttcaaaaggcagtctggaagtttatttactttattagtcttttaataaaacacattttggcttggttggtctgtcgttgattttgtttattttttattgttgtttctatttcttttactctgtgtttaattttctgctctaacttaagatggatgcttaagttcattgattttctgcccttttacaagatataaagttaaaactattgaattttcttctaagcagtagctatagctgcattttgatatgtagaattttcattatcattcaggtaaaaatatctaatttttgttacgatatttttatttgacccataggctacttagaagtgtgtttctcagttttaaaacatgggggattttctacttattttttgttttggatttcttccttcattgcattgtggccagaaatgtacaatatgctttcagtcctttggaaagtaccttgctggccgggcgtggtggctcacgcctataatcccagctctttgggaggccaaggtgggcagatcacttgaggacaggagtttgagaccaccctgtccaacatggcaaaaccccgtctctactaaacatacaaaaattagctgggcgtggtggcacacacctgtaatcccagctactcgggaggctgaggcaggagaatcgcttgaacctgggaggtggaggttgcagtgagccgagatggcaccactgcactccagtctgggtgacagagcaagactccgtctcaaaaaaaaagtacctcgctttatggtccagcatatgatcaatttggtcaatgttccatgtgactttgaaaatatatgcaatttgcagttgttgggtagagttttctaatgttctaattaagtcatttaccttatttttcagattttttatatagttactatgtttggggtctacttatgctgttactgaaaaaagtatttcaaatctccattctaattgtagatgtgtctttcttgtggttgtcttactgttctttgctttatgcatgaggctctgttattgggtacatacaaacttagaatgattgtatcttcctggtaggttgaccctttttcattttgaaatgctcttcattatctctctagtgctgtttttttccttacatcttacttgtgatggtactattgcttcaccaggtagtgtttgcattaaatctcctttctccttcttttactgttaatctttctccagcctttcattttagatgtgtcttctaagcagcatataattgggtattgttttcacccagtgtgacagtctttgtctttttattaaaagattttttccatttatatttaatgaaattaatgatacatttgagtttatatctataatcttccctttttattacacttgttataagtttttattctccgctttcttgtctttgtttgaactgatttttcaatggaaaaatttaaacacaggcaaaagaagagaccatagtataatgaaacctcatgttttcatgatgcagctttcagcaattatcagcgtgcggccaatattgttttatgtccctctcctcaacccccctctacattctatattatcttaaagcaaatcccaggcattatataatcctgtctataaatatttcaatatgtttctctaaaagactcaatcataaccccaataccatgagcagctcccaaatttaaaatgtttcagtactatcatggaatatttagttgtgtagagttttctaacttgatgcatgtcttttattaattaattaattattgagatggaatctcactctgtcactcaggctggagtgcagtggcatgatcttggctcactgaagcctcctgcttccaggttcaagcagttctcctgcctcagcctcctgagtagctgggattacaggcacgtgccaccacgcccagctaatttttgtacttttagtagagacggggtttcactgtgttggccaggctggtctcgaactcctgacctcaggtgatccacctgcctcggcctcccaaagtgctgggattccaggcgtgagtcaccgcgcctggtcttgatgcatgtcttttacaattgatttgtctgaattggggtgtgaacagagtctacacactgtgtttggttcctgtgtcttaagcaatttttaatctaaagcagtttccccctctcccttttccttgacatttatttgtagaagaagaaacaagattgttctgtcgaacttcccactttcttctcttgccagtggcatctttggggagccgtttagctcgctccttcgtctctccaccctgtctcccatagactggcagttacatcctggaagtttggtcagactcaagtttgattatatttgttaacaagaattctttatcagtggtgctgtgtaactcctgcgttaccacagctggcggtacataatgtctggtgtgtcttgtgaagttaagattgttcagtaggtatggggtgattattccctgatgccatcaacttggtgattctatattcttttacccttcaagtaaccacactagcgaccacaacatacagccttgatttatcagcatatgatatacataatggttgtctcagctgtccccaggcaacgctaggaccttagaacatcacaataatatttatcccattttcaagcacttgtgtttatttattgatttttgaaatggggtctcactatactgcccaggctggactcaaactcctgggctcaagtgattctgccacctcagcctcccaagtagatgggattacaggcatgcccggcttttaaaattctatatttatattaaatgtcataaaactttttcattattgtcattgcttgttaatcacgtgtttgtgcaggaagccttgggaatatgacagacctgggcttctatcccacttctactgcggagtagctgtgtgattggtcctttgtgcctcagttttcctatctataaaatgggtgtaatggagttgtgaagattatgaggcttgatacctgtgaaatgcttaggatactgccaggcacacagtgaaaactcaataacagttagctgttgatggtaatgacaacacccctgcctcccatttgctcagccaagaacagagggtcctccctggctggtcactccctggcgcggggctgggtagggctgtggggagccactcactgcacagggaggatggtgtcccttttctttccaggtgtgcaggtgtgggttcctccctcccttcctccctccctccctccaggtgtgcaggtgctggctcctccctcccttcctccctccaggtgtgcaggtgtgggttccaccctcctcttctccctgcaggtgtgcaggtgtgggttcctccctcctcttctccctgcaggtgtgcaggtgtgggttcctccctcctcttctccctgcaggtgcgcaggtgtgggttcctccctcccttcctccctccaggtgtgcaggtgtgggttcctccctctcttcctccctcccagtgtgcaggtgtgggctcctccctcctcttctccctccaggtgtgcaggtgtgggttcctccctcctcttctccctccaggtgtgcaggtgtgggttcctccctcccttcctccctccaggtgtgcatgtgtgggttcctccctcccttcctccctccaggtgtgcacgtgtgggttcctccctcccttcctccctccaggtgcgcaggtgtgggttcctccctcccttcctccctccaggtgtgcaggtgtgggttcctccctcctcttctccctgcaggtgcgcaggtgtgggttcctccctcccttcctccctccaggtgtgcaggtgtgggttcctccctcccttcctccctccaggtgtgcaggtgtgggttcctccctcccttcctccctccaggtgtgcaggtgtgggttcctccctcctcttctccctgcaggtgcgcaggtgtgggttcctccctcccttcctccctccaggtgtgcaggtgctggctcctccctcccttcctccctccaggtgtgcacgtgtgggttcctccctcccttcctccctccagctgcgcagatgtgggttcctccctcccttcctccctccaggtgtgcaggtgtgggttcctccctcctcttctccctgcaggtgcgcaggtgtgggttcctccctccctccctccctcgaggtgtgcaagtgtggatttcttgcccttttctcccttgccttagcacttgagacccagagaatcacccagtgctcacagtgcctctccaggtctgactgctgcctcctgagtgctctttcaaggccatttcttcttgctctttcctctgagaatatggcagtgtcccctttggaatcatttgtttgcttttcacacttgaaatccagacctaactttagaatcatggagtcacacagcagaaaatacttgcggctggtcggtccgtgcagcccatagggtaggagcctgtgggagtgggcagggccctggccccggactcttccttcttggacctggcccctcgggtcgtcatcccctccctgggcagccctgtcttcataccttgacagtatctctgagggttgatggcttctcacctcaccatgcggcggattcctctaggggggtttagtaagtgacatcttcttttcaccgccccaagacccccattctctgtcacattattacccaggagcccatgtcccttccatcagaccctctccctttctgtctctctggcttcaaggggagcagctggggtggggaggaggagccaagagggtttcactccccgccgtgacagatgcacacacgtgtgcaccttggcctctaaagctctccccacccctacccaggggactcggaacaggaggtgatactgaccaccaagacccctaaggccacagtggggggcctgagcccctccaagggctacaccttgcagatcttcgagctcactggctctgggcgcttcctgctagctcggagggagtttgtgagtaagtccaccgtctgccagctgggtacccactcctccaggccgggtcccaccctcctctgggctggggtcccaccctcctccaggctgcgttccagccccaggggtgggtatgtgtgaagcagttctgggctgtgctaggggcaggttcaagtcccgactcaccagcaaggctgccttgcccctgacatctttgcatgcctcccaggctcctgggccctcagcacccacagatgcgcccttgaaggggtgtatgtgcagctgccccagtggaccaggccctccactcccaccctgatggctctttgtgtctccctgcagttgaggatctgaagagtagctccctggacaggagcagccagaggcccctcggctctggagccccggagcccaccccctcccacacggggagcccagaccctgagcaggcttctgagccccaagttgccttcacaccaagccaggatccgcgcactcctggtgggtcagagtggagagagagtaagtctccggggagggagtgacctttggtttcccacatttcccaccatgaggccaggaagttcttcctcgtgtctgaccacacggtctctgaccacgaggccaggaagttcttcctcgtgtctgaccacacggtctctgaccacgaggccgggaagttcttcctcgtgtctgaccacacggtctctgaccacgaggccgggaagttcttcctcgtgtctgaccacacggtctctgaccacgaggccgggaagttcttcctcgtgtctgaccacacggtctctgaccacgaggccgggaagttcttcctcgtgtctgaccacacggtctctggctttaacttaaagttgccatgttcccaggttcactcaagccaggccactgggagcaggtggtcccactacctctgacccctttgggaacctccagcctgggtctagggggtggtgagaggggtgggtcatgctcccccaggagtgggatcaggagcagagctggtccgggggccctggagggagggccctgcccagccggccccaggcgtggagaggtagagccacaccaggacagaagagaagccaggtaaggggtgggcacagacgggggcagtgcactgtgtctgcccataaggcccccgtaggcagggctgggcttccccatagaactgggagggcctggctttgtctcctccatcagactggggtcctcagaagcaggattctacctcccccgtcagacttggaactgaaggaagtgttctcctcagacttgggcatatcccctccagagggtcctcgggtccgctgctgtcctcccctcagggtgctgggctctgctgggtcccctggacttgggctcccccaggggagtgtccccacccatgcaggcctcagggcagctgggcctcttcggtcgccccacggggggctccaccgtgatggctgctggcctcgttcaggcatctccccgggggtctggccctggctctggggcccgcctcaccaggcactgctcctgcaaaaccccggggagcgccagaccggggatggcggctttgcctccacagcgccgcgctgcggtgctcacggcggctctgctggggctctttgtggtgcccaccctcccctccttgcctggtttgcacctggtgggcttctgggcctgatgtctgggcgggcagctgcatgcagccgtggagggcagaggtgcccgagcaccaggctgcctcacattagcggtggctcgatgtgcagccgtgccggtgtggggctgtctagtccggtgaggcctgagggccttggagtcctttcccctgaaacctggcccagcctgcctcactcttgtggctggagccccggggtaggtgatctgggggccttggaccagggatgggcctcacctagcacctgacccgctcccaccgccccagccggcccccagttccgctgcctgccccccgtgcctgctgacatggtcttcctggtggacgggtcctggagcattggccacagtcacttccagcaggtcaaggacttcctggccagtgtcatcgcaccctttgaaatcgggccggataaggtccaagtaggtgggtgctggcccggcccgcctcctgccccacccgggtgtggtccccacagctctgccagaggaggctgtgacctgtgggggtccccgtaccagccagggctctcaccttgtggggtgggacgcctgctccacatggggtgttctggggacccctccgtgtggaggccctggctctgcaagcgtcctctccctggggactggctactgtggccaggtgaccccacagaggcacgtgcagctctcaggtgtggccttgtgccaagctccctgggcatctcagcattggaaactcagcccgtggccatgcccctgctccccaggcctgactcagtacagcggggatgctcagactgagtgggacctgaactccctcagcaccaaggaacaggtgctggcagctgtgcgccgcctccgctacaagggggggaacacgttcacaggtacggcccaggcctgcccctccctctgtcctgagggcggacctccttctgccgccctcccagatcccgaaagcttgtgtgtaaatcgagctccaagtggtgtggacctgagccctgttcacacctttatagagggcagagtcacccccttgtttacctttgatgaaaacgagggcctgtgtccagcgcgtggctcctctgttccacattagcagctctggctgggtccacacccggcccagtctgggtgctcaccttgcaggtagggtctggctggggaacttggggcccttcaacaggtagaccctccctgctcccttgggctgctgcggggcctcctgataccccacaagggaaggagaggagcatctctgctgtccggttgctgccagccgagcaccaggaggggatgctggcagctgcctgtcactttattcctgctgctcccaaggccttgccctgacccacgtgctggggcagaacctgcagccggcggctggcctccgtccagaggcagccaaggtggtgattctggtgacggacggcaagtcccaggacgatgtgcacactgctgcccgtgtcctcaaggacctgggcgtgaacgtcttcgctgtgggtgagcaccatgcggctcccccggccctggagtctcaccgccgggtgggtttagggtcgcagcagggagcttgcattgggcacctggtccctgagccccagcttccacatctgcggcacggagctgcacgcagagccaggcaccgcctggcactcagaggcgatggcacaggcgggctgctcctttccaatcgcctggtgtttggtgccctccgtggaaccaccccaaccctccccctgtggcgtgaacttccctggtgagatattcactgagcagctccagctgccccctctggccaccatccctgtgcctggtgactcccgcctgctgtgccctggcaaggagcttcctggcatcctccagggcctgggactcacaggcgaatcaactctgtcctgtggggaggaaaccccagatttcgaggcaggagtcccaggagcacagacccttccttgatgcccccaacccctcgggagcgcctggcccagcatgtgggtggcaggtgggccgagtacagcccataggcctctttactcctgacccagtctccatggagacccccaccgcaggtggccccgtcgggtgaccccagtgcaggccaaccccacctccctcctcacgagcaggtgtgaagaacgccgatgaggctgagctgaggctcctggcgtccccgccgagggacatcaccgtccacagcgtgctggacttcctgcagctcggcgcgctggctggcctgctcagccgtctcatctgccagaggctccagggtgggagcccgcggcagggcccaggtgaggggcagggtcacccgcacaggctgcagcccccccggctgctttgggcaaagggttggggggacgctgtggctcccgtgtggtacctgaggccggctcctgtggctctgagggggtctgcagcacccccttacatctgtccacagaagggctggggagcagctttcctgtccctcctgtgagtggccaccagggggagcgtggacacagctgcccgtgcagtgaccacctgccccccactcccgctactccagcagcagcggctccagccctggacaccctccctgcccccaccagcctggtcctgagccaggtgacctcctccagcatccgcctgtcctggactccagccccccggcaccccctcaagtatctgatcgtttggcgagcctctagaggtggcacccccagggaggtgagggggccggtatacagggctccccgagccggtcctcagccgtagtgagatctgataagccaaagggagggcaggaataaaggcccacaaataactgggtccaggctgagaagggggtgtcgaggggctgacagcccagggactcactggggagctgcgtctgggaggcagcctgggatgagtgcattttagtggccgaggagggcagagcagggggcgttccgagggtgctggggttagggtcagactcagagcgccttctccctttgattgatcgatcgatggataattgtggtgggcctggcactgctctgtcgtaggtacagggagcccaggcctgtgggaagtggggcaccctgcgggccccagctgagctcacactccagctgacggagttcctgtcctgctccccatcccccggcaccccccttcctggctccgtccttgcccactctgttccaggtggtggtggagggacccgccgcctccacggagctgcacaacctggcctcccgcacagagtacctggtctccgtgttccccatctatgagggcggggttggcgaaggcctgcggggcctggtgaccacaggtaggtggggcagaggcagcggccaggttctgggtgggaggccccactcacggctgtcccttggagcctgacaccccagggcagcatagcgagcagctctggatcttaaccacccacagttggcaccatccccagcttgctgtgtgaccaaggccgagtcactgggcccctctgaccctgggtgttctcttctgaacaccagctataccgttggtgtcatcacctcaactgtaatcacagcccattatgctgcttgtccacagtgttcatggagctcccccctgcttggcctccagcacgtggcttagctcgctgggttcttggacccccagggactgccatgagcccgtctgtaatagccttgttgagatgtaatttacacaccatacaacctgcccatttaaagtgtacaactccagtggctttggtatattcagagctgtcacccatggccacagttcatgttagatcattttcatccccccagaggaaccctgcacccctaagcacccgcccccccagccaccccaagccaccttctgtctctggatgtgcctgtcccagacgtttcctgcaggtggaatcacacagtgcagacttttgtgtctgggtgtttcccaaagcccttttcaccccccggaggccacattcctcccatgacctcaaggcagatggccttagacaaaactgtggggtggccttgtgtccccagagctggagccacaaaccttggcccaaggtgaagcctgggaagtgccactttgaatcctgtgcacctgccaggcggtggccgtgcccacccactctggtgtgagggtgccccgtgcgtgggtgtgatctctgtgtgggctccttcctaaagtgtccctgcatggccccccagcacctctgcctccgccccgggcgctgaccctggccgcagtgacgcccagaaccgtccacctcacctggcagccctcggccggggccacccactacctggtgcgatgttctcctgcttcccccaagggtgaagaggaggagcgagaggtgagctgggccggggggtggcgggggaggcagaggagtggggcagagcgagtgggggctggcctgggacgtcatgtctctgcaggtgcaggtcgggcggcccgaggtgctgctggatggcctggaacctggcagggactatgaggtctcggtgcagagcctgcgaggccctgagggcagcgaggcccggggcatccgtgccaggacccgtgagtgctccaaccccggctgcctgcccacaggcgggtgccccatcttgttcctcagccttccatggcatgggagacctcaggccccctcggtcccagccactgcccacccttgcccctgccatggaggccgcgtgctggccttgaggctctgctgtgctttgcagccaccctggcccccccgagacacctgggcttctcagacgtgagccacgacgcggcacgagtgttctgggagggtgccccgaggcctgtgcgcctggtcagggtcacctatgtgtccagcgagggtggacactcggggcaggtgagagcagagccctccgggggcccgagtgtcttgagggaccacagggccctgtctggcaggcatggggtggagccaaccatcagataacacattcaaaaccacagcggccacgaggcacagcgggggcacctggtgtgggggcagatgtgggtgtggggtctggggggaaccaggctggggaggcccaccccagccgtcctgcagttctgttgccctcccatccctcaggacaagcccattttccccgtttctggggggtcgtggggtagtcctggctgcaggtgctgggcctgattctccaccccagcaagggctccaggcaccagctgggcctgccatgtcgccctcccacctgctgcagacagaggctcctgggaacgccacctcggccacgctggggcctctctcttcctccaccacctacactgtccgtgtcacctgcctctaccctgggggtggctcctctacgctgactggccgggtgaccaccagtgagtggggagaggctggggctgggggtccagcagggtttctgtgtccttctgccctgctagacagttcacatcaagtgttttgggagcctgccctgggtcagtgctgagccaggtggggatgggcacccggacgggtgtgatggatgggggtatagggtgctcctgggtgtggctgcccctcctctgaggtgcccaggctcaggggctacacccccagcctgtgtctccacttccttcagagaaagctcccagcccaagccagctgtccatgacggagctgccaggggatgcagtccagctggcgtgggtggccgcagccccgtctggcgtgcttgtctaccagatcacgtggacgcccctgggagaggggaaggctcacgaggtgggcaggggtgggtttgtccttccgaggggccccccgtgggcccctagtcctgaagccaaagtctagggctcagagccatatgtgcgcccaccctgtctcccagggatgcctcactgcccggccccccaacctgaggaccccactgcacccggtgacccctggggctctcctctccctagatctctgtcccagggaacctcggcacggccgtcctgcctggcctagggaggcacacagagtacgacgtcaccatcttggcctactacagggacggggcccgcagtgaccctgtgtccctccgctataccccctgtaggtgcccctccacttcccctctgctgggtgtggggcagggatggcccaggggatccctgactcacccgctgcacaggcccaggaccctagactcccagaactgctggctccagagccctgatcactgggcctggtcgttggagtctgcagcacttccttgagctcacacgggtataggtgttcccccagtggccgagtgcacaaaccacctagtgtcccgcagggcagcccaggcagcagccctggttgggggtatggtgagggccctggcaggtggcgtggtgtgggtgtggtggggtgcggtgtgggcagtggcaggggtgtggtgtggttgtgccaggggggtgatgcgggctgtggtaggggtgtggcatgatgtggtggaggcattacgcagagcagggtaggggctgggcagctggtcctctggccaccgggtgcctcctttctggaggggcctgagccccacacaacccatgctctcggccagccacggtgagcaggagcccaccctccaacctggccctggcctcggagacccccgacagcctgcaggtcagctggacgcccccgcttggccgcgtgctccattactggctcacctacgcccccgcctctggcttgggacccgagaaatccgtgagtcttggtagagcctgaggctgccccacctcgtggggcctcctggaaggggtatggccacactgtctgcgaagggtggcagctctgccatggcgggacgcagagggaggcagctgagccgcgtggacgagcaaagttgcccaggaagtggggaccaggcaccctcccttctcctaggtctctgtgccaggagccaggagccacgtgacactgcccgacctgcaggcagccacgaagtacagggtcctggtctcagctatctatgcagcaggcaggagtgaggctgtgtctgccacgggccagacaggtgagtgggcaccaagaccccagacccaggtagacccagccccagccgggccctagaccccagaccctgccagctccagactcatccaaccccagacccagccaaccccagacctagttgaccccaggggtcacaggcaggcaggggtcctgggtggctggagatgactggttccaggctggccccacctggattctccagggacaaggacgtggtcacacttgcctggggtcttccacggtgggagctgctgttgctggttttttgtctcttgctggttttcctggagaaccacaggtccagggcgagggctctgagaggcatccatcccaaccttccagcttccctctgggcttcccattgtggggtcttccagtcttggcttgcacgcccttggggacggggtcctcactgcctggacagcttccccggcgaggcagccttcccatgggaggggagagctgctcctcccatcaggagtgctccttcctgccttctctgcccatgaagggttccgagcacctgccatggagcaaacccaagtccctgggcccccaggacacgcatgcccccagcctgcccgcacaccaggcatctccctggcccccaggacacgcgtgcccccagcctgcccgcacaccaggcatctccctggaccccaggacacgcgtgcccccagcctgcccgcacaccaggcatctccctggcccccaggacatgcgtgtccccagcctctcctcacaccaggcatctccctggccccaggacacgtgtgtccccagcctgcccgcacaccaggcatctccctggcccccaggacacgtgtgcccccagcctgcccacacaccaggcatctccctggccctgccagttcagggcactcctgggtgaccagtaccctcgaagggtatcacacccagtgagatgcctggtacgacccggggcccactgggctgtcttgggggcagctgcttcactcagtgagatccagaggggcagggaccatccctgttcccttccttttctgggaggcgtggggaccacaggccttgtgggtggcagatgggacatagcacagtcccacctatacagatggagcacaggctggggcatcgtccatgaagtggcccctccccagcggtctgtcaggcgttggaggctgggccgctcccactcacactgaccctgtctcctctcagcagcctgcccagccctccgccctgacggctccctcccaggtgggtcctgcatgccctcccctgcctgcccacccacagtctctcgggctcttcctgggcgtgggggccaagggtgtcgtgacctgggacccagtggtggtgcagttggaggatgtttgggcgggtttgtgcctccacagacgtccctgtggctggctgggcggtggttattcctgcttctcactgagggagccgaaggttatgtaaggtcagggccaggaaccggcagagcccaggcagcgctgggggcgctgggtcctttccagccccattccagggtctctgctgactggagctgggggtttcaagtgctgagcccggggttctcattcgagttgcctgagagtgaggccctccccagagaggggctgagaggtggagatggtgggaaggcagggactgcctacttgaaacaggccttggaaggggctgcggcctctgccgcctcctgcccggtgcctgctggcagcgctgataagctgcagtgtgaatgggatttcgcccttcactttgtaccaattagtgctggaaaggagctggggcttcgagggtggtggctggcacctgcggctctgcgcggtggggctcgccagggaatggggtcatcgcaggcccccaggcagggtggatggagcgagctggccacgctgtgtgccagcaaaggggaactcactgacagagtcttcctcagagggaaaacgaccctgggcgggcgggggacgcggtgcagtgggcttgctggggggcaggggcgagaggtgggagttggggctcatgatcgggggctgggcgtccaccttgtccatctctgggtctccgaagctgggcatttggcccagtgatttaccatggtggcctggggagcggcccctcccagtgtgttggattcccctggggaggggtggggggcgatgcccagcccagggcctgaagcagacccctgcccaccccccagcccctgtgctgacttcccacccacgccgctccgtcacccctccctcccaccgcactgcagcccctgggtccctcttgagtccccgctcctgccccttcctccctcccctgccatctctgagggtccctcggtgccccttcccccaccatcttccccagggtttgacctgatggtggccttcagcctggtggaaaaggcttatgcgtccatccggggcgtggccatggagccctctgccttcggtgggaccccgaccttcacgctcttcaaggacgcccagctgacaagacgggtcaggtgtgagggcaagggctggggtggagctggaagcccaggctggggccgctgaagattaggaggacatggtgggggggcgggcatgggccggagacctcctggaggctgtgggacagggcagcgctgctatgtcagcaaacggctgactcaccccagtactcacacttcagaaattcacattttacaaattaataaaatctccatgggcagagtgaggccagccccttggcatattttggcaaccaagtatggatctatttcccatgtgagctgagggctgatcaaacacgcaggagccccagactgacctgaggcgatgggccaaactgccagtagccggatttagaggaagcgatcactcaaatagctttgcatgagatttgggacaattcctgatatctcatgaccaccctcccttatttacagagaacagttgttcatcgtgaccctgaactgtgatataagctgcatgacagtttaagttaaaatggttgatgataaaggcggaagccaggtgtggtggtgcacacctgcagtcccagctactggggaggctaagtccaggaggttgaaaccagcctggacaatgcagcaagaccccatctctacaaataaacaaacaaacttagctgggtgcggtggcaggcacctgtattcccagctactcgggaggctgaggtgggagcatgtctgtctcaggagacggaggctgcagtgagccaggattgtgccactgtagtccagcctgggcaccagagcaatactccgtcccttaaaaaaaaaaaaaaaaaaaaagaagttacaaaggagagttatattctgtaacagagattttaaaattatagaaatatatatatttaaaagctcacctagcactgttggggcttaggaatgtctctcccagcctgttttgtccccacacagccgccggcccatgtgctatgctcggccctggccccctggtcaccacggtgtcttcgtggctgaactcgatgactgttccccggcttccctcaccatcctctccctccccccagtcttgctgcacatgccccctgtgctccgcccccatggcagtttctcttcagggtggtatagttgccctctgccctcctctctgggcagcaggctgcagagccctcttcctccatggcctcaggtggtgtagacgccccccgcccccctctcctcttcctcggtggcctcaggtgcacgtactgagctgggtgttcttacgggtgggtgaggtgggagctctgatcgcctgcagcccgaggcagcttcaaggcctcctgggtgcctccccaacctctctgctctcaagcaaaccctcctgggaccaggcagcctccacagggtggctgtttccatgagtccctgttctcaaatgagggctcctcccagccttgtggcatgagcaggcacttcccatgcctgtttgcccttccagagctcacagcctgagaagtgggggcagatggttctccaggtgcggccacccagggtggacccccgtgagggttgccacaccaaaagaggagggctcctgctgtgtggggtcgggaggctcctgaggtggcatcacaggtgcccaggccccagaccagtctgctctcgggatggcaggaaggtggctgggcatcctaagagtgaatggaagacagataggaggctacggccattgggaccccaattctatcaggggcccgagaccctgctccctggaccccgattctatcagaggcccgagaccctgcttcctggaacattaggggaccaagaccctggtcccacccctcagggtgtctggctgggcactggccaggacccactgggcggtgccaatgagtgtgagtcgggggagctgctcccgagagcagagctgcctttcagtagtgatcctgagactcccctgtggggtgtcctgggccggcacccctcaccctcacgggccccgggagcacgggtcttggtgagcccttgctggggtcatctgggatgtgacctgggatggccctgggcctggcgcctccaagtacttctgttgaatcctcctcattcaatgggagggattctgtcctttatgtaccccatgttactcatggggaaaccaaggcagggaggccccagtgtggcctcatagaccctcagctctgtggaaccaccagtctgggctcctagggagccagcggcctccacgctcagtctacagctgggaagggtgtgcgggtgcaggggtccaccatgaccctcagagcagcctcagggactggcactggggctggggctgggcgagcggatcgttctgccaggtttggctgcccttgggtctgctcatgtgcctctccctcccccaacccccacagtgacgtctacccagcccccctacctccagagcacaccatcgtcttccttgtgcgcctacttcccgagacaccccgtgaggccttcgcgctgtggcagatgacagccgaggacttccagcccctccttggggttctgctggatggtgacgtgggccccgcgtcgcccccagcagtcaggaggagtaggggcagggaggccccagagccctgggaggccttcagaggaagtccagcctccaggccaggccctcagcaccctctgggtgggaggcaggtgtcccgggcagggggctgtgggccacattgagggtcacctccagcttggcaccctcagggctgctcctgtcctgtcgtgggggccgccctgctcaaggtataggcccggctggttgcagcccgttctcacctgctccaccccttccctggcagccgggaagaagtccctgacctacttccaccgtgaccccagggctgccttgcaggaggccaccttcgacccgcaggaagtgaggaagattttcttcgggagcttccacaaggtcctggtgcagctcgcgcccctctcccccgttcccccagctctggggcagcccagccccacagggacctgccggatgccaactcctctccctaggagagcaggaccttccttgggagggaacattgacctggggctctgttcctctaccccagctcttccatcttaattggagttgaagagcctcccagcccatctctttgggacccacagaccccgggaggctcctgcagcaggtgccatttggtccattttacagaggggaagccgaggcccagcaagggggggttctcccagggtcccccgaaacctgaggtgaggtcaggttcctgaccccaggtcccagggatgggtgttactccccagccctggcctggccttgggggctcaggtgggcaccggccccgcctgggctgtggagaacctcccgtgccgtctcacaggtgcacgtggctgtgggccgctccaaggtcaggctctatgtggactgccggaaggtggctgagcggccccttggggagatgggcagcccacccgctgcgggcttcgtcacgctggggaggctggccaaggccaggggcccccggagcagttcggccgcggtgagttgggccctgcccacctgctgggccacgctggtgggggctggcagcctctctgagccccggggctgagccggctcccctgcgttgcagtttcagctccagatgctgcagatcgtgtgcagtgacacctgggccgatgaggaccggtgctgtgagctccctgcctcggtgtgccccgtcccttgcccctgttccacgaagcaagttagggcaagtgcccactgagggtcacagtgcctggggtcagttggcctgtccagattgtcaccgtgctgggagagatcagggaaggctttcagaggaggcagcctcagggccagtggatgagcccagaggggctggacagagagtcctggaggccctggggcaggctgggaacccctggctgcactcagggccatgcccacctctgtgggcccagccaggtgcagatgagtcaggaaggggcacgtggccaggccagagagcccctctcatcctcagtgactcctctgtataccctgtgctgggcttggccatactgggggcccagacgggagagagggagggagaaggcaccattctgtcctggggctcatgcggacagcgtggcagggtgggaacccagggccggctggacacacaggggctcagtggcctgagtcctggacctgcccactatgcacttgggcccctgaccttcgcccctgcctcccaggtgcgggtctggaagtctccctggagcccaggtgtcattggctaatctcagctctagggtcaggcaagagccagggagagggtctctctaatgggcagggtctctcttcttccagagggatggagagacctgccccgccttcgtgtctgcctgttcctgttcctcagagacccctgggcccccaggacctcaaggacccccagtgagtccagtggcgtctccttggggtgaccagggaacactggccaatgtattgctgccactggtggatgtgtaacccaggccctcccgccccggtccatgcccccgtcctgccgcagagttgggatgtatttcatgagcctcttccctgctgtgcccgccctgggccaggagacagaggcctggcccagccccttccttcccccaggctgggcctcccctgcgaaccctcctctagtgcggaatccagtgattctcactgtcagggttgggaaggggggccaggcgcagctccttccttcccccaggctgggcctcccccacgaaccctcctctggcgtggaatccagtgtttctgaagtgtgaggcttgggacggatccaggcgcaactgggatccagaactgtgctgtggccacagggtgtgacgtgggccggctgtgagtcacagccacttggacggccactgtcctgggtgctggcagcctagctcacctgcagcaggagctatacgggccctctacccaggcctcagggaggcggccctccaggcctggacccctgccatggggtgggtcctgagaggtccttggacctgccatggctgcagctgcctctgctcaccccaaggttccagcgccccacaggtgacggctggggcttccagagctggctctgggaccggtcaagcacactctctctgagctcagtgtccacagccttgtctactcagggggccggggtttgaacccagaactgcctgactatgagagggaaggatgggctagtgcgtccttgccctggaaaccccttctcttccccttgacagcagtggacagtctggggctgggtggggcatggggctcagggtgggccaggcatggggctcaggggctggtctttgctcctctaccttggttgggtagttctgggggcttagccctgtttgtgcctctgcagggcctccctgggaggaatggcaccccaggagagcagggcttcccagggcccagggtaagttttggggagccctgggaggtgaggggcctggatcgtacctaccagaagagaacacccctcccagtgcattcctgagagtgcagggagctgcacgcagcttccctaggcagggtggggtctccccaagctgcagacaggcagggaccccagcaccccaggagtccagggggtttaggctggcctcccccatgtgcctgcagggcgcctggcccaggcctggttatggtgcaagtccccttttcacccagatagggaggatgaaccccatggcccagcaggggaatctgaggcttggggaggtgaggccacctgtcctattggccctgaaggccgcccttgatttccatggggcaggcatgagccagatgccttctgtgtgccgggctgggcccaggagcttaggcccacagagtattttcagatgtctctaggctcagcgcatgcgcggcgtgcagggaggtgtttcgggggcggaggttctggttctgcggagagggatgttgaagacagcgcgcccagcgatggcagcagccccccaccccaggcgccaaagggccgccctccaggctcgattctaaacatttacctaaaccacggtactgcacaagcgtgacacagatgccgaaggcgtggtcggcatgcagcaaggccgccctcctcccgaccccgacacccacctctcccccggcagccttccagcgagttccacatccccgtgagcaaagacgtgcgcctggctctggcggggctgtccttttgcacctgcgctgccatattccctttgtctgcggttgtgctggagcctcagagcacatctcaggcacagagtccctaggacagtcgctgggtggaagggcacacgcccctgtgctttggggtggatgtccccacactggcccggcagagccgtgcgaggcgctcccccgcgacgagccagcggtgacctcccacccccatcttgcattcctggctgctttgggagccgcgtctgatagatgaaaatgcatttctcttccaagcagcgtgaatgccctttgaaagttgccaatattttcttgctggagatgtcctctgacttcttctccaccgttcttttttcttaataatttgtgggcacgctttttacttgctggaaccagccctgtgtctgtgatgtgagttttgactgcgtttggcattttcttgtcttttgaccttgtttgcgacgtgcgtttccatacagattttaaaataacttttacgtagtccatgttactgctctgttctatggcttctgaattttgtatcctgttttaaaagatctttcttattccgagagtagaaatcgcgcctcctcctggttcctcctggtgcttccaggcacttttcgacactcccaggtggattcgtctagagctgattttgttacagcactggggaggacagaggacggggaggactccagcttcacctcttcacagaccacccctggtcgcctgagtcgttcattacacagccagccccttgcagaagttgaacgccctggctctcgtgctgtcctaaggcccctgtgtattttggggtttttcagatgctccagtctgtcccgttgatgtgtctgttgttcacaggcgagggctgtgctgcttaaattattacagatttctttaagatgtcgatgccagatgggctggtcctcttttgtattattcccccagaattttcctggctctctttgcttatttcattgttcagtgaactgtagaatcgacttatccgtttaacctaaacaattcagttggtgtttttactggaactgcattcgctttatagatatactcgggaacagatgatgtcttcatgatgttgaatcttctcatccaaaaacacagccatcctgccttttgttcacagggcctgttgtggccctcagtacagtgtggggatggtctcttcctacagacccactcggttctccttcatccctacgtatgtcctcttttttgttgctattataagtgaggtgttttctctcattacagcttctacctcattattttcacactggccgtgaccgctgtgtatgacttttgtacccagttttctttctcaattatcttctttgtggttttcttggattttccaggtttacagtgacatcacctgcaaataaacacttcaccttcggcttttcagtcttgatcactcaaatttctttttcttgtctaatggtgttggtgaatactccagaattttgtcagagaacagtggcagtagcagatactctcattttcttcttggcctaacagaagtgcttctagcatttgaccattaaagtgctgtcctggaagcggagacaggtgcattttgtcatgtggtagtgaagtccatccactcttcttttattagatttaaaacaccaagaatgcacattaaacaagctctagtgctgttatggacataatgaaatgactgtgcgtcttggagctattaattgtaggatatccctaaatactggatgattgctgcatccgtcgaaaatctgacgtggtcgctgaattctcgttatccatgccatgtgctgcagagctcagcttgctgacattttgttttggatttcgcactgatgcttctaaataagactgtcacagttttctttatagtgtttggaacctcagtttgctttgttcaaaagataatttgagtttaaatagcagcagtgtcctctgccccacagggttggatttcccataaaacctgagtctagtgttttggggtccagggcttaagaaagttttctgtctcttccatacagttggcctgtgggggtctctggcttttcctcggtgatttctgcagcgccccccacaccccgttagaacccagagttgggcaggggagggctgggggtgaggttggttggaactggcttcacaggcttggctctgccattctctagctctgcagacccctgctgtgggttctcccagaccctcccagggtgagcagtgagggtgctggggctgcccctgctcctttaatggaggtgtctccatgtcggtctgggtctgaatgcccagagggctgggagggctggctgtgacccagaggggccacaggaggggtggcaagcgtgaccttgtcaggccctacccgctgcctgtgtctccagggagagcccgggccacccggacagatgggaccagaaggtcctggaggccagcagggctcgccggggacccagggccgtgcagtccaggggcctgtggtaggtgtcactccttccctgccctcctgccctgtgccccctccgcttcgctgtccagcccatcttccccctccagggtccaccaggggtcaaaggagagaagggagaccatgggcttccaggcttgcaggtagtgtggctggggccagggggccacaggggttggtgggggtgggggaaggacagggatggagatggggagtgcctggggggcacaggggttgggggtgaggcctcacaggcagggccacctctggatgtgaccctggcccctgcctggccggcccctctgttctctcccagggccaccccggccaccagggcatccccgggagagttggcctccagggaccaaaggtgccggctctgggcttggagggttctgtcagggtggtagagactggcctggggacggggggccttggagatggaggctgtggggtagggagggggaggtgctttctcctgggctcctgcctcacctgctgcaccacccccttcagcctgtggcctggccagaaggctggagagctccagcccaccccaggcaggagctgtcactgaggcagggtgggtgggggagtggctgggtaggagcctggcagcctcagctgcctcacctttgctgcttgggttacagggtgtgttgggtgctgctggggggctgtcaccatgggagggctgggtacaggtacaaaccccacccagcttgcgccttcctttgccatcagggaatgagaggcctggagggaactgctggcctgcctggacccctggccccagggtaggcaccgacctcccatgaccccgacccccacccagggttcctgtgttccaggggtcaggcagaggccagtctgaacaccagctgccacccctaggttaccccaggaagtgcctgggagggcctcacttctgctggaactttctgcagggccctgtgggtgggtgagcgtctgcccaggagcactgcatgctcccaagtgagggctctgtgctgaggactcagttcctgggagaccttggaggggggtctcctggcatcggcctcgggctgagtgctgggcaggccaggttgcctccctgcaagcgccactttaggggaagcccaacttgcagtcacactggagcagctggcacagctggggacgtttagagcagcgtgctgacagtgctggaggaggggtgcagggcatggggagccagggcctggaggcaggggaggcaccacctgccggaggaatggcctgaaggaggctggggccagccaggcatccaccgcccttgtcaggtcagggggcccctgggacatctgggaaccagggctgaagtgggagcagatttgctgggggcccaagccaaaccctgacttctgtgtctatgcaggggttccagggcatggcaggggccaggggcactagtggagagcgaggacctccagggaccgtggggcccacagtaagtgcatttccaacacccaccagccaaccaaaggtgggggagcgaagggtgcaagccccacatgcaaccactcagggacttcctactgacagctcagggacttcctactgaccacctagggacttcctgttgacagcccacagacttcctgttgacagcttcctgtttactggcctggaacttcctgttgacccccctagggacttcctggtgacagcccatggacttcctgttgaccacccaaggacttcctgtcgctctcccagggacttcctgttgactgccagggacttcctgtttaccactcagggactttctgttgactgcccagggacttgtgtttaccactcagggacttcctgttgacggcccggggacttcctgttgaccgctcagagacttcctgttggccactcagggacttcctattgaccacccagggacttcctattgaccactcagggacttcccatttgttgttggaggcctgttctgagctgggagcttggtgttggtgctagtacaagagagtgtagctaagggctggttctgcacctctcccaaccccacccaggacagacgtggtggaggggaggtggtggggcggcaggctccatggagggtagggggacagacgtgggagatgggggtgtagtgtcccctgggggatgccttggccttcagcagctccatgggcccccccttaggtgggctccaggttcaccaaggagctggggaggtggaagaagacagaagacggcagggaagtgccagcacaggcctgacccgggcccggggcccgggaggggtctgttctctgggcagtgtcccacacccgccatctcccctagcacaaaatctacagccagaggcaagtcctttgtggcacaagttccagccccactcaggactctgctgcagaaccgagcctctcacatgcctgctctcgggtgcaggcgaggaccacaggctcctaggatctgggaatttgggatggggctttcacaccgccactgtggctatcaggctgcctgagtgaggatccacctcagggccatctcacacttgtcacgtgtggtctcaggccatctctgctgacttcttttctcttcccctcctcatcagggactgccagggcccaaaggggaacgaggagagaaggtaagtgaggctgagatctttggctcacttgggatctcctgggaaggcacctgccacacgggtcccaaagctgcaccaccttcccttccagggcgagccgcagtcccttgccaccctctaccagcttgtgagccaggcctgtgagtctgccattcagagtgagtgaggccagcagccctgcacctgtgcctaccacacctgtctgtcctcacactggccaggccgagggaggccgccttcacccatcgttagcacacctgggccaggtgtcctggcgtggcctgcacaggcctcgcatccccgggtccccactgtgtcctgctgacacccctcctccccacagcacacgtgtcaaagttcgactccttccacgagaacaccaggccccccatgcccatcttggagcagaagctggagccgggcactgagcccctggggtcccctggcacccgcagcaaggccctggttcctggagaatgggggcgtggtggccgccaccttgagggcagaggtactgggctcctggctcttggggagggagttgtggccggtgggggcgccggttgtcccctggtcctggggctggggcttcaatctgtgtcagcacagcagctcctgctggagatgccactgtccagcctctggggtgctggggtgaggacacggggcttccctgagcccacacaaagccagtcatggcaaagaggtcagcctcggcctggccttccagggccctcaagatgacctcttccccagtcttcaggaaacatgagctgcctgcttagggccacacaggagagcccagcctacctcccatccttcctcccgccctcccgccctcctgtcctccttgtcctccccactcccgccctcttatcctcctggctgctgcttcctccgcctctccccacccagcgcacagtcgcaggctcccgtgaccttgttggtgctcctcctcctctgaggcagcagcggtgggtcatgacttggacgctgagatggaggagaggctgattcggggagctggagctggagaggggcgtccacggggagaacagacgggggatgacccagccagacgaggactgagttctgcactggccggggcagcagcgggggcatctctgctctgttcgggcatcggctgaatcccacccctcatcccacagacgtctcaggaaactgggggcaacctggggggagccccgtgggctgtgggaacccctgcccccggcttggaagctgcccacagtggcctggttgcagcctggcagatgaggggtacatcactactcagaataaacggccccctctgcacccacctgtctagatgagggtgacaggcactatcacagggcccccacctgacgccttcccacctggccatgcccccccagaactgtcatggagcccaggaggcgcctgtgtggagcacggggacctggcacgctgctgcccctagatctcagactcccatctaaggaccagacctgctgcctgtgcccagggaggggccctgacaccctctgtccccgtcagaacagggccccaagccactgcattgctccgtcctcacatgccctccctttcctcgcaggggagcctggagctgttggtcagatgggcagccctgggcagcagggggctagcacccagggcctctgggagtgacaggtgagcccctgctgcctgcatctatctgccaaggctgagggcatccaggaaggaggagctcctgaggggccaacgggtggggcctcatgctgtccagggtggggtgctgggagcacaaggcccagcagaggcaggcgaggtggccctggggaaagtagggtcaactatggaccccgtaggggcaacaggaatgtggggtcacagggtgtggggtcacagggcgtggggtcacaggacgtggggttccggagatggattggcgtgctgggagtctgctgcacctcgtgggatgcagagttgcgtgctggggcggaggaggccctgaccagggttagcgcagcagggagagtggagctcaggtgtttgctcagtgggcacctggtccaagtgtgggaaagctcacaggagtcccaggaggggcctgtgaggccctgggtatgtcgatgagagaggcagggtgggggccatagtagcaccaggtaacctctgccttcctcaggaagcgctgggcaggcggaccctgtgtgcaaacttagctgaggggctggtcccagcagcaggtgtggggacagggtcccaggagcaggtggtgggtacagcacaactccggcctcaagtagcttcaggggccagagcgtggcgcagggtgtgtgacctggggcccatgaggggccggcacctttgagctaggggactcggcaggggctaggagggctgaggagcacaggcaggagacccaggggctcctggtaaggctggggcaagagggcagctgcctgagatgcccaagaatcaggtcagagcccagggctaagaacaagcagccttgcttctcctccacagacccgtcagagaatgaccccacccacggccctgcccgcaatcctgcccacttacggccctgcccatggctctgcccactcacggccctgctggacgcagtgtgcagagacccaggatgcgggctctcagggtggccacagtgccaggcgctggccctgagccggtgtccagctgtcttcggcctctcacatctgtcctcccttctctcctgccaggacattttctgcactgccccgaggaacgctgagccttcctccctgggtttgtctggacaccgagagcgaccacatcctggagaagccaggagaaaagctcaggaagagcctgcaggtggaaggagagggaagcagcggcctcggccaaggcccaccccatactcttggctctgtagcatttccaagttcagataaacccctgagtgctcacccagccaagcgaggcgggagtcatttcctgggagagtgtcccccaccctggctctgtgcaccccaccttgaggccctgcagcttcagccgcagtggggaaggggaggggctgggctgatggcgaatcgggttcaggagggcagcagtgccctgtggccgtctcagtagctctaaaacaggctcaacaacatgccccgcccctttctctgggcctcatctaagcctggccagggccctgtgggcccgcctctctctgcgcctcacgcaggcaacagatggttccactgctggcccaccagtcacctgcacgatggctcctccctcagaacagcactcccaccccggccccagcaccttcacatctgggcacaggcaggtccctgcctgcctcatcgtcccctctgtccccagcccaagaaggagttcagatcctgtgtgtgaatggccacccctcacccacccagccctgtgctgagttccttgtgcagggacattgctttgagacttggcaccatcagcccctggtccttagggtctcagagcaaggtcatccctcagcaggcttctggcctgtgcgctcctcagcacctctgcccaggtctctcccaaccatcacagacgctgtgtgagcctggacttcctgccttatccccactgtggcccaaacagcatgggggcaagctcagaacacacacctgggcttctgggccttgtggcccgtgggggtgatgtgggaacttctacttcctttccaaacaaatattcagtaactagtccactgttaccacttaggcagctaagcaagaaaggtgccagaaatgaagagggaagccatatcattgaggagagaatgaaaagtattaaaaaggaacaaagagagacccttgatattgacagaaggaaaacccaccaagatcaccagtgcagcattgcgtgcaccaaagcataccccaaagaggtgagcgcaaaacagcttcagggcaaacacttcatctatgattcaactgttccaggaactgaccagacctggagaccaaatagagagtcataggcagggtcagcaggatgggagagagcgcctgcacccacaggagccacagccctgactgaggccaggaagcagccccaaatgccagctcccactgcagcatgagaacagaaacagaccactgaaaattcccaaagtctgtggacaaatcagacgtcgaagaagtcacgtggcatcgagacagattttgcactgagggacaaggagagcatgtggccaaagtaggtgcaggtaaagcagcatctggggcagagttatagccttcagtgcaggtatcagacacagttgttgagagcagcagcccaagccagcccctccgtcctgcagggaggacacctaggtcacttggcttctgttggggagctgagttgcttcagattgtgtgaccagcaaaacagcttggttgctctcacttggtttctccagggcggggaattacatgtccccagctgaactgagaaggctctttgagcagtggagtgagcaggctttgtcatgaggcaggagtggggctagaatcaagcccagagcccacagggcatccagagccttccaaaggagcccctctcctggggctctccaatttgatgaagggactgggcactgggtggctgagaccacattggcagccaggaggaggcagcctggccggggggaaccagggtggctctaatccccaccaccccctcagctgccctacccccgccacgctggtgtgacaccagtgatgctcagcctcaaaaggggagtccggctgtcttcgggaaactgactttatgctggaggccaattaaaatggcacagcaaaggcagcggccagctggtgcccaggcagcttagggactggtccctgaggccccacccgccccagcctgtgcagtggagctgagtacgaatcaaaggtgaggatggcaagggagctgagagcagcctccggatgcaccaaaccggcctggctcctgtttgcaggaaggcagcctccccgagacccagccgacctgcacgtctcccatcagccccgactccaccgcatccctctgggtccttttaggagcccccagggactgagccggggctcacgctcctggccagagcgctgggtttctggcaatgcctcccctcctgcctttacggccacagctctcccctccagaggcccctctgtagtgggcctcggtcccctctccacccccagaggcagcacagcttcagccctacgcagtgtgggggctccgggaggaaatgcagggaggtgcttggtcttggcccagagctcatggccttaggtgctgcccccagtcacccccgtgcccatgcagccggggatgttcagctcaggccagccaccgaggtggtgtgacgcaaggctgatctgacgctcagctcaggccgctggggtcatgggggttgtgggaaggtcatggaatcacggggctcacgctggggtcacagggtggtgtggctgtgtggactgtaaggggcgtgcagccatgcgtatctgacctgccctccctaggtctgcaggcagtgccgagtggctctgcctgaggccccaagagcgaccttggaagctccaggccttcacagcccctctgagagccacctgcaaggtggggagctgggaagaacggctcagtgatgagctcagagggaggggtgggcacagcgcccaggaaggcgggtgcgtgcaggcctgggaggaatgtgtagcaggaggcagggggtgctgtgcccgcaggaccagcaggtgaggcgtgtccacccacagaggatggctctggcccaggcagtgtcagaaatggaagctgaggaaacccaaccccagctgtagaggagcctgccccgatgccatctgcacctggggggcgacgtatggctgccagcctcttcatctaccaaggaccagggcagtggggacgggagagctgggacacgtggactcacaccagggcagatggtgggggaagccagtgtctgtagattcagtgcatttcttggggaagggcgtggaacatttggacttgagccccagcacagagacgatgtcataatacagccccccatcgtgatctgatggtaagtacagaactccttgcccagtggagaaacactctcctctcatgtgtggaatatccacacactaaccatgaactgggccataagaaaccttacattccaaaggatcctgctgttcagaactcactcactcactgatgaaactggaaaaacaaccaatgataacaagctaaagaatgcctctagaagctaaaagacacacccatgactccacagtaattcatgggttaaagagaaaaaaggaaacgtgaagatacttgtaaccaaataatgatggatgcagcgccacgtcagaatctctgtgctgcagctgcagtggtacctagagggcaatttatagctgtaaatacagtgctttgttttgttttcttgttttttgagacaaggtcttgctctgtcacccaggctggagtacagtggcatgatctcggctcaatgcaacctctgtgccaccctgggctcaagtggtcctcctgctccggtcttctgagtagcaggaaccacaggcgtgcgccaccacgcttggctaatgttttttgtatttttttaaatagagacagggtgttgccgtgttacccaggctggtcttgaacttctgagctcaaacgatccaccctccttggcctcccaaagtggtgggattacaggtgtgagtcacctcaccggcccttaaacacagtttttagggaagattccaactcaaacaattttaaatagtagaaaataaaccctgaagcagtgtgcattcattagtactgtgtttgcctgtatttaattaaaacctgattgccattggcttccctaaatcagtttttgccatcacacgtaaagtcctgtgggcaggaatggacattgagggaatcctgggctgtttggccgtccttggcatgtagctgcccttcatcagaagatggcagatcccagcccttcatcacaagatagcggatccctgcccttcatcacaagatggcggatcccagcccttcatcacaagatggcagatcccagcccttcatcacaagatggcagatcccagcctgtttggccgtccttggcatgtagctgcccttcatcacaggatggcggatctcagccctttatcacaagatggcagaccccaggctgtttggccatccttggcatgtagctgcccttcatcagaaggtggcagatcccagcccttcatcacaagatagcggatccccacccttcatcacaagatggcggatcccagcccttcatcacaagatggcggatccccacccttcaccacaagatggcggatcccagcccttcaccacaagatggcggatcccagcccttcaccacaagatggcggatcccagcccttcaccacaagatggcggatcccagcctgtttggctgtccttggcatgtagctgcccttcatcacaagatgactgctgctgctccaggagctacacctcacttggcggaaggggcgggagtcctctgggtgaagagcaccagtgttaacaggagtcccacttggagacttctgcttgtacctaaggacaaagactgcaactctccttgtccagaaaacagacgttttagctgaacacgttaccacctcccacagagtgactaaacgcgccgtgtagggctcgatgtggcttcaagtaacaataataacaggataagagtggctctcgcagtgtggaagtgacattctcagaggcacggggaggcctctttccctcacctggctctgcatcctccacacaggacactgcccttgtttccactgttgggtcatattccaacaacaggaagaagaggagggaggagaaaggctggcccggaatcgggtcacattccaacaacaggaagaagaggagggagaagggcaggctcggaaccttgaagggcacattccaaaggtgtccttgccactgtcagctacatccctgtggccagacgtcggtctcacggccaagctgagctgcaagagtagaaccttttctggctccttcctgaggcaagaggggaaagggagagtggggccagccctgggccagccacggggtggggaaggtggcccccacgtcccggagggctcagtgaagtgcacctggccagagaaacgagagggccaccacagtgctggggcagagaggacaaaaccatggatgaagacaaggctgaaaaccagagccctctgacccattttacgccaacagatctgcaggcccaggtgaaatgggcgttcagacatccgcatttccagaagagtccccacagactcctggaaacaagatggccactaacagaggctcctgcctggtgagacgccaggactggggagggagcccgacaaatccaggatctgaacacagaaacggagaaaccctggggacgactcaggccaccctgtgtgtgcacgtgtgtgcgtgtgtctgcgtgcatgtgtgtgcgtgtctgcatgcatgtgtgtgcgtgtgtgtgcatgcacgtatctgcgtgtgtgcgtgtctgcatgcacgtgtgtgcgtgcgtgtgcgtgcacgtttgtgtgcgtgtctgcgtgcactgtgcacgtgtgtgcgtgtgcatgcacgcgtgtgtgacagtagcccacaagaaaccattacatgacaatggactgtctcctccccaaatccgtacacacacacacgaggcatgcatttgcaaacacacacccatacacacacgtactcacacatttgtgcatgcacagcgctgttatccatgttgaggggacgtattcacaagggaaggtggggtatctgagatcaaaagcattgggagagacaaaccggagaatctgtaccaggcagagaagaattcatgtttgttctctttgatctattaattttttaaaattgtaatctcttaaagaggcaaggagggatatcggtaacatgacgccagaattataggtataaaggaaaaccaactaggaatatgatgtgtataaaacataaaaagagaaatgttaaaagcggagctgtaagatcaggtctgagacgtctcccgggaggctttgggaaaagataaaaaggaaacagaaaatgtaagtgttagcacccacaccatgggggctctacgaggaaagaaacagcaagaggagggggaaaggttgaaataactgggttttctgaagatttgtgcattagagaaagatttaagatctcagattaaaagggcctagaacgtcaaatggaataaatttttaaatgtacccttaggttcctcaatgccatatataatgcagtacataatgatgacggtgaaaaacagtcttttaaaaatcttcagtacatatcctaaaattggaacgatacagagaagattagcatagccccatttgctgggatgacacacagttaaaagaaaaaaaatagaaatctttccggggaaaacctgcagcccagactacagaagaaccaggggccagcagaggagacgctgggacggtggctccacagggttcaagaaaacatgctcgcgtttcatatctacagaattatcacttaaatgaatgagacaaaaatacattctgaatccctgagactgtcagaaggagtcacacacaagatcgtctctgaaaataccactggaggaagtattctgcaaaaaaaggaaaatgatcagaaattacaccagatacctgggaaaatcccacagtaagtgtaaaacttagtaaagttccctatggaccaaataatcaaacccttcaccccagacaaatcatgtctgtggcaatccagagctgaaattctaggttattccagtgtggctggtgtgtgggaggccagaattcctgaaggcacgctggggtacttgttttctttggaggtgggaggcatttttcaggtcaatatactaagctcttgaaaaacataaatgcttgttttgagtcaggagcagtcaccagggaatgtgtagcttccagagcagctgactataccagttttctcccacagaagggatggaacgtatttccacaacaacaacaaaccacagagttggcctaaatatatcccgctgtagtagaaactgcaatacctttcactgatcgaaggatgaattctccaaatggcatttaaagatgacatgcagctttctgcttccagccgtgatggagcagtcctgggccagtaacagccacagagctgggtaacacgctcgcgacagtctccagccacgtccacgggaatggtgctcagacaatgagcctccacccttatctcacaccagacacaacagttaattcaaagactctcacctaaacaccaaaaccagaactacactttccaaaaggaaaaaacggaagatcacatttacagcctcggagtaggcaaaggcttctcaaacaggacacacgaagcactaaccattaaaacaaacagaaggaaaaaatgacactttgtcaaaattcaaagcttttcttcaaaagacaccattaagtgaatgagggctgtcagaggcagagaggacctactctgaccacaagtcctggatggaggttttacatccagaatgtacacaaaattcctacaactcagtaaaagcagacaatctgataaaacaatgggcaaaatatttcaacagatccttcacaaaaagaagacatacaagtggctcgtaagcacctaaaatggtcaacatcaccatcatcagggaggcacatatgaaaatcacagtcactgcaacagctaagacactgggtgctggtgaggatgtcggggcgtgtggatgctccagccaccctggaaaacaacgtcggggctccttacaaagagaaaagtacaggctgggcacggtggatcacgcctgtaatcccagtaccttgggaggctgaggcgggtggatcacatgaggtcaagagatcgagaccagcctggccaacatggtgagacttcgtctctactaaaaatacaaaaattagctgggcgtggtggtgtgtgcctgtagtcccagctactcaggaggctgaggcaggagaagcacttgaactccggaggcggaggttgcaatgagccaagatcgcaccattgccctccagcctggcatcagagcgagactccgtctaaaaacaaacaaaaacagaaaagtacaactatcctatgcccccagcaattctaccaggtatttgccccaaagcaatgaaagcaggtgtctgcacgaagcctgcacatgagtgttcacagtcactttaatcagagcaagtccaaactggaaacaatccacatgtgcattgattactcaacaaattgcagcaaatccataaagacgagtgaattacatcatatccacacagatgaatgaattacgtcatatccacaaagatgagtgaattaggtcatatccacaaagacgagtgaattaggtcatatccacaaagatgagtgaactacatcatatccacacagatgaatgaattacatcatatccacaaagacgagtgaattacgtcatatccaaacagatgaatgaattacatcatattcacaaagatgagtgaattacatcatatccacaaagacaagtaaattacgtcctatccacaaagatgagtgaattacatcatatccacacagaggaatgaattgcatcatatccacaaagacgagtgaattacatcatatccacacagatgaatgaattacatcatatccacacagatgaatgaattacatcatatccacacagatgaatgaattgcatcatatccacacagatgaatgaattatatcatatccacaaagatgagtgaattatgtcatagccacacagatgaatgaattacatcatatccacaaagatgagtgaagtatgtcatatccataaagacgagtgaattacatcatatccacacagatgaatgaattacatcatatccacaaagacgagtgaattacgtcatatccacacagatgaatgaattacatcatatccacacagatgaattacatcatatccacaaagacgagtgaattacatcatatccacaaagacgagtgaattacgtcatatccacaagatgagtgaattacatcatatccacaaagacgagtgaattacgtcatatccacaagatgagtgaattacatcatatccacacagatgaatgaattacatcatatccacacagatgaatgaattacatcatatccacaaagacgagtgaattacgtcatatccacaagatgaatgaattacatcatatccacaaagatgagtgaattacatcatatccacacagatgaatgaattgcatcatatccacacagatgaatgaattatatcatatccacaaagatgagtgaattacgtcatatccacacagatgaatgaattacatcatatccacaaatacgagtgaattacgtcatatccacaagatgagtgaattacatcatatccacaaagacgagtgaattacatcatatccatacagatgaatgaattgcatcatatccacacagataaatgaattatatcatatccacaaagacgagtgaattacgtcatatccacacagatgaatgaattacatcatatccacaaagacgagtgaattacgtcatatccacacagatgaatgaattacatcatatccacaaagatgagtgaagtatgtcatatccataaagacgagtgaattacatcatatccacacagatgaacgaactacatcatatccataaagaggagtgaattacgtacattcaacagcttgggtgaataccacaaggactaagttctgatttcctatcttgcccaaattcctatcaaaagtgtctggggagtcatgccctacaaactatccattctcaccagatgtgttttatttgaccctatatatcgtgacttacttcccagtctcactctggtgtaacattatgagacaaggaaaaaaaaaatgttttacgccaaaatatatttccttgccataccttgaaattgccctgcaaagtttctcgcgggaaaaaccgacattctatagagaatccccttcccctttgttttccttcctttccagatccaggagataatcaactaagagccaggcacccttttaggtccaataagaaacatttcacaacctgctgtctctgaagtctgctatctgagagcttcctctgcaccaatcaaacttggtctccacaatcctttatctcaacctgaacattcctttccatggatgccaggtcttcagacaaactcaaccaattgtcaaccagaaaatgtttgaattcactttgaactgtcccacctttctgaaccaaaccgatgtatttcttaaacgtattgattgatgtctcacgcctccctaaaatccataaaaccaagctgcgccccaccacctcgggcacgtgtcctcaggacctcctgagggctatgtcatgggccatggtcactcagatttggctcagaataaatctcttcaaatattttacagagtttgactgttcatcaacaactccaaacgccatgctgcatgacagaggctatccacaaacgcacctgttccacctacatgaagttctagaacataacagaaatgatccacagagctgggaatcacatcagcggtttcctggagcgcagagggttttagctacacaggacacgaaggagctctctgggtgagggaaacgttctgtgtctgactaggatggtgcttacgtgttgtctgcaggaaaccttccttatatgtaatcaaatggagcagcaaagtgaaaaggagagactggaaagggatctaccaacaactctcaaaagacggccggagcgtttacgtgatgatgagaaaggagacttgagagagtggcacggtacgagggatagagaggccgttacatagtgagcaggtgccccctcgcgagaacacagcaaccctgaatgcaacctaacagagcttccaaatacacgaagcaaatgccagcacgcctgcgagaaggggcaaagccacggttctccttggtgacttcagctcccctctgaaacctcctacaccgtgtagacagaacactggcccgggtgtagaaggcctgaaggacacctcagtaggcgggacctggcgggcatttctagaatgttccctgaaacagagccgaaagatgtcttcttttcaaggctgcgtggaaccctgatgaggacagaccatatgctgaacccgataacaagcgtgaaggatttgaaagcactgaaattaaatggaatactttgctgactccagaggaattcagttagaaatacaaaacagagattcaaaaacctgacaaaataggcacgtcatagaagaaacgtgaacagccgataaacgtgtgagaagatgccccaactcaagtaactagagaaatgcaatttaaaacacagagagaactgtattcccaccagactggcaaaacttaagaacccttggtacaggggggagaatcggagccctgagaggaggtaacgtcgatgcaaccacgttggcaaacccttcgtcagcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcaggggattcctgggtgccggctctatgcgaatattcttcagtctgtgaaagaaaatgccttgtcatgccgctgaggattcatacgcacgctgtgtaccttaccccgcgaggcaggcaaatgccaagaaatgccagctcggattagcgcagcgggagcgcctgtctgcagacagggagtgtaaacggcacagtcacgtggaagacacgttggcattatctcctaaaacccagtgcaaacccctgacaatcccactaccaggtgttccgtcctaagcagcgagcttccaaccgtgggtcaagaaatcagttttgtgggttgcatccagcctttcctacagactgaaatagaagacacttgaatagaaaatgcaaagcacggcacacgtggtgacggtgcgttttattcattgaagtctgtgcacacactgggagcacattccagggcttggcagacattgcctgcagaagccgggcggccgcacctgggctcggcgggccacacggtcggcggggcttggtccatggggctggccgggcttgcatccccaggtgctgtgtgtgctgcgcctgatccagcatttctggtgcaaggtgaaaggactcagccactttagaaatccgaagccgcctctgctccaggggacacctaacccagcagtcccacagcagctgcgtgccctagagtgtcctgggcccggccttaacttacaagggagcctgagtgacaactccggaggccagccattgagagattaccacgcttcctgagaggagggccacgtcgccccaggccgggccacacgggaagcacccaggccggtccggaggcagaaggggctgggaagccctggccagggccttcactggggcctcccctgggaaggagggggcaggatggcgcaagcagccgcagaggggccggcgccccggcaggcttcgagctgcagcagtgtctcccgctgcctggtgcctggcacagggcggggaaacgttggcttagtgtgagactttgatagggggtcgggggtcacagccctggcaaggtgggttctaggcaagctgtccacccccgggaactaactggccctaggaggagcagtcctgggtctgaaagatgttaaaacattaacagatgcagaaaataaacatgcataacggatagagtgccatgcacacaccggcacctccattcctaatcaccgacagctgcaagcaaagtccactaacaggtgatggacaaactgcgtcttagtttattcagacagaagaacactgctcacaattaaaaacgaaggaacagacagcaaggagctacggacacacacaacagcacggatgaagctctaagtcataggatgaagaagccagacatcaaaggctccaactgcaggattctgactcctcgaaggtcgtgagccggagaggtcaatccacggtgcttaagtcagagccacagatggggagggacgccgacaggaagggctggagggaccttctaggggctgggtctccactgaagagcatgcatctcaccatatgtaaattttaccttaattaataaaaacagcactggacgcaaatacgccaacattgttgtcaaggttaatttggcgtggtgggaatatggtgctttatttggattttttttttgagcctcaaaaaaaaaaagaaagggaaaggggtcttcccccaggcaagcggccacccccggcaggagggtcccccggcaggagcgtcccagccactccgcagtcactcctgacccagaaaagaacaaccacagctgggcccagcaccccgggccactccctgcagctgcccacacatctggcagctgggtccacttatgcaatgtggatcgggcttcttacatctgaaatctgcgtctctatccctcctctgagaccagtgtctcctgccagcttccatggccccgggatgacctcactctcccagggtctccctgcgtcctgggagctctggccgaggagcagcaggggctgatggcagagcgggggcaggtcagagctcagcagatggggtcctgaatacacgggggatgtgggaggggccagggggctggggatgcccaggatttggcacgggggtctctgtgtcccacccactcctggcacaaaagccccagcctcaggaccccggtcacaggcacccgggggtgggggtgaccagcagcagttcagaggcaggtgtgggcaatgtgggcctgagtctcctccccactcacgtcactgcccgcggggacacagcggcatttctggggcactcggcatgccgggttcctaacctcaattattcattctgctctcaggcacctcctgacgagaccctggcccaggagagctcggctcggggacagaggaatgagactcagtgggacgcagagcccaaccccatccccacccctggctggatggggtctgggggcagcagaatgtggaccactcagcaggaggcttcctgactgtctcctcctgaaccgatgtcactcacaggcaggggacacgccatcctggccccgcccctctgggcccttggaatcatggaggggtggggcagcctgtgcccatcccaaggggaagtgtgcccctggggacactggggggctgccgggtgcgccatctttagggggtgcactgccgggctccagggtcatgcctggaaacatttcaggcctccctcacctctggataccgcctgcaggggtgaggctgtgctgagctctgcctgccctgccaggacggagggcatgggcctgtgtggaaaccccagggctccctgactcccatgaggcttctcagggacttcctgccccgagggtcccagcatctcccaggtggaggtcctcaaggatgcccccaccagctccccacagctactgtagcaggaagtccttcttcccgaacccagagcccagggcggatctcccgggctgcgcgccaaggtggaaaccctcagggtcctgggggaaccagggcccaggtctggactccattcgggaccttcccagctccggggaatcacaacacagaagtaccccaggggctgaagccactaggcccccgtggagccctggccacctgccagagccctggccctacgcctggaaggcagagtcctggtctccagactcgctggggctgggtgttcctgtcccccgcggagggcctgcgcaggggagagctggtcccgcgtgggcctcccgattctccccacgcggaaccagctccacaaaactctgttctccaaggctccttaggcacaagacttgagttctcactaacttacccaaaacacaaccaaacacaatccctgcctggaccctctcctagcgaagcagattggagcgctgctggctcaccctcatggggcccgagaggctcaaggaccctgggggagaagttgaagcccacacaggcgcaggacacggtgggtgggagaggcggccgggcctccagaagacggggcgcttggggctgaaggggcgtgaactcccttcaagggccccttggggcggtcgggaccatcaccagatctgctgagagactgggaggagtgagttccatctgcaggggagctcaggagactcttgaactggacttagcccgagtcctgcaggtagaaggcgccgacccccacctctgctccaagccactgcctcctgaggccacagtccaactggaagcagctccacactcggtctccccagaggccgtgtccccgtccaaggccgtcttacagcagacacagaacaggaaggaaaatttggcaaacgtgtggccccacagagtccagggagaagccagcccggccccaggccggccgcatggatgctggccccgtgcacggcagccccaggccacgcaggctcccggtcccttcctagatcatgccagccagccagggcggcaggaagaggcccaccgtccccagcaggcagacgatgatgaacatccagaggaagatgcggtcgatgaccatggccacgtacttccagtcctccttcacctgcaagcacagacgccgtcactccagcacggcccggccgccgccagcggggacagccctcaggaccccggcgccgccggcaacagcttctccacctcccaccttccacccgaggcagccattgctgctggtgcacgcggcacacagctgcaccgaggggaggaattggggtgcacgggacagccagtgctctgcggggggcatcatcaccatggtatggggcaggaggaccttgcaaccctgggaattctggctgggcagacccccttgtggagacaagctctgcactatgccctgtgtgcccccacttctcagcaggcggcctgtgctccgggaagggggcacgggggaggggggctcaggcaccccgtgagcggtctgctctcagctcaccagcgctgggagggcccatccccctccccgttttgcagatgggcaaatgtggcccggtgggcgcacagagggcggacgaaagcagcacacatggagcccgcagagctgccgccatctgcagtctctcactcgagcctcccctggcctgtctcgttttcacactgaggccttcaggggcggctgcggttacatatctgaacggggacagcgggttccggctccaggtccggcttctaaccccacactcctggggctgatgcagggcggacctcccccgggtgacccccaggagcagaggcctagggagggcagaggcagtggcctggtcaggcctggagtcgggaagccactctcgagacagccgctgtgtgcagcccaaggcactcatgccgctggccactgccctcgccccggctcccccgtcccgcgtctctggctctgccgtgtaggacctgagacaacccccaagctgatgagctgcctctgggcccggccgtgagggtgtcctgggtcccaggcctgtggatgctgagggatgggagggatgtgccgcgggggcctgggcacactgtggggacagtgccgcctcctgctctgattgtttatagcaatcccgggtctcctgatggtgttaaactgaaccaaaacggccgcatttatctacgggaagcctgaaggcaaacggggtcacttataaataaagtcctgcccaggcctcggctctgggggcggggacgcggccgccctctcgccctttcctatgtgcctttagttccctgggttctgtgtgccgcgttccatccaccctgaagatgaaacgcagccgcagaccaaagccttccctttgtccccgaggtggctgctgtgaagtcagctctgctccccacaagcccagaaccaggtcaggcagcggcagcaatcggcccgagaaggctgctggaggggcccagggcgcgcgaccgccgagctcagacccactgccagcttcaggaccgctttgatcaaacacctaaatgcatctgaccccacggtggcacagcccgggcacagctgcctctcgcttcaagagctggcagcaaagcaggatcccgatgcttctccaggctgctctcgtgaccccagaatgttctggaacctgcaggaggttttgcagcttcttgggattcagtggggtggctgtgtggggcgagcaactccctcacttttcatgggtatggagcacgggcccctcgctttggggctcgctcagctagtgggggcaggcaccagatgcgtccgaataaaccatcgaggatggcgctctggggtcctggcagaggtggccccttcagacggaggtggcccactgagggcaccaggccctggcaccgggacaagagccaggaggtgccggcgacagcaggtggatggacaggacagatgccgaattgccgctgtggacgtcatgggctgcacagccgaggccgagacccccggccacctgtgtgccccacccgtcccgccccattatcctgtccgtggaccctggcccctgtgcctccccccatgtgacaggcagtaaatgtctgcagaaggaaacagggaagctacctggtgctggggtcaggcaaagctggctcagccccagcctctcctgcatggaatgggtaggagactgcacagccacgggtaacacggacatggctgccacttagcagaaactgtggctcctggggcctctgtgcggccagtgcctggcgctggagggtgagggtaggtgggctggccccgggccccggggggccttagccgtgggaccagcgttctgcccccagcccctggctctcccacctgtccccagcttggccgtgtggggctgatggtcttggagctgtgtccctgtcccagctccgtcctcctgccaccagcccatcccatcccatcttctctgagccccctacatccaggccccagatacggaggggccccggggaggcccgcggggcaggcacaggcgcactctggagaaagggccttggcagtgcctcgttgcgttctggggacttggccattgctgggcaggagttcccagagcgcccccgttctgtgctggaaggacgctgcctgtggcccctcaccgtgccgtccgccgaggcccactgtgtcccaaagccagagacggcaccgggatccaccctgtgccagccactcggggccccctgccccgctcagcctgggacctgcggccacatagcaggcttgggaagaggctgctgcagcaggggccacgccctgcaccccaaagcgaagcagcctgaggcctgggcccggctcctggattacacaccaggaagaaagggcgtccgccggttccgtctgggtcagaggcgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgcttcgccagggctggacatgtgctggacgctgagggacctggctttggccagccctggtgcctgggtgccgtggggcgggcggcagggtccaggcgaggggtgggggctggctttctcagcttccaggggctgctgaggagggagctggtcggagggtgacttgcaggaaggcccaggctcagccggcacatccagggggacacagaaggacggtgagggcgggtgcaggctctgggtgccgctcgtggcagggggctccccttctggctcgggccagaagcgcggggcactggccatcttatgcatggactcgatgagccgccggcaattgtccttgaccacggacggccgcttcatgaggagcaggcgtggcacgatgtccaggaagaccctgcgtacccaggtgggcatggtgtgcgtgcgtggcgagcggtggtgcacgttgagcacgaagaccgtgatgacgatggacagggtgacgaagatcatggtgaacagcaggtactcgccgatgagtgggatgaccagtgaggtggacgggatgatctcggtgatgagcagcaggaagacggtgagcgacagcagcacggagatgcacagcgtgatcttctcgccacactcggagggcaggtagaagaccagcacggtgaggcaggagatgagcaggcaggggatgatgaggttgatggtgtagaagagcggcagccgccggatgacgaaggcataggtgatgtccgggtagatctcggcacagcactcgtacttcctggtgttgtaggtgcccacggcatccacgatgacccactcgccactctcccagaagtccagctggtccacgcggctgtgcatgttcaccaggtcgatcttggccttgtcgtaggtccaggagccgaatttcatggtgcagttctgctggtcgaaggggaagaaggtgacgtcgatgctgcaggagctcttgtaaatggccgggggagtccactgcacccgcccgtcatggaacaggtgggccttggtcaggtgggtgaccgcgaagtccccgtcagcactgggcaggaagagagcgaagggtgtgagacccccacatccatgcccacgtccacacccacgcccactgccacacccatgcccacgtccacacccacacccacatccacgcccacatccacgtccacgcccacatccacgtccacgcccacatccatgtcccacgcccacatccacacccacgtccacgtccacgcccacatccacacccacgtccacgtccacgtccacgtccacacacagaggcattctcacgtcacaggagcacaaaagggctggcggccttgcccgggtacactgttcgtcttctcacctactcgtgcacctcagtttatcatccctgagctgggcgtagcacgtggttcagagaacgggaagggacctacgagtgcctgacacacataatcactgctgctggtgattacccttatccatgagtggcgcatggatggggctagtctcccagcgtcacctcctgggacacacggcatccctatgtccccgcccctccaagcagcaccccgggccaccatgggaattcctcacccagcttctgccgttaaccccaaggacttggaggccacctcccagtgtgtgagcatgaggacaccaggggccacagaggcaaggacaggtgttctggccacccagggccaatgcagtggggctgcatacgcactgcccagttccagggccacgtctgagccactggctctggactctcttttgccttgggggacgtgggtgttctgtccacaggcccaggtgggcaacagagcaatggagcgaggggctgatgtcccttgaactcctcccggtaggcagagctcccagccccagcccctggttccatagacagcggctggctgggtgggacgcactgcaggagcacattcagggctgaggcagccaggctcacgggggcagcagccgaccctccacccccacccacagaagtccccaccaatgggaagcctgaggccccattaaatccccagcgttggcaggcatggggccaggctcagctctgtggagggcgctggggcacgacgcgtcggggggagcggctgcccagccacacacctcctgctccacctctgccaagctgcctggacccctgcccatccctcctctgcctcattccctgagagcctgctcaaaggccagggcctctccaggtacttgggcagagctggcgactgttccctgagcttcctctgtgcctgcccccgagtcccagggctggacctgcacctcaacctccctcccaaccctcagggaccctccctttgtggagccgccactgctggagctctgccctccaggtcgtggagacctggccccccacggtctcagtcggtgctgagcctctgcccccctgaactggtcctgagccaacaccgccggctgggctgccgctcagctgcagagggagggagacccagcaagagccaccagctgcatctcaatgcggctccggcccagcacagcctggctcccgagcgtccctccagcggggggcggggctttaccaccaagtcagtctgggtggaatcaggctcaagtttgctccctctccccagcccatctctccaaaaaccaacgccctccaccttctgaggcacaaattaaaagattctcatatggcaagcgggtgactactctgttcagcacacactctacagggaacgccagggccatgctcagggaacagtgcaggtctgcgccactctgggcagggcccccctcccccagggtcctctgcccgcgccacaggaaacgggacaaggtcagggccaggtcccccagcccccaggtcccacagcacccctgggctgcatcactgctgctccctgccccgcccacccctggctccagccgccctctggggagcctttgaggagaaccccgtttgggctgaaccacccggccgtgagccggctctggactcgcaccataaagctgcaccctgggagcagacagggtctgaggagccgcccagtccagcaggtccaggttcctgctccagggcccacaggctggcgtgagaccctctgtcccctccaccccgaccccagtccaggtcagggatttctgggcacctgccccaagtggacagcagggcccccaactgggggtggccaaatcccagagaagggccgaggcctcccaccctgcagcctggccggccaccagccacagccacctgctgccccagaaacaggcctcctcagcgggagcagacccagcaccagcggccactccaggaaccctgggtcctgtccggagagagcctcggtgacaatcccagccccaaagagaaaactggggtcaccccactacatcccacaggccatggtgaggaggagacacaggagaacatggggtggcagcaatccctgctctcctgagctgtggtcctagggggctgtggtcctaggggggctgtggtcctgggggggctgtggtcctagggggggctgcggtcctggggggctgtggtcctagagggggccatggtcctggaggggctgtggtcctgggggggctgcggtcctggggggactgcagtcctagggggctgtggtcctagagggggctgtggtcctggaggggctgtagtcctagggggctgtggtcctgggagggctgcagtcctaggaggctgtggtcctgggggggctgcggtcctgggggggctgtggtcctaggaggctgtggtcctggggggctgtagtcctagggggctgcggtcctagggggctatggtcctagagggggctgtggtcctggaggggctgtggttctagggggctgtgaccctcgggggggctgtggttctggggggactgtggtcctagcgggctgtggtcctggggggctgtggtcctggggggctgtggtcctagggggctgtgaccctcgggggggctgcggtcctgggaggtctgtggtcctggggggctgtggtcctggcgggggggctgcggtcctaggggtgttgtagtcctagggggctgtggtcaggcaagaactgtgatccttgtgggggctgcagttctgcaggaggcactgtagccctagggtgggatgaagtcctgggaggactgtggtcctggcagggaatgtggtcctgggggcctgtggtcctggggggctgtggtcctgggggggctgtggtcctggggggctgtggtcctagggggctgtggtcctaaatggggctgtggtcctggggggctgtagtcctggggggctgtggtcctagggggctgtggtcctgggggggagctgctgtcctaggggtgttgtagtcctagggggctgtggtcaggcaagaactgtgatccttgtgggggctgcagttctgcaggaggcactgtagccctagggtgggatgaagtcctgggaggactgtggtcctggcagggaatgtggtcctgggggcctgtggtcctagggggctgtggtcctagaggaactgtggtcctgggggagctgtgaacctggtgggggctgcagtctttggagggccgtggtcctggtgaggctgtggaagtggggggggctgcagtactcggggggctgtggtcctgggggtttgaggtcacagtgggggctgtggtcctcagaggcttcgttcctgggggctgcattcctggagggctgtgcacaggcacccagagcggcttctctgcccggcccatcctgggcgtttccacttctccctgaaatgtgtccatgcgagtcacacaggcggattcggtgcatggtcctggtggcggggagctaggtggctgggtggcttgcagggggcagggagtctgtcctaagggaagaccacccgctgcccactcaccactgaccacctccccaatgcactctggaaaagcgtccggccctcccactgccggaggcccttcccgctgccattactggaatcaattgagttggaagaggagcccaatcgttcttaatcatacagcagggtttgtaggtcaggcgggtgccctggggcctggaaagggctgtgggcagatggctgggacgggagaggaggaagagcttccatttgctttgtttgtgggagctgtgaccctgccacacccagaccctgagcctgtggccagagatcatccctggaggactcagctcagagagcgctggctgccgggcgcagggccctcggcacagatctgcaggaaggacaagttagaggacagcagcctccggaggccaccatctgccacggccaatccgtggcaacgctgccctggcttccaggcacagaaaacccgtttccatgaccagacttcatcttggcctcctaggagcctgacatgggcttggcccagcccgaggctttgtttgtttgctggggacctggcgtgacatgtcctgggcagagcgtgagtatgcagagaaagcagaggccctagtggcatgagaaccatctggggcttcctcacccctctccagggcaccctgcagtccacactattctcccagaaaggccaggatggggtctgatggcgaaaagcactcctgcccaaaagggctctcctgcagctgtcaagggtgggggcaaagacgtcgcgggtcaggagccagcccccaggcctcaggactggtccaggcagggacactgtgtccaggtgccatagccactctcaggcccctccggctctgacgctccagtgctgagacccagggatgccctcagcctctttgctggcctggggggacccttccctcctcaacccacaccaatttctccattgctcctgcttcttccttcctgggcctgggctggcatgcatggggctggcataggccccgctgggccaggctgggccttggtggagctccctgtctgggcaggggcaggccctggccactcctgcccaccaaggccctgtagaggactcacttgttgtagaggactcacttgttgtagaggacgatgtccggccgccagatgagctcggaggggatgcggatggaggtgacattctcatagtcagctgggtcccagcgcagcttgtagtcgtgccactcctggatgaggtggggcggggggaggctgcagggtgaggggtgtgggggagggcaggggcgggacagggccagggtggggcaggggcagggccagggcagggcagcagggtgaggggtgtgagggagggcaggggcgggacagggccagggtggggcagcagggtgaggggtgtgagggagggcaggggtggggcagggccagggtggggcagggccaggacagggcagcagggtgaggggtgtgggggagggcaggggtggggcagggcagtgccctcccactcacctgcttcacccatacgttcgtggtcatcatctggttcttctcatcctagggcaccgagagaggaagggggccagtgaccccttggtgtctttctctggccctaggtttcctcatctacagccactggcacaaggacacggccagggcaagatatggtggacgggcgacctgtggagggggtgagtgccccgtccctggaggcagccgagcccaggatggggactctgaggggacctagggatgtggggacaaggccacaaacatctccagcaggaaactggagaggagtcggcggcctcacaggcttccccagctaaggacaggtgtggcgggcatggggagcctccttctgcccacctgccttgctccctcccggcccttgggggcagcccctctgcagacaaggcccccatgtgggcacacacagccagcaaagctgcccctggcacataagtgggttccactgctggccagggtggcccctccaggactgtgcctcatgacctgagcaggtgggacctgtcactcaaggtcactgtgtgcagctgggccactcaccccagccccttccgacccaccccacccacctccttccacatccccacaggaccacgtccccaccgaccacatctccatggaccacatccccacagaaccacgtccccacaggaccacaacccacaggaccacatctccacggaccacgtccccacagaaccacatccccacaggaccacattcccacaggaccacgtctccacggaccgtgtccccacaggaccacgtctccacaggaccacattcccacaggaccacaacccacaggaccacatctccactgaccatgtccccacaggaccacgtcccacagaccacgtccccacagaccatgtctccgtgcagggccatatctccccacaggacctcatcccctcaggacctcatcccgtgtgtctgaggaagctccagggtcctcagaaccagcttcacgtggccaggcctggccctcctgcccagtgtcgtgccctacccccttgcagccgtcattctcagtcgcccttgaagctggagggcaggtcaacactgcacatttcaccaccactcagcactggcctgggctggttggaaaagcactgggtcttccagaccctcctctgcagccagtcctggggcctgagctcacacgtgcagctcacaagccctcccctccaggacagaccctggtgatggcacctataacaagtatccgagcccgcaaagggggcacaggtgaatccccagcccctggtgggacgggcagagtgggccagacacaaggcagccccttccacatacacgtggtcctcagccttaggccagcacccaggagcatcaggcagccccttccgtgcacacgtggccctcggccttgggcacccaggagcgtcagcacccacgtgtgcatgttcgtgtaagtccttagtcggctgcagggtggagagaggggtgggcagctctgggagtcttggttctgggtgtgctccaggcctcaatgtctcctgggcaaactggggactctgtggtggcgtagggagccatggattgagccctgagaagctcaggtaggcagccaggtggggggtggcagacccagagccttgggcagctgccagcggccgcctctgccagctatcactttgcagccgtgtttgcaaacctcagcaggcttgccaagcctgtgcaacccgcattgtcttctggctgggcctccgccagggacactccacaggagccactcaagggcagctccaggacactgaggctggaggtctgggtggccaaccctggacggggctggctgactggagtctccatgcgctgccctgcatgggcaactgccaccactgagcagcctgtccgcgggaatgtggctgcagctccccacacctcccaaaagcccctggggtgtggcccactcagcctgggatagtgaagcagctctcaccccgtttcacaggccccaggcccagggttacccaacacgcacggcaccagcctcccaaagagaggaaattctcccgcaacccggtggctcctccctcagcggcagacccaggcttggcatcctggcaaggtgtgggctgggcctctacagcatacaaatgcctccccatgtgggggtgccctccctggaccagcgagctgggatttggcagcagggctggagctggcggacttcagtgtggaagacgagcccctgcagctcagctggccattggctgcccactcgcaagtgggccagctcccagagaccatggcctgcccaacctgccctcctccatggtggcagcccccaggctatgcacccccacccagccaggtaccctgagggatggtctcaccccatttggagtggctgagcctggctgggaaacgtggaaatgtctctgctgccccttacccggcccctccagggccgccgagacccccagacagtctggctcaggcctgggtaggtaaccaagcatctcaaccgagcacaaggccgagcctcccgcagctcagttctctcagcctcgaagcctcctggttcctatcctgccttggggctccatgtgcactggcccacgctgcaggggcctggctggaccagtaggcttcctcccagcagccttcttgggccccccaccagaaagaacatatcttcagacaaacagacttcgcccaagactcccccaaaccccacattccagatctgtgggtgaggggcctctggggccagctaaggttggggtgctgccgggacaccacagtgcctgctcctgccccggcccctgccccggccggttgtccctgttgctccgaggtcacagcgtgccccgccacccccaagcaaggcctttgctgttctttgcttccgaaggtgcctgggctctgtactgagaacctggccacttggagtgttcccacgtcaagggggaggaaagggcagggcctggctgggacgctctgaatcaacccttggctggggctcaggcggggcagagctggtggctgtcgttctgacgtaccagcccgggccggacactcacagccacggggagtgttgatggctgtgtcccctctgcccacccagacccctgtgctccttgcagggcgacctcagtcacagtgcacgatggccacgccctcacctaccacgtcaatgagctgagcgatggacaggccgaagcggacgaggaccacgtccgagatgttggccacgggtcgggaccacttgttgtaaccggagaagagtttcttcaggagccgctcctcggcgtgggcccgggtctccacatggctgctggctgcggggagaggcaggccagtggctcaggtgcaggcgggacaggagccgggagctgtccaggagctctccaggctgccccagccccctgcccagcacgtccacttcctttcagctcctcacatgagcccttcccaccccaggacctgtgtgtgtgccgggcgtgcgctctgtgtgtgtgtgtgtgccgggcgtgtgctgtgtgtgtgtgtgtgtgtgtgtgtgtgtgtgccgggcgtggcgtgcgctgacctctcttggcctccggctctctcccacccctgggtgtaattgtgatttcctcggggaagcttcccaggcccctcagcccacggaggccttcccagcaccttgaccgcaccacaaaaccaggcggcggatgggccgaggactgctttgggtctcctgtcacactgacttccagggaagggctgtgtctctagcagctggcgagtcagaggacactcgggggtaacagcagcaaaggagggagtacagggcagcggggccagcccaggcaggaagagggaggaaggggaaggaggatcgggcccccacaagcgcccgcttcctacggaacctcccctggttcatcaatcccctgatgcccgaggagtgtttcagatgcagaccccaacgaggtgccagccccctccgcaccccagcctgcccgtgctgttgggcagacccagaacgcccctgatgagtcgctctggaggagcacagccctaggtccatctgtgctccaggtccggggccccaggatctgaggcattccccgcctgtcctgggcgctgccataaggggcgggtctgggcggagggggagacctccacctccctggtgggtcccgctggcctgagagcgcagacaggactcggggagggggaggggtcagttctacacccctgggagccttgactcccagcccagagtccccacccgcgaccttgtccttcctgcagaaaaggtgggtggcggccgccaagggcagaggccacccctctgatcccctaaaccggaggaagcaggcatgggggtcttcagggaaatttagctggatggatgggggaagggcgaaggtggccccacctctgctcaagttcgagcttttggggccagccctgaaatagcagcggaaccccccacaccccgcggaaagcccctttcccagccctccgcattcgccggcggtcaactccctcctcgcctggctcagcccgggtgcgagcgcagcctgtgcggctggggatggggagcctcgcggtcgcccagtcgcgcgcacccgcggcttgggaccgcagtcaggagcctgcctccctctggctctgggggtcccaggccatccgaacgcgggcgaaagggggcccatcccgcgccccgtaacttaccgcgcaggaggccggtccccagaagcagcagcagcggcggcagcagccgcggcgctccggggccccctagctccatggcgcacgcacctcgcgggctctagatgcgggcggctcccggctccccgccgcttcgaggcccgtgcgcgcccaacttcatgcctcccgcgcctcgcgggccgcttcggccgccgggcccggttcgtcttctcctgtggggcgcggtgcggcggcggcgcggcagggagcgccgggctgtgggctccgtggcgcggccccgcccggccctgcccgcctcagccggctgggagggggagcaggggaggggggaggagggggagcaggggagggggagggaacggagagtgaaaagggaggagggagcaagggccagggagaatgagcagggatggaccgcgcgcccagggggacggggaggctgcgctgggccccgggcgggggtaaagtttccttgttctcctggggttcgagacgtgcctgagccggggacggggaccccggggtcactgagtgcgactggggggtcccggagtcagtctgacctccctccccacatctccagcctgggcgcccgctccctgcctgcaggggtggggggcacatctaggggatccggcgcaaggaggggcacccctagcacatctgggttactccatcgcgccagccggtgtctgcagcctgaaaatcgcgtctctggtcttgttccccagcgagccgttcaggactctctgtccgcctgcagcccccgccttccctggtacctccgcagagacccaagaggcgtccagaggggagcccaggcgcacggtccccagggaggggccccgccctcaggtgggtgccgaggtggccgcccacagagcagcaggtgcgttggaggaggggcgccttgtgcggctgaatctcgtgtgcaggaggagagggcgaggctctgcagaaacatcagacccggccatccctgtagccgcgcccctggcccagcctcaggctctgcagctgggacacagcccccgaaaacggagatttccgtcgtcggtaatggaaggcagagcagaaggggctggagaggtccggtgaccctccgcattcacgcccctccctccaaggctgcaaggctgctggtcgggcgagggggctccgtcaggagttccctgcagcaaccccctctccagcacaggcctctggagccctacagctcctgcccctcccatcgctctcccatctcccctgtccctaccccctaccttccttctcctcctccccccagcttccctgagcagccactgctcctgcccacccctctcccccctccctgcccacctctggttccaggttgagctcatggctcctcatacacctgctttgggacgggcaggagctcttcctcactggccagagctgtctgtccgctctgtgggcagtgcctacaattagagctttcagaacacacagccgctgcacagtggctggtccaacgacgacactgccctcctgaattgcctggtccagcgacaacacctgccctgcttctgtggccttcccacatgctggtccaagcaagctggatgcagggaccccctgcacttccacggcccccttgaggtggcctcttcaattgtccctacgttaccaaagagataacacaggtgcggagaggccgagcgacttgccgaagctcacagtcagtactgggattccaacccaggccatctggctttagggtctgcaccccggcctcctgctggcctcagatgtagttttgggctgacgtgccctcactgggacagcctcctgggagatcccaggtctactttcctgaactctttcctggagccatgggtgtctgccacccaccctgctgacggctctccctcagaccaccctgcagatccaaccctcgatggtttcaagggcctgtttccctaggcagactgaagtcccccaaggaaggattccctctcctcctcctcctctccttgctcttcccaagcccctgggcagtgcaagaccctggtccttctggcctacatgaagcccctccatgggccagttctgtgccaggaactagaaggttccaagctggatggatatttgggctgagcaagcagctggtaaacacagggaggggagaagagcaaagtcccccgaggccccgtgagggcagcctgctgacctctgacctctgacccactcacagaaccccacccccgctccctgcggcacagcccatgaggctctctgcttaggaaggggacagagaggtggcaaggccagcggttcccgcatggtatagactggcctctgccctttggttcaggccccaccttggtgagaagcccctgcctgtggtgtcgcagagcaaatgccattggcagagccaaatccacattcttttgtgagtggagaggccagccgtgctgcggtccctgctggagcccctgtgacacggggttatcgtttctctgacttggcagctggccgaaacggggctcttctgctgataaagtgatgtccactcgtgggttccacaccctcgtgggtgcctcaccctcccgtggcaaaccaaagacctctttgggaagaggacacccctgctcctgcacttgggctcatggtttccccctggacttgttaaaatcgaggcctcctgtggagattatctggggtcacagcagagcggggggcgtgtggtgagctgggtgaatccctgaagggccacgggtgtccactcagccgtgcgtgggggcgtttgtttaactccagattctggagctccaccctcagagactgttcagtctggggtgaggcctccaaatctgtggcttccaccagccattgctggcagctctgatgcaggcggccccagagtgcccggagaaatgtcagcttagagccacttggcccagggctgatgtggagggtcagggttccccaccgcagccagggctcagcccgaacctggtgtcctggcctggggcaggggctggaatttgtcccccgttggtgcaggggaagaggccgtgggcctcggcaggagcctagcagaggctctgagactaagccagctttgccttttctgtctcctcctcacttttctaacaaaacaggcccaggcttccacagggtcaagcggtctcaagccggcggctctccctggtggattcctgcaggtgagttcactctgagagctcagccagggccagcaggcctgtctctcccggagccaggggccaggccgggtcagctggacgcccggggctctggtgacacagccctgcggccgagtgcacacgctcacacacatctgtccaacctcactggctttccctttggatttgctaatgcagcaagattaatcaggtctaactcattaatttgcacagcccctccctcccacctgcgcccgctggagagcgctggttgtgggaacccagtaatcaccgaggctgaattagattcctactccacatcctggcccttgcctctgctgctcctgaaattgctgcttcaaaggaaacaaaaactctggattcaaagtccagtgagaccagatttgggggcacagcttttctgtggcctgagccgccctagggggcttgcgggtaggttgggggacactaccaggcccttgcagacaccagcccccgccccccaccctgggggacacaaccaggcccttgcagacaccagcccctgccccccaccctccccatgtcaccaccaactccaggctgccactggctacggtgcaaagcagctcccctgggagcacggctctgggggtgatttttctctctccctcactgctgtctacctgcccatggtaaccgagggtttgtagtaaaggtgagcattgcggggcaccagctgagcctgagccgcacccaaggagatggctgtgggaggcaggaggcatccagccccaggtcccagtgctgggacgcgctgtgggctcagcccatggacagggggccctgcctgtgctcccatcccccccaagggcctccccctcctgcagctgggcctcgcccatccctaccgtgctctgtggaaactctgtcccacccagcacccctgagagaaaggggaagcccggggaagggcagcactcccccacctgctctgcccgactgtcttcctggcactcttcacaccaaacgtcatgcgtctgctctctgctggcctcccctgtcccccacctgccaacagtgccagtccttgagggcaggtctgggcttggcaggcgaagcctggctcttgggccacagtgaccacgtggacagatggacggatgcctgtccaagggctaagggagggttggcccagagcaggcctgtcaccagcggccacctcacccctccctggagtgaggacccatgtctgcaaggagtcacggggcccaggagaggactgaggagggttcaggacaggtgggagcagaaacgctggggccccggagactcaatgctgtcagttctcaccacattgacttccctgtcatccaccaggacgggcggagagtaactctgtcctgtagcctccgtgagtctgggaaggcctcctcgccctcccgtggacccgggggtcatgctcaccgcctggtggcccccaagcacccctccctgccagccctgccatggggccccccctggagacagagtgcacccggccctgcgggagtcccggctgctgttccttctggggctatcaggagagtcgggcctgggctcagcccctctgtggggccaagtcactcgcaccccttctgtggggcctgagccccatgctttgctgctcacctgagtctggcctgcgtccctccgaccccgttcctctgaggcgggaaaacgaagaggccacacaagtgagcagtgtcacctgccccttcacagacatgagcaccccatggatgagagtggcctcctggagcctcaccagagcccaggtgctccccactgcatccccaggcctggctccctgcccccggctgtgctctcaactccctgccctcggctgcgctcccagctccctgccctctcctggtgctccctgccctctcctagtgctccctgccctctcctggtgctccctgccctctcctagtgctccctgccctctcctagtgctccctgccctctcctggtgctccctgccctctcctggtgctccctgccctctcctggtgctctgccttgcagggaacagagagtgctttccctcgggctgagagaagagatctttgagcccctgtctttgtccgttttgttcagcacaggttttgaagaccgttaagtgtaagagaaacatgggaatcgggcccggattgccaaaggggcaacatgttctcctcacaccccctctttccccacctgcagctgcttccatcccgggccctgctgaagctgcctttgctgaaaagatgtagggcacagccgctggggtgatagtgggagacggaaaggttggctgagaggcctgattccttccacgcatcacaacctgaaaatcgccaaaggtcttccttgttggggaggagtgaatggcagcaccggaagccaaggcccctcaccaccaagaagccagcagctcatccccaccttctggaccaaagacacgaagcagagaccaagccgagccaaggtcaggacctggggccacagtcaaggtcggggcctggggtcgcggtcaaggtcggggcctggggtcccggtcaaggtcggggcctggggtcacggtcaaggtcagagcctggggccacagtggatttcctcctgtggggatgtccttgacgtccacagctcaggcctgagggtctgccaccggctccagcagctgccacaggtgtcctggctcacagggtgtctctggctcagggccggggctgtctgcaactcccctctcccctgagccctctgagtggggctcctcaagctctcaggggctccgccacacctgggcttcctgggggctgggtcctgccctgtgacgcctgccaggctctttgtagacagttactgatctcccattggctccggttttgtggctctaagtgcttctggccctccctccacactccctgcctctctgctgagtagttaattcactataagcacgctccagaggaagtctccagcctcttagtgaaactgcagcgatgaatgagaatgatcgggcacccaggtctgcctccaagtctcgcggatggcccagagaccgtgcagtgggaaggttggcagcaagctgaaggtttgaactctggctgtgcccctgctgccaggggacctcaggcaaatcatctttttctctgggccttggtttcctcagctgtggggacagtgctggccccgagtcactgggccgttgtgaggatggagagggggtcgtgcaggctcctgggtcctcgctgaagccacccaggagttctcctgcactctcaggggagcccttgtgctgacatctgagggtcacggttcagtggcttcagggtccagacaggcccggaggccaggccagatgtggtgcagccaggggagggggcaagccccgggggccgtgggccatcggttcacaccacatcaggggccgggaatcccactcagggtttagccctaggctccccccagcacccccctcccaatccagaggacactcccagccctgagcagcgagctctgggcaggcatcgggagagggagcgcatctcggctctttgtgaggaattacgtcccgacaggtcactgacacagaaaagccctttgtcccagccagctggccgcctgctaatgacatccagcctgcaccttccaaggccacctctgcatccagaaaggacagtggcggctccagccggggaggaacaagggccacagcttccctggggtcaggggtggggagggtgggtgaaggctccggacgcttctgcacgttgccccagagctgcggacggacctcaggtgaccgtcaagacctgctgcggatccagtgacccctccaaggagagtgccgagtcctgggaattctcttcctcctcctgcacctccaggtcaccttgccctctcccgtgttccccagccagacccccagtagagaggagacccctgcagttgtggatgtggctttccccagtgtccacgagacccctggagcctggcccctctgggcccgtagaagctcccatgagattctgatgcacagcgagggcctgagccctgggccagctcttgggggcagccctgggctcccatgtaggtttcatcacaccacactgtggccctcacaccctgccctctggctgcccctcctccctagggcatgtaccccgagcccacctcagcctccccgggcatatcagggccccactttctggggtatgtgtgagccacgggacctcgagtcaggagatccaggcctaggcctgattctgccccctccaggttcaggaccctgggcaagtcctcccacccatcttagcccagcctccccacccataaaatttgggttgcttgtcccggctctgaggctttgagagcagggctgtctctaaccgagggagggtgctgcaaactccagaaggcccccgtcccagggaacagcggggggaactgtcagagaagcgacccctggaccagcaccctgagtgggctttcttctcctccccaccctgctgagaccacccaaaccttgttaagatcaaagattccctggggagccacacgggccatgctggacactccctgccagactttccggaacaattcctggggacccgtgtcccacaaacaccagctggaaaaggcagcaacgtggggtctccctccccctcagccaaagtgaactgtgtcagcaggtgtctcccagctgctgagaatgagccaagggaccaagatggccgcctggctcctgcaagtggagagggtcttgctggggcctgaactggctgaggtcttgcagcaggtgaggaagccctggacagtcctggcctctccaccaaagcagaatggctgcaggcctggaggcacaaagcagggatcattttcctgtgtgtacacgggatgtgtgtacatgggatgtgtgtgtgtgggatgcgtgtacgtgggatatgtgtctgtgggatgtgtgtacgtgggatgtgtgtgtgcaggatgtgtgtgtgtgtgagatgtatgtgtgcagggtgtgggtgcaccaggcttgtagatgcatgcacagggtacgtgtgcacagacgtgtgtgtgtgcatggactgtttcatgagatgtatatgtatacagggtgtgtgtgtgcaggtggtacatgcttcatgagatgtgccgtgtgtatgtgcgcacaggatgtgtgtgcagtgtgtatgtgtgcatggggcgtgtgtacacagggcttgtatatgcacaaacagggtgtgtgcacgtgtgcatggggcatgtgtgtgcacaggagcatgttttcacaagcatgagtgtgacagtcacctgctgacaggcggcctcaccctctgctcaccctgcccacccggacccagggcctctctcatttaccccaacatcccctgcccagctcttctgcctgggagggtcctgtgcagaggggggtggcccacacgtccgcagcctcagcctctccatgttgttatccctggatctgggggtgggacccccacagcactgcctttttcagcctgtggttatggggactcaggtccccaggcccaggggctaatttcagagggagaggtttcctttgccaggcaattggattttcacatcagcacattcctctgaaagtgggggcagagggtgggcttcatccccacagccgctaggggtccttgggcatcctcaggctctgcctcccagcaccgggtaccccaggcttctgaggccgggtggggaacttgcagcctgcaactcgggcacctcttgtaatgtcgggaaaccggggcaccgctcagtcacacgtggccgagtgcaggacacctgaacgcctgctgccaggcctgccctcccggggcagtgtcaatgccgagtctgggaccctgcccgcctgctgagcggtgcacccagttctccaggagctcagttcttcctccacgcagtgcctcctcccacctgtccctcctcagccctgccctccccagcactcaagtcaagaccaagaccacacctcagccaacccctcctcattcccagccccacccaccctcctggactcgtgtggggccagcaccgccacaagtgtgccccacgccagagtcccctcatgccctggccccagctgggggcccacagcgagcctcccggcagcctggtctccttccttacaggaaggggacgctggacacttagccccctacagggagcccagagccaggcctgggtgaaggtgcctttgggaggaggtggaggagtgtaacgattgggacccagctggacaggtccctgtgagccggcctgggtccttggtgggtgggtgagtgccagcttgccctcacgggactttgccccctgagcaggagggacagctcaggccccacctgccttgggcttctgagcatagctttggggggcaggggtcgtttgcagcacgaagcccttgtcagcttccagcgtgttctaacatttgtcataccagatggattgtcacgagcatatggggtgacattattattctgttactcccatgatgacagagccaagggctggggagacggacccatttcagcctgacccagcccagggcccttctctaccctcacagcttcttgatgccccattccccaaacccgggcccccaatgcccccgccccacccccgggagaagagcccagccgcgccggagggtggagagttctgtcaaccagtgccgtttccttatcaacaaggacatgtctacaaatagctcatcacgtctccaatccagaagtgctgtgtcgtttcaaaaatgagcggagccaacgcagccaccagccaggcctcggctacctgggcaaggctgccggctcatgaatattcacggctccgatggtgtctctgagcctcctaaccatctggaattaaaccaacgagcttcccctcatgggctgcactcacttgactttcagctcctctccaaatcgttctcttcctcgcagcagatgggggtgtggggcggcctcgaccctcctctgtgtctgggctgttgtggcaccagcacctttgccccagttccccgtctcttaagcgctcaacatgcgtctgccccgttctcagggaggcctggaccctgtcccagccctggtggggataattaccctgacgctcgtttgcagcgtttaatttgcttcctccgcgctggaagcccacgtttggtgatgtatgtgttatgatggccacgtgtccttcccccatcagcgacggggtctggggaggccggggaggctcctcattacgctcccagcacaaagcccaatcacagacatcgcacacggatacactagaccctgcctgcggggagagtggctgccagccggggcacccagacgtccctgcgtgccctgtgctggcgcaaggcagctcttccgtgcctccgtggtgcctgcggtgaggctgcctgggacccccctgtagatgctgccaccagggtctgctccaaggaacggggagaatgggcttgtggtgctggggccttgtgtggggtgagacgcttcagaccggaagggtgggtggcctggagctgctctgtctccaggcactgaccacagcatgcacctctgataggtccaggagaagtgtggcagggttgggcgcagccacctatgagcccctgaacctccccaggccgtcggatctcacttcagagtggcctgggcatggcctcaggttaggtcaggtgaagactctattcctggctcaggaaaaccaccaggacaggtgagcccagcagcatctcgtggagggaggctctgagtcccgtgaggacaaggacggaacaccggggctgccacaggtcgcagagaccctgtgtcaacacccttgttttgaggtgcagagaccaaagttgagacctggccatgcagcaggtctgcagggacctcagagcccagggccactgtcctgtccccagccccattaaacgcccagggccactgtcctgtccccagccccattaaacgcccagggccactgtcctgtccccagccccattaaacgcccagggccactgtcctgtccccagccccattaaacgcccagggccactgtcctgtccccagccccattaaacgcccagggccactgtcctgtccccagccccattaaatgcccagggccactgtcctgtccccagccccattaaacgcccagggccactgtcctgtccccagccccattaaacgcccagggccactgtcctgtccccagccccattaaacgcccagggccactgtcctgtccccagccccattaaacgcccagggccactgtcctgtccccagccccattaaacgcccagggccactggcctgtccccagccccattaaatgcccagggccactgtcctgtccccagtctcattaaacgcagcaaacgtcttctggacgtgccgccagtcccacagaaaaccaaagcaaggcagactcaccgctcctgcatcccggagctcaggtccaggagggtctcgggaaaggatgggggcaactggagtaccatcctaaagccgtctcagccccagggggccgcaggggtctaccctgtcttctctcttgcaggtgtgtggttggttctagaagatgctgagcccccccccgcgcactcgtccccacctgcctggccccagcacatctggctgattctcattcaggccttgaatgaaaggccatcttcccaagagtcctccctgactcccctctcacgggacaggtccctcctgttccccgccatggagactgttggttaactctcgccccagccgactgaagggcccaggagggccgcacctgccttggccactccagacccgccacccagtgcagacccaccacctagggcagcgcctccacccagggcagacctattacccagggcagagcctcgggcatggctgaaggcaggaagggctgaggatgagcgtgggtggtgagaaaaggcctctggacggcaaggacttagacgtggttccaggtgtgcacacgggcaacagctgggggccttgggcccccgcaggcctgatggaggaaccccgctttggttaaggcttaaaggaggcgcacgggactgactcttcctatggaaaatcctgcacagggagatcaaatcccagcctcccagagggaagccccgtgccggctgtgagctgcccgcagctgcctgaccctaatcttctccaatgaagtggctctgagaggttttgtggtcagtatcagttctgtctttgatttcagcgcctggtctggacagcaggaggaagagctcagagacagcttcctccagtgtctcggggtgcagccgggaggagctgcctcgcccctgcctctgcctctgactccctgccccgccgcctggctctcacctgcagcccaagagtccaggcctgggccctagagtcgctctggcccacgggaggggcacacccgggtcccgcccagcaccactaaaagagcctgttcagagacgtgggccgtcgcccctgctcctgctggaacgtgcagcccagagcccccacaagcacctcgtgctgcctccctctttgtgatcccccagcccagccctcagttgtaccccaggggaaactgagtccctgcctggtaaatgtgcagcaacacagccacagcaggctcagctcggcacaggcacagccagggtgggctcggtccagcctcggcgcctccccgggttctggtgctcaggcagtttcctccacctacatgagccccgactttctcatccgtagagtgggacgaacaacgcccagtgctcagtgtgatattagaagagcccaagacagtggagggctcagcacagatgccgccatccgtccgcagaatcgcgctgagagcagctccttcaagggagcccgggacgtcccggggaagccaccctcagtgactggccccagacaaaggctgaacgggccgggctgggctgagggacactgccggggactcgggtaggaagaagcccagggctgaaggtcaaggccactgcaacgccccgggctcaggggagagtggggacacaggacccatcctcctcacctcaggctggtccttttcgctcccatgtgaaggcaccattgccaggccaatgctggtcactctgtgatgaccaggttggagaaaagctgagaaccccaagtattgggcaaatgcagactcttgtgtcttcaaaccagaggacatttaaccctaagtcaagaggccggcttcttccaggagtcccctccctgggcattgcctggaaatgaggggccgatggattgtcaggccacacacctgaggggaagggagcagtcggggcaacaccctggcaggacactggctcgggatggagggaggagggtctcagagtagcaggctcaggcagacagctcactcatccctgcctccagcgccctcgccccttacgcatcaaacttccggttaatgaacaacctccacactggggaaactgctaattaaggtggctgcactttggcttctggcttagttagctgcaacacccccagtgcccgcaggaactcttttctctctcccacagagacgcctgggaggctgagcccaggcagtcaccatggtcgggtcctgtatctccttcggactccggaggcatgggcggcgttccacctcccaccaggctgatggggcagagatacttcccctcaaagagatgcacgattttaacaggctctctgtgcaagccatactggctggatgcaacctctagggaggaggtgggcaggtggggggcagtcagggccccaccacctccctgcgcccctggagacagctcccaggctcccccactccctgcacccctagagacagtgcccagcgtctcaccagaggtgccatctcagcagcacatgacaagggcataaggtcacggcttccctagcccccaggatgcgtcccagggttggacagggctcaccctcacctaaggtttgggactcacctggtgtccactctggagtcagctgacccggcccagccctgaggtctctcctccacctgtctggctccaggacagtgatgggcattgcaggccgctctgtcaggtggcgtttctaaccttgttctatccacagaactcgtcttcaaaaaaagtttacatgacagaaccatttagaagaaaaaaagcagagaggccttggttgaggttttggtggctctgagtcagatccaccggcctgaactccaccagccctgcaccccagcagccctgtaccccatcagccctgcaccccaccagccctgcaccccatcagccctgtaccccatcagccctgcaccccacttcccaccagcattgcaccccaccggccaccagctctgcaccccacccctaccatccctgcatcccagcagccctgcaccccatcagtcgtgcaccccatcaaccctgcaccccaccagccctataccccatcagccctgtaccccatcagccctctaccccatcagccttgtaccccatcagccctataccccagcagccctgcaccccaccccccatgagccctgcaccccacaccccaccagctctgcaccccacaccccaccagctctgcaccccacaatccctgaaccccaccatccctgcaccccagcagccctgtatcccaccagcactgtaccccaccgcctaccacctctgcacccccaacccgccctatgccccaccacccttgcacccccaccaaccctgcaaccccatcacccctgtatcctccagtcagccctgtatcccaccccaccacccccacacccccaccagccctgtacccccaccagtcccacaccccccaccagccctgcactccagccccagccccctgcgcagactccgaggcatttcccaggaaccccagattccaggaagcaccgttcagaaactgcccgctctgctcatgtccgtaactcagatcttttgttaattttctcagcaacaagtgataactcaaccatttttggggagaagatactcccaggttcactgatttttctcttcgtacacttttcttttaatgattttttaattccgtgggtaaaacacgaataggttttccttggaaaagagttcaaagcagccagacaaagggaacttcccatgacggctgcccagtccctgctgcagaggaagccgggggtgcccggggatgcccctccctcctcactgctttcccacaccagagtgggggtgttgaggtcggggggagcccaggagcggaggtatgaggtgcggttccccaccctgaaagtacacaagggcctgcatgggagctgctggcctttgcaggctcgtcggcaccagcttgggtcagcagtctgggcagaggccacacagcctggacccctcaggacagtttccctggaagagaggttcctgttttcacccttgactcacagttcagaggccaagcaaacaaagtgcctgtggcaggtgcatcagcagctcacatccagggtgcccctgcctgggctcggtgccaaggcctctgggagacccctctccgtgcagcccccagggtcacggtctacaggctgtcaggcgcctgctctgaggacacctcaacctggggatgccaggggcacagctctgcccccagccactctggtagaagggccgctgaggagctccaccaggggaaagcccctcgccgtggacctccccgacctgggtgggctggcgagtggctttgcctgggagaaataaaggctctgggtgtagacacagcaggggagctggtggacccaccgcagagcccccgggcgaccaccggggccgaggacctgggttcccccgccatccctccttggggggtggggacagagggagcccccatttggctcatctggggagctcagttctttggcccttggtctggggtgacagccgggggcacccaggcccctccagctcggagctgcaccagggacgggtgcgtccggagggagcatcagcagccagtcacggtagtggcttcgcctctgcacatccagatcagggagaagagggaaaggcttccatcccacggttggctttgccgagacgtttctaaataaacgagctttgcggggcggcaggttgatgcatctggagtgtggggtctcctccagcttccggagcacacgcctcccaccgcaccgccacctccccggctctgagaggaaaactcattcatctttcaacacttcatccccggcgagaccctccgggcccatcccccaccccgaatagcctgtgtgtgtttccatagcaacctgcacgtgcctctgtgggtcacatttcatgaggccgtgagctctttgaaggcacggccttgacttgaatcattcacagggtgcagagtggacgggtgaaccatgaccctaagccagcctggggggcaggtgagccagctccctcccatgccattctctggaccatagctcatgcaccccgattgcgtcttaccgtcatttgacagacagaggccaaggcccacagaaagggggccctccccttcagcagcagggagacggcggtcatgctggcccgagacaggacgcccctcctggggagacggagctctgcagacgggaaaagccagctgcccccctgcacaccggggtgcggggcagccctgcttccttggaacaaaggctgcacttgcagaagtagctcagactttcacctgcttcaaaccctgggccgtcttctggtctcaaggccaggaggcagggcccaccgtctgctccctcctgctggatggagcctggggaagctgaggataatgggggcgtggggagggcttctgagcccccgtgctgagcagcaacaccaaccctcccagtgctggtgagaattccggagcagctggtttactccgtctggcaggcgtttccctcccaacagcaaagcatcccgggcttctagcatctaccttgtaaatatcaagggcattgcagggaagctgagctggcactggtgagctgacgtcagcaaagggtcagccccggggccgggggtgtgatggcacagctgtggcccagccctgggggcttcatcgctgctgagtacctcgcagtgcgggaatcgaaaaagcctcctccctcggcatcgagctgttcttgccccagagacatctgaacaacgagtattgtttcagatacacacaggcactatgtttcaatttttgatagtaaaaccattatttctgatgcccatttctcaccccacagaaattactggaatttatctgcattaggaaataaggaacggggaccgggcctggccagcctctattaccctgtgccttaattaattaattcattcattcttcatcaaactgtcactcctctcccaccaccttccagccaacacttggcaaagtgcaatgggacagccgtgccacgaggacgtcttctgggtgggctgtggggtcgcggggctctgacccgaagctgcacgcttgtaggagtggaagctgttaggagctgaagccagggggccttgctcaaggcctggcctcctctgtgtgacagagctatccaaggtgctgactttacctgctccccaggatgagcagctctgagggtcacccagggaagggagtgggggacagtctgaggtggaagacacagggagtgggggaagggggtgcgtgcacacaaaacagcaactccagcctcccaaaaccaccctccgctttgtgctccggggccccccattcacccccgctgcgtggtaccctcctttagggctgtgcctgcactgtgctgtgtccacactgaaatttgctcacagctggccctccacacggatctgctgttggatactctgtgttattccagcttcaattttcaaagaaaaggaggggcctttcttcatctgctcaaaaattagactcaaacccacacgtccagtgtccactcaggctccttctgcattttttccatgatctgttcccttgattgtgtcgaaggcagggggagggagaggccagcatgtaaccagactggatcacccaacggtgaaggtgatagcagcggcggcctgtctggaatgggctgccatgatgctggctgccgtcggggaggtgtagccggggctgtgcgctctgtggagctggtgggagctgggaacaggtggaagctccacccacttctgagttgacagggtgggggcccagctgtggctgcagacccaggcatctctgcactctcggaggtccaggaagcccctgcccccgctgcctggcctctccctgctcccagtgcctgctctgatttcagggcaaagttgaggctgagcccaggcactgtcacagcccgcctgggtgtactcacccttggggcagcactgacacaccagcctctgctgccctggccccccttcagactttgggcgctgacaagcatgggagggaggctgagggacactaagggcaggtcagtgtgggcctgcaggcagccttcagcacaaacagtctgggcaccgtgggcaccgtggagagcaggttaatggtggcagggggcagatgggctcctgggtggaaagcggggggtcccagtgaagcctcatcttcaggccagggctgccagttctgtggaccacagtgagaacttgtgatactttttctgggcccacccatgaccacccatggaccaatcggcatgcatgaccacccacggaccaatcagcatgcatgaccacccatggaccaatcagcatgcatgaccacccacggaccaatcagcatgcatgaccacccatggaccaatcagcatgcatgaccacccacggaccaatcagcatgcacttcctcccctctgaagcccataaaaacccagactcagccagactccagatgacaatgggtcacctgcttgcttagaggagtgacccactgcgggtcgcctctgagctgttcagtgaagctccccttcacccggtcacccccccacgtgtccacgtacctcattcttcctggtgtggaacaagaatgtggggcccaaatggcagggctgaaagagccatgacagacagggttgagacaccccccttgctcgccatgctgtgggtgatgagagggagagaagagaggagagaagagctgcggcccttcggggagcccagaccaaggagctcctagagccagggctgtgacgccatctttggggctctgcagttcctggtacctccaagcttccaggcaccaccacgttccctggtgccagctgtggaagccacttgtggtctgcctggtccagcgccagcctcacagggagccggcatgtggagctgtcctccctgccgcagccggcatgcctggctgtgcatagtgcctggaccccacgctcactcgctcacacaccgctctgcgcctggctagccctcggcaggtgtggggtccacgcgggtagcatgagccaagcccaacctcctgggccgagtgggcggaatgagcccagagggccccagcaaaccttggcaaaggtgccaccggccacagaggcttccagcaggaaaagcaacagcccaagggtcccgtgacaaagggagaagccttccagcagaggcgggagggaggcgcccaaaggcggagggatcccaccctcccacccaaaggccgaggcctgggtgctgccccctgtggcaccctaaaagcccctatgatgttgccttctcccaagacgagatcattcaactgccaagatgagctttctcagcctcccccagccccctcagcctcctacactagccccctcagcctccagaacctgctcattccaactccagggccggctccccagcctcacaggcacctggcctctgcggtgtgcccagccctgcaccagaggtagctctgcctgtgctgaagacctctgccttctgggagaaggaggttaaaataggagctcatgggaaccgaagcctggtggccgcttgggtgtgaaatgccattctcacgggttccccagagctaggggcaacatcatgtgagtctgggggtccccctcattcccctggtgtcccgacttccatcagaggagaaagaaaagtagggaggcacagatgtgaactcaggatccaaggtctgccactgccctcacgcagagggccgctttggctcggagaaagagaagggtatgacaggcaccgtccctcacctcctgtgtggctcgggggcccttgtggcctgcaggcccttcctcctgctctcaggctgtgctggtaaccgcgctcctgcctgtgtatatttttggctggggagttggcgaaggggctgtttgtctccgaggccactcctgcctcctcttgagtcagggcggagacggagccttcccaggcagaggggagcgtggagggggcttcaggagtgtggggccgaccgctttccctacagggcgcttgacctgtccagagggaccagggaagacggcggctccgggggagggaactgggaacccgagacccagaaggtgcagtgactgctctgctgggcccggactcaacactgtttacctgaaatccgtttccagttcaggaggaaacagactccgtggcaagatggtttttccactggcctctggatgctcggccttccctgataccgcagctgcagtcgccgttaaccgcaggctggagggagaccctgaccccagctccaagcccccagtgcagagccggagagccgggccccagaagctgtccctgcagcaccacctgctgggcggtgctggaagtgtcgcagcaccagcgggggctgggggcgctgccgctgggtggtgaggaccccggggtcacgcatcaggttatgaactctgactctgccatttggtcctgaccatagtctcgtcatctgtaaaatggggtcaccagcacccccaggtgtaaggaccccatctaggtccatgctggggacggtgtcgatggagagagctgggggcggggaggtggaaagagaggatgataaaccagaaaaggggggactttctgtccttatcaagatgggggtggtccatctggggacctagactctttcatggctggctcaagtccccagtggtcctggccctacagcctctggagtagggtgaactccttcgggtggcatcagggcagagggcctgggcaggaccaggaatctccccacccattttacccccagggaggtcttggccaacccgctgaaggggttggtaatctccccaacccgtgtccatgaggggttctgaggaccccctagacccatgtgtgggtaaacccttctgcacctggtgccagctggaccccagcccccgccccaccatccctgtgtggactgtcaccagccccacccctcccacaagcaggtctcaccctccctggcccagtctccctccttcccttagggctggggctgtaccccattgggtttctcctggccaatggcagacctggtcctcagctgcccagaatagcgctgggaacccttcctcctggcgctggcagcaagcaggcgagaggcaggactcagcccggggctctccccacctgactggccagcgggtttccacagcactacctgtccgtccacacagggcatctgacttggaaaggcttctctcggctgattttttttttttttttattttgagatcaagttcactctgtagcccaggatggagggcaatggtgcaatctcagctcactgcagcctccatctcccaggttcaagtgattctcctgcctcagcctcccaagtagctgggactgcaggcacccgccaccgcgcctggctaattttttgcatgtttagtcaaaacagggtttcaccacgttggccaggctggtctgaaactcctgacctcaagtgatccgcccgcctcggtctcccaaagtgctgggatgacaggtgtgagccaccacgcccagcctgaatattttttttaaaggcacaaaaaatatttaccaggccatttcttgcctccggaacctgaagaaaataaaattcactttcacatcctcagcagccaagtggccccttcagatccacctgctgaggtcatggccagccctgcccccagcagtttcccaggatgcgtggctggggggtgtccgatcacaaaccgcgggaactttattttcaaggctgctgcctggcccgggggcttcggttccaccacatgggccagtttatcaccagccagctctgcctcgcttctttttattgtgttttgtttccttagcagtaaaatcattgacttacttgtctgggtttttttaattgcaaaacgaatgcatgatgcctgtaaccatgtcaaataaagagttatgcacagaattagaatgagaaagtctctgtctcacacctcccctcgcaccacctgctggggttggaggtgggaaaggtgctcccaccgactccggcagccaggatcactcaggggactgggatgcggagagagctcggggatagggcctaggagtcactgggccccaccaaccacccaggcacctgtccgagcctcagcgtccttgcagtgctgggcctgagtcggcctcctggcggctgggagctggggagcctggctccccaggatggtcaggactttttgggagcaggaagacaatagcccaggaaagctcactgggccttcatcctcacggaccactacaggcagggcccacagccgagaggtgcagagaagagcaagccagtgccgcccaggctgcaaccctgaccccactccatgcaccgtcctcccccagtgtccaaaccccccaaaactcacagaggctacatcgtaggcaccaccatggaaaggaggcctgtttccagggaaccctctaccgccacccccccaaccccaaccccaacctcacccccactcctttcgtcacctccaccccccaccacccatccctacactctcggtggctctcagtggcagccacatcaagaacaaacccactgggtctccgggataccccgtaacaggtggaattctgagaggtgggtggggtgggcattctggggctgaacttggatgagcgaaggcccggggcagggagatagaggcggccatgtgcgggacaaggatgtcaccgtgattcagaaaggctttggggccgacatgcagtaatagggccagggtcacctcctgcctggacaacaacagacggaatatctgcagccacagtgttagaggcctgggacgtcggcagcagagctccacagcccccaagaggacgagccctccagctgctgcagcttcttcctggtgcagtcctgggttgacgggaccgacctcggagtctgaggaagccaaggtgcctggtagagagggagagaagggagctgctccgacacggagcctctgggatctcctctgcacaccctgggcggacgcggcccaggccaggaaaaggcccatctagaggagtccgaggagcaaccccgtgttcccacagggccgggagagggcctctttcccagccagcctggaaaacctcgaaatccatgggattgttgggggagaactcagaagggagacgctgggcagtctcagctggggaataattaggatgaacaaacctgaaacacaaaaacccctaaaatcaaattattgtgagtaacacatcaccccataacaaatgtcaaaaaccaggactaaccaaattattgtgaattaaaattcacaacttatggcattaaatcaaagattaccaggcatgcacagaaatagaaaaacgtggcccccaaatcaattgattgaaactgaccccaaactgatgtagatgtagaggtaatagacaaggatatttcaaatgttatcagaggttgggtgtggtggctcatccctgtaatcccagcactttgggaggccaaggtgggtggatcacttgaggtcacaagttagagactagcctgcccaacatcgcaaaaccctgtctctactaaaaatacaaaaaattagccaggtatggtggcaggcgcctgtgatcccagctactcaggaggctgaggcaggagaatcgcttgaacccgggaggcaaaggttggagtgagccaacatcacaccactgcactccagcctgggcaacaaagtgagactccgtctcaaaacaacaaaaaaaagttatcagaactgtgtttaatttatgcaaaaagttaagtagagacatggaaaatatagaaaagatccaaatataaagtataacttccagagacgaaaaccaaggtacctgagacacgaacacactgtgcaggatcgatggcagatggaagctgcagaagaaaagaggagggaagttccagcaatagaaaaggtccacagtgaaacacggggacaaaagaatttttaagaaattaaaagaccatcaatgatcagtgagacaacataaagtgggcaaatatatatgtaattgctgtgcccaaaggaggagagacagaaaaaatatttgaaaaaacatgtccccaaatattccaaattttatgaaaacaacaagcccacaaagccaagttcaatcaccccaagtacaagacacagatgatgaaaaccacgcagagatgcatcatcattaaattgttcaaaattagtggaaaagggaaatctggcaaagtcaggaaaggtaatcaataaagcagccaggaaaaaaaaatagacactttagacagaggagaataaaggacaacagcaggttcatcctcagaaacaacgtgagcagaaaggttttggagcaatagccttaaaagtcgacctagaattctatacccagcaaaactatccttcacaaacgaagacaagccttccagcctgggctcaatgaagagagttgaaaagaccatcacgcccatgcttacaatgaaggaaacatgggaaagcctggaaatgcgcaccttctggaacttatcagaaagctcagctctcagccaaccactcattccaaatctgtggagatacagtgaccaggctctggatgcaagacacaggacccgagcctttggttgcctggcacacactgctggatgctgaataagccaggaagaagatccggctaaatgttggcacattctaaagtctacgtgaggccagtctgaccctgggaacctccatgaagacatgggcgtggagggtctgccttttgcagggcccaccaggggctcacaggaaaggtcgtggaaaattacaagaaatcttccctctggcactagcgggtgaggggaatggaagccaccgccagacagcaccatctcctcaccctcctgtgaagcacaagactcacttgcagagggaagagcgcagaaaccgtcaccccaggacgctgcggttgaacgagaggaagcgagaatggagaagccctggccctggggaacaggatggaaaacgcttggctcagctccgtggctgcgaaggaaccggcgcgctcgcggaggccacaccccgagacccgaggacacagtgcctgcctgagatggagccagaaacattctccaccctttcacgcaagactaacaagggctccatgaaaataaaactggaagagctgaaagagaagcattctccctgggtgtgaaaccaagaaaagacacaaagccaaggaaaagccattgagaaaacacctggcacacggcctatcccctaaacacagaagataaccatagaaacaacctcaaaccaagtccaagtcctgacttcattgataaaacctccacaccaaagacctagagaaggaagggcaggtcatcaccaagcataaagccgctcatggcaatatctactttcctccacaaaatgcctgccttcctgtaaaaaattataagacatgtgaaaagcaggaacaaacacactcccaagaggcaaaataatcatctaaaccagaattgggcatgacactgatgttgggactatcaggcagggaacttaaataaccttgagtagtatgttaagggctctaacggaaaacgtagacgatgtacaagatgagatgagtaatttcctcagggagatggaaacgataagaaagaaccagatggaaagacgtcaaaccaggctacagagatgaaaaatgcttttgatggggcagtagacgcaacacagtggaggaaagggtcagtgaacatgagaatagatcaatacctaataaccaacacacacacatgcacgcacgtgcacgcccacacacgcacacccacacatgcacaaacatgcactcacatgcacaccacacatgcacaaacttgtgcacacacatgcacacgcacatgcacacccgcacacgcacgtgcatgcccacacacgcacacacatatgcacacacaggcacacacatgcacacccacacacgcacatatatgcacatgcatgtgcacgcccacacacatgcatacacacatgcacgcccacacacgcatatatgcacatgcatgtgcatgcccacacatgcacatgcacacatatccacacacccacatatatgtgcatgtccacacacaaatacatatgtgcatgcacacacaagtacacaccatgcacgtgcacgcccacacatgcacacacgtacgtacgcacacacatgcacgcacatgtacaaacgtgcacaaacatacatatgcatgcatatgcacagtcacaggtgcacgtgcaagacccgatgcgcatacatgcacacgtgcacaaacaggcacacacacgcacgtgcacacacccacccacacatgtatgcacatacaagcacaaacacgtgcatgcccacacacacatgcacacacacgtacacacacacacgcgcacacacacgcccccacacacacatatgcacatgcacgtgcatgcccacacacgcaaacacgctaatcacacacatgcacaagcacatacgtgcccacacacatacacaggcgcatgcacacacacacacatacacgtgcacacacgtgcatgcccacacacacacacacacgcacatgtacacacagcagggaggggaaggcagagcatccaagaacagaaggaaaagagaaaatagggaagagccatttggagaataatggctgtatctttttcaaaattaatgacaagcactaagccacacatctaaaaaacttaacactaagtagggcaaataccaaaaataactgcccctaggcatatcaaattcaaacttttgaaaactaaaggcaaaggtagccctggcgcagtggctcacacctgtaatcccagcactttgggaggccgaggagggtggatcacttgaggtcaggagttcgagaccagcctgcccaacatggcaaaaccccatctactaaaaagacaaaaattagcctgatgtggtggtgcacgcctgtaatcccagctactcaggaggctgaggcacgagaattgcttgaacccaggaggcagaggctgcagtgagctgagatttcaccactgcactccagcctgggtgacagagccagactccatctcaaaaaaagaaaaaaagaaagccaaaggcaaagtagaactcctggaggcatccattggcctgggagtgcgggtgtggtggggacacaatatctatagaggaacaggatctaagaatcacagctgacttcttgtcataaatcactcaaggaagcagacaatggagtaacacctttaaattactgagaaacaaaacaaaactgtcaacccagaattcattcgccagtaaaactatccaccaaatctgaaggattcagtctttctctggcaaacaaaacccgagggaacgcgtggccctcagatctactcgacaagaaatgctgaaggaattcttcgggcagaggcagcagcttggctctacacaaagcaatgaagagtgttggaaattgagtaaaataattcaaaataaagtttactttttcttacttttacttgctctaaaatataattaactgtctaaagcaaaaaacagaagcaaagtattttgtgtttatagcacctataaatgtaaaatatgcaataattcccaatattgcaaaggatgtgaaggaggacctgagactgttcaattactccaagagaagattaaaaaaaaaaaaagaggcaagaagaaaccgagccaaatggaacaaatacaaaatagctagcaagatggtggattttaatccaaccatatcaataatcactataaatgtgagtgaactaaaagcaccagttaaaaatagattgtcggattggattttaggaaacaatatctaactatggtgtgtgaaaaaaagtcaccttcagtataaagacaaagataggtaaaaagctgaaagatggaaaaagatacactatataaacactaagccaaagaaacctggagtaactctgttaacatcaggaataagtagcttcagaacaaaggatattatcagggataaagaggaacacttacctcatgataaaaaggtcagttctccaagaagacataaccatcctaaatgtgtagtcagctcataacagagtctcaaaatacatgaagtaaacactgagagaattaaaaggagaacctgggaaatccacagttatagctggaaacgtcagcactcccccagcagtcactgatggaacacttaggtagaaaatcagtaacatcttggccaacatggtgaaaccccatctctattaaatacaaaaaattagccaggtgtggtggtgggcacctgtgatcccagctactcgggaggctgaggcaggggaatcgcttgaacccaggaggcagaggttgcagtgagctcagatggtgccactgcactccagcctggaagacagagcgagactcaaaaaaaaaaaaagaagaagaagaagaagaaaagaatatcagtcacaatacacatgaccttaacaacctcaactaattggaactaactgacatgtataaaacaaaataacacacagagacccagcagcaccttcctctcagatgcacatggagattcaccaagatagcctatattctgaccataaaacaaactttaaaatttaaaagaatagaaatcatacaaagtatggtcttagaacataaagaaattaaactagaattaaataacgatatgtgtgaagtctcacaaatatttggaaattgaatagcacactctaaaataatccatgaaagagcaagtctcaagaaaaatttgaaaatattttgaactgaaatgaaaatgtaaagaataacatcaaaatttgtggtaggtaggtaaagctgtgcttagaggaaaatttatagtattaaattattagaaaaagaagaaatatttcaaataagtaacccaaacttctacctaaagaaactaaagatgaagagaaaattaaacgtaaagaaagcagaaggaaggaagtaataaagattacagaaaaaatcaatgaaattgaaaacaaagtcaaccaaaccaaaatctggttctttgaaaaaataaaattgataaaccttagacagactgagcaataaaaaaaaaaagaaagaagaaggctggacaaggtggctcacgcctgtaatcccagcactgagggaggccaagacagggggatcacttgaggccaggagttcaagaccagcctgaccaacatggtgtaacctcgtctctactaaaaatacaaaaattagccggacgtggtggcaggcacctgtgaccgcagctactcgggaggctgaggcaggagaatcgcttggacccgggagacagaggttgcagtgagctgagatcacaccattgcactccagcctgggcaacagagtgagacggttgcaaaaagaagatgcaaattatatcaggaacaaaagagggggacctcactctcaatactagttattaaaggaacaataaaaaaatactagggacaactctacacccaggttcaacaacttaagtggactaattccttgaaagacacaaactaccaaaactcttccgaggtagtcctatgcctattaaataaattgaatttgtagttaaaagcctttcaaaaaagaaaattttaggctcctatggttccactggtaaattctaacaaacgtgtaaggaaagagtaacccactgggaagttcgaacagacatataaggaaggggtaatgccagtgttacacaatcaggttcaggaaagaggagtcgttgtgtatctgttgctgagtaacaaattgtgctaaaacatagtggcttaaaaataatgataaccatttatcgtctcagtttctgcagctcaggagtcggacggcacgcagccgatctccactcccaacgtgcagggcctctgccataagccttgaaggcactcattcactcacgcatcgggggctagtacaggctgtgacagaggcctgagctggaactgttgaccaggacacacacatggccatgtggcctctgggcttcctcacagcatggtgtctggattccaggagttggcatcctgagaaacaaccatgcagaagcagccctatggatcctggcctggccttggagtcaggcagtgtcactcctgtgccttctaacctgggcccccgggcccaaggggaggaaatggagaccccacctcccagtggagggaaggcaaggtcccactgtgggggtagcacatgggatacacccatgtggctgccgctggagacgttagtttgccacacccgtttcttctacgtgaacatttgcctgcatctcaccttctaactcctgggtgctgtttgtccattttcactacaccaggggcccccacagtatatgcagaccaggtttcctggcctcagagtcctggcaggacccgtctgaggggaaggtccaggttggtccccgggcagacagacagtcctctgagcagcgcccacatccccacggaggccacagcacccagcctgccacttaaagaggcccctcaggttccctctggcctagcctgcactgtggagggtgggggtctcacaagcacagaaggaagaacacaggtgtggcccacagacctccacctcctggctacatcttgagggctgagcaggggctggggggcactggggcctgtggctcctcccaaacccctacaggggctcctccatgctcccctcactctgccctcctcagattcagcgctcctcagggcagcccaggcaaagcccgccacccctgagaaggcacagggttgcggaagcacctgcctccacacacacactctccagccacgctggcctgtgctggatcctgggacctcacccattcacctatggcaggaagtgaccccatcttgggtagtgaccatctggggctggtgttgtgtgggccataaaaagaatttaccaaaacagttgtaggtaaagaaaggcagatttattagagaaagtagaaaatgtgcatagcacagaagcaacgggcaggtcagcaagggaggagccgaagcaaggggcaggtcagcaagggaggagccgaagcaaggggcaggtcagcaagggaggagccgaagcaaggggcaggtcagcaagggaggagccgaagcaaggggcaggtcagcaagggaggagccactgcaaagaaatgagggcttgctggggatgttataggacggcgcctgtgctgtgtgctggagagggccacaggcagtactgataacgccaaggttgcagtcagctaacatccattctcctatcagccaagggtctggcaatagccgggcacaggaagattgtgagttatttcttcaggagggctgtgtgtcctggacagtgaagaagggcagacttaaagcttctttgcttcttctttttgccttccctctgtcctgccagcccgactccttttccctcattaggattccacaccccccacccccacatgtcagggcacagccgggctgaccagctccacccgctctgctgggccctcactgagtctcagtcttctcatgtgtgacacaggcaaggtgaacatggtggacatgtgtcaggcgggcgcctgggcctagaggaggaaggagcagggccattgtgggggcgcaggctgggcctggctcctggggcctgggcccagctcctggggcctgggcccagaggaggaaggagcagggccggtgtgggggcgcaggctgggcctggctcctggggcctggacctagaggaggaaggagcagggccggtgtgggggcgcaggctgggcctggctcctggggcctgggcccagaggaggaaggagcagggccggtgtgggggcgcaggctgggcctggctcctggggcctggacctagaggaggaaggagcagggccggtgtggaggtgcaggctgggcctggctcctggggcaataattgctgtgggcggggagtgccagggctgggccatggccccctaggctctctgtgcacagccccccagtaggcccgtgggacttgcaggctctcagcaaatctcccgtcagaagctggtggctgcaggtttgacaccccgtcgtcccatggagttagcgagcacccattctgcacctgctgtgtacgcggcaggatccgggaggcagtgccagccctcagggaggacggaagggtggatggatgcgtggtggctgctcccggctgcagggagcatacagcacaggcggactggacaccagctgaatagcctgtcctgcgctgtgctggggtgcaagggaatgagccacgtcagccccgacccaagtggagctgaccagggctgcgtccatgaaatgatggaggagccaggtgtggtcagaatttgccagggaacagtgaccctccaagagggccgctcagggaagcttcatagaggaagcagcgcttgggcgaggacttggggttgggggagggccaggaaggggagctgcgtccttccaagacaagggggctggagggctcggtgggagcagaggcggggccgctccatgagctacacagcaccaagtctgcgcctgggtggtctcaggtcccagagcctccctctggcagggcaggcaatgaggcaggtggcccatccggggatcactgcctgagcaaccagcaggatttggtctccggccagcagcagggaggaagttaacataaatccattccaatgcaaatgtcaaaccaaccgtgcgcaggaaaacttagcagctctgaatgtcaaggagggagtcccggctctagctggtggcgcggcttggctgagctgtttcctccagctcctgggctgtgggaggaggctgctggcgtgcggccactgcctggcgcagaggggctgccaggacctttgagaactgaggcacacccgggagatgatctggggactcgtcgctggagggaaggagccccagcaaacacagcccagtccagggactcttgtctgcatagcctctgagacacgcgggagctggtgcgcccagggggcctccccttgagaccagggctgctgatgacagagccaggatgcagagcagaaggcaaatcctgcagcggcaggatggcatctgagccaaggctgaggaagcagcaccagaattcgccatcaggccgggaaaaggcggaggcgctggtgggcctcagtcccccggacaccacctggctgcattatgagagatctcctgtttggacaggggagggtctggggccaccgcctgggtgtggtgcccggggtcctgagtccaggcgggggctccaccctgaggcgtgcgtgggtgacgggctcccaagacatgaccacgctgggtgtgaagacaaggccacgtgaggccggaggacagtgcaggccaaaccgaggccaagcgaccactcctcatgaggctgcagggaccaacccggcacgcagagaggcacgaggtgacatccgaggcagggagcacatccagggccacgaaggatggcattgcggagagaccgggcgccgtgtgctctccaccctcagagccacccccagaccctgctcgcccttcagtccccctccagcaggtgcggcctcacctctttccctgcccccactgcatgcagcaggtgctccataggtgctcctgctcatgtgagaggctggtgcagctccctctctctgctggctgacggcagacccaggggtccccgcccagggtcactccaggcaggaggcgacactcggcacagtccttgtctcctgagatgaactcttgagatgaaccattttccttttaaattgaaaaagaaatgaagtgttttgcattttattaaagcagacacggctgcagccgggtagggctcccaaggactcagccaagcttgggtgctgggactttccggtggtcactgtcagagaatccccaagcctggggacatggccccggctggagggaaggagggggagcggatggaaacagaaccaacacccgcaggacgcagctccaggcaggggacggggggcggtgtagggggcactggttcagggtaactggggggctccaaggaggaggcggggctggaggtggactgggaggggccaggaagttcaggaaggttctagaagagagtagagagggaagaaggcaggtatggggatggcatagagagccgccctcggagggtcccagtgctgctgggattttcccgtgggccatgcagacttcagggcaaggagcaccacagttggggggtccgcgggcagcagccatgagggaggaggcggccggggctgcaggaggaggtgcgggcccagtggaggggaggggctgcaggaggaggtgcgggcctggccgggtggaggggctgcaggaggtcctggacagacaagctcacaggagcaagtgcggaagcccagctctgtacacacggaagaagcttccggttagaatccttaaaccggcagcttgtgggttggtctgagaagatccaggtgcttacaactggtgtgtgtcttaggggctcctcctcagtgaactcctgttccgcctttgagagcacctgggtctctcagtggtgtggacatctgaggttggtggttggggcaggtgggtgctggaaggtgagaggtgcctgttgtctgcccctcagggacccctggtgacctggtggttctgagtcctgccaggagtggggaccgcgggcggccagactccgggttctgcccacagactggctatttccctgggcccccttgttctacttttgggcctcagtttccaattcttcaaaccagcaggttgatgctgtgggcccttcctacagcacagtggtaccgccccagagccaggggaaggaggcgaggagggtgtggaccaggcgcagggctgtgtggggtcagctcccgggtgtggaaggtgatggaggggcagagagtgaggagcaggagctgaccgggacaggggctggagcggggctgtgctggcatgtccacactggacacaggatgaggccatctgggaagtgccagaaggtgattccaagacctccaggccatgaaggatgagggagccctggaatccccggcccagcgcccaggcctcagtatgctcaaaactgacaaagttcttatagctgctaagcccagttttgggccccaaggagatgaccatgggcttgtcaaggtcccctctgctggccaagacccagcccaggaggaagagggctctgcccttgtcgtttgtttaaattgtgaaatacacagcataaaatgtaccatcatcaccatttaaagcatgaagttcagtggtttaagtacagcacattcccactgttgtgtgaactttgccaccgtccatctccaggactttcatcttcccaaactgagactctgcccccattaaacactcacccccatttctccttcccagcccctggcacccacctcctaccatccgtctctgaacccggctactctaacacctcctagaggtggaatcgtcctaccatccgtctctctgaatctgaatccggctactctaatacatcctacaggtagaattgtacagtgtttgcccttttgcgaccggcttatttcactttgtaaaatgtcctcaaggttgtcagtgttgtggcctgtgtcaggatttctctcctcctgaggctgagtaaattccatggcacagatggaccacgctggctcatcctcctgggctgcctctgcctctcgtgaatgacgctgctgcctacctgggtgtgcacgtctcggccagaccccgcgttcaggtgttgggggcctgtgccccgacgtggggttgctgggtcgtctggtaattttatgcggaatgtttggaggagccgctgcctgtgtgttctctgcagcggctgcgccatgtcacctccccatcagcagcgctgggctcccgcgtctgcacgcgctcaccacgcttgttcctgcctttctttccacagctgtcccatggccaggtgtgtttgttaagtaggactcagccctgcacccagagcaccctccctcaagtgctcatcctgccccccaccctgtctggcggcgggcccccagctccagccacggtctcctcccaggcatcggaacttcccggaagccagtttgccctcccagtccaagttaacgtgccctgggaagcccattcagacccagagccaaaactgggtcaccatgggatgctgggtgtgcatggcgagctccgggtcctcccacagctccagttctgaggggcccacaccagctgccctctgctcctccgtcaggaatgggccccgaagctagccaggatggtcaagagaggtcttccagagcaccctgctgagcagtgccaggctggagggacgctggctgaagggcgccagccgggcacccacccgccacctcgggctgatggagagatgacccgccctggccctgtcctcgttggcgatggatgcccctagggacagcggcgtgaagctctgccccactgtgccctcccccagtcaccatccgtgcacagcccagcaatggcccggggcagctgccctggggggccccgcacgtccctagcgccctcctcccagcacaagtgccccgagtcttgagcaggcgtttctgttcgcctgtccctctccggagcagcaggcggtgacctgttgaattctgtaattcctgcgctgggtctgggcttcaggctccgtgagcccaggctcctgttggactcagtctgtgggaggtcttggggcgagcgcctgtttggtgaatgatgaatgagtgaatgaatgagtgaatgagtgaattcgtgcagccacctgctgcaatgtctctgggcctgttttcaggcctgtcataatcaggggcagagccaattctgagaatttaggtcacaattctaatcccacgtgtccttgggcctccaggtgctggccaacccctgcataccaggggtgctggtgtccaggtggctgctgtggcctcagcagagggcaggcaaggagcgggccagggggactggacagcccgaggccaccaggccaggacagagtccaggctacagccgactgaagccatggaacggcccctcccggttcggccccacaggagcccccacccaggagccaggagccaggcctagagagcctgggatctgtgtgcctgtccagcttcacccgccttgctcgcggaagggcacacacagagggacggggactaacgcatgcacctccgtggtgtgcccagagctgcggccgtggcctccctgtggggcaaagccaggttgtctcaactcagctgtaggtttagccgagcagttcccgcccagggtgcaggtcgggtgggcctttcagggcctcggctgccaggtgtagtgggtgcccacggggaggagtgggtgcccacagggaggagcgggtgcccacggggaggagcgggtgcccatggggttctcctctgggtgagccctgcaaccaggcaggcttcctaggcttggccaccagctggggggtgtggggtctgtccctggagggggccgtggggtccatccctggaggggtgtggggtccatccttggagggggccgtggggtctgtccctggagggggctgtggggtccgtcccgagaggggagcgtggggtccatccccagtgagacccctgcaggcccagctcatggtggggctccgcactctctggctggccctggacaggggactcttgagttcccctggagaccctttgggcagatgggccccccaccatgcttcccatcaccacgttgaccatggccccctctagcccttctcagaccctcacacgtgcctctgtccccgtgtccccttcagactggagcattcgggggctcctgcaaatgcccctttgtgagtgaacccgcaggtgtggggaagcgcccagcagccctcatggaactcgggatcacggcaggaagggggcaacgtggatggacacctgcaccctgtgtgggggtataaatcaccctacagggcgctcgtcacctggccagccaggtaggatgtcaagatcgccacggagccccccagctgagggcctcagcgagcgtggggaacaggagggcttgtccagaggccagagatgagcagaggaagatttgggcagggagtgggggcagggagacagacaagcagacgggggccaggccaacaacaggaggtacccaagtggacacatggtgaccggcgatcctgcccgggcgagctgatggaccacaggtgccccagcggcaggcccaggccccagcatctttctgggtggctgcaggcctcagaggggagggagagctcggcgccccaagagagagcccagggaccacagcagccccacagcggcccctcctctggccagagccctaggacccagccgcccctgctcctcactcactgtggcccccagccccactgtttcacaacaccccagctcgttcgtgccctgaggagagggaccatccgtccccacacccggtccacagcaccgcacccgactcagccccagcatcgaccagaagtccccggccctcagaccggccgcccagagacagtgggagtgaggaggccacacaccgtccaggttgaatcactgcgttttactgagtgcacaggtccacctggcgtccgaactcgtccccgtggcagcagggatccccagaaccttccacggccatcgcggccgcaggaccccacacccgaagtcccccgcaaacccgcactggcgcattcttacggctctggcatcaacctgtccgtgtgagtaagttaatatctcagctaatctgttagaaaactagagttcattccctgggcgtctatccctagaaaatggacggtgcacaaagttgagattgaagtgtgcggggtaacacatccaccaaaaaaaggcctggtcactacggcacaaggacacatacaaaatggtcagaagtgtacgtcggtactgaaggcattatgaaatgttctttggagcatgaacaaaagtgcagacagccagaggcaacggcgcaaatggggaagctgcagccaccgtcacggccagaggatggcagactgcaatggcgtggggcgcgggcatggcgggcacacgtgggccgtgtggatcccgggcagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcctgcctggtagccccggggaccggcccctccttgctggcgcctggccgagagtcagacgctgaggacctctcaggacggggcccctggccagagccagtctcctcggccagccaggggcaccacggcaagtgtccaagcccagagcacactcaactccaccccacaaacgccttttaaaactctgaagaggcccctccatcccaaatggtcccctcccgtctctcctcctccaccgttgcccacaacctcccccggcgatgtcacctcctcccagggtcggccgtcagcccccacccttacaagacggcaaagttcagcaaactggaacccccattcactcatgctcccgggtcatggaaagctcctgggtgtgcagcttctctaggtctcccggagggacaggaacctgcgtattccctcgaccccggagtccaccatcccacatccttcaggaagccgccctggctgtctctccggctgcttagcgctttgctggggccgaggtggagactgcgcgctgggtgggaatgcaggatggctgcccggcacagccacacaggctccccaggcggccattccgtcctgcagcccctaaaggccctgaccaggcctcttcacgccacccccatgccctggacatacgtgcatgtgacctgggagttctgcatgggtgtgggggttgggggaggcaccggacaggatcagaggacactgggggcacccgtgcactgagcacccacccctcagagctcagccccctgctgggcaccctccacagcaggtccaagcctcgtgagctgtccctctcacaccacgtctgctgggcaccctccatggcaggtccaagccttgtgaaccgtccctctcacacgtctgccgggcaccctccaccaggtccaagcctcgtgagccatccctctcataccacgtctgctgggcaccctccacggcaggtccaagcctcatgagccatctctctcccaccacatctgccgggcaccctccatggcaggtccaagccctgtgaaccatccctctcacaccacgtctgccgggcaccctccatggcaggtccaagccctgtgagccgtccctctcacaccacgtctgctgggcaccctccaccaggtccaagtctcgtgagccgttcctctcacaccacgtctgctgggcaccctccacagcaggtccaagcctcgtgagccgtccctctcacgccacgtctgccgggcaccctccacggcaggtccgagctttgtgaaccgtccctctcacgtctgctttgagggtttgtgtcaatggggctgtgcagcatcaacctgtgatcttgccaatgccccagcctctgctctgtacggcattcatagctcaggagggcggggacaagggcgtttctgcaaagctctcacagctccttctgctcctcggcttctgggaagcaactagaaatagctgagagcccagctctttctagagagaagggggtgtcctttatgggggtccctgactgtgggggaccgagcccagctggagtcctcctccccttctctccggcagcaggtctctctggcagcagggtctggaatctagaaacactgagacctccagccccgaagggggcaaacattaaaccacacgccctggctgtgcctctcctccgggcgggacttggggtgatcagacccacagctcaaagggtgccccctggagaagccctcacagtgcctggggtgatttcagcctccaagggggggcttgagacgaggccccccaaaaggtaggggcatcgctgaggggcagcgtgtcctccggtggggggtgttgggcacctgccctgctcagacggctgtgtgcaggaggcatgggaggagccctcccccagcgtgtcccagccgtggtggcagctggaagactcacggactgtgattttatgcagagggagaaggagaagctgggccaggaaaccacaacaggcagcagcacctgcctgggctggggcctgggattcgaggctgagccacccatcccaggagggcccagcacctccagggcagaccaaacacaggacccaaccggacacccatacagacaccggggcaccttggcatctggtagagcccctcctctggatggctgccaggctgtgggagggaagggcagcacgagaccctgattgggctctgcctggcgctctgccactgcggaccaggagcccggacagtcggataccccacgacggcgcttgacattccagcatcaccacgacccctaaagccacaattactccttgtagcccctccccaggcagcttacactcagcagggtcaaagagaaagaccagagacagaagggctccaaggctggaagtgcgaggagtgtgcatgcacgcgtgtgtgtgtgcatgtgtgcagtgtgctctgtgcacttgtgtgtgctgtgtggtctgtgcacctgtgtgcatgtgctgtgtggcctatgcactttgtgtgtgcatgtgttagtgctgtgtgtggtctgtgcacttgtgtatgtgtatactgtgtgtgagctacacgtgtgtgcatgtgtgtgatctgtgcacgtgtacatgtaagcgtgcatgtgtatgcctgtatgcaggcatgtgtatgcacgtatgtgtactgtgcatggtctatacaggtgtggtcagtgcacatgtgtgctatgtggtctgtgtgcatgtgtgcaagcgtgcatgtgtacgcctgtatgcggacatgtatgtgagcacgtgtgtgtgccagtgggcacgtagggatgtgcactctaacaaacactgcgggagctctttgccataaggtggcactggtccttggccacgctcattcacgcagacacccgaggcagcgccgcaccacctccagcctccttcccgctgcacttctctgaggtggggcagtaggtggctgcactgctcaggctagagtctgggggggcccaagacagaccctctacccctttgtctcccaaaacagggccccgcaaccatcccaggacgtgcaccttccctcttcccagggcccagagacttcccaggggacacaccacacgttccttgctggacatgagtctggcctcagtccctcctgctgggcggccagcttctgggagggaagggattggcctgtcttcctcatcctgcagagccccaacctgtgcccaggtgctcatgcctcagcggccccatgggaggaaagagcaggcggggcctcacctcgggggaggaaagagcaggtggggccatactgggagggaggaaagagcaggtggggtcacacctcggcaggggaggaaagaacaggtggggccacaccttggggggggaggaaagagcaggtggggccatactggtgggggaggaaagagcaggcggggccacacctggcgggggaggaaagagcaggcggggtcacacctgcagggggacacacagcacagcctccctccactgccaggtctcccttctccagggtcctggagtccaggtagctgagacggaactggggacacggggagcggtggccggggctggtgctgcgttgggtgggacgcactcatacccctgcctgtgggccccgctatggattccctgccccatgacgggacggcaaagggacatggaccccaggctcgagccagcccaagggagacagcaagggcaccgccgtgaaacgctgcccccaaaacacgtagcgatgcccacaccagaagggatgcttcatgccaccgcagggcccgaggccacacacgctgcctttgggaacagagcagacaggcagtgggagcctggacagtggcttccgaggcctcccagttggcacctttttgggacaggctccagcacagggaggggtgaggagacagcccagcggaggcacctcaatggcgacagggcctgggagtgccctggccgggctgggggtaggcagagaggccagggcagcagctccccacaatggacgccagacatggctccccgaacaccctgagcgccaggacccccaccagccaggggcgtacgaccctcaaatgctgctttcaaagtcctctccctcaggactggttcccctgctggcctcagggcctcaggacctcccagccaagccaagtgcactgaaaacgcaggtggaggagaaacgggcccaggactcccctgcacttgctctgcaggagtatttgcgcccacgaccccagccctgctcactcccagggaggccactctccagggagcccaggcccgcctgcgacgccgtcacgccaaatgccagatgctcccggggtctggttcttaagtctggagctagggactcgctcccgcattagagccgcctgccccaagggccacggtgcccacaacaggacgggcatgggacggtgcacccgaggcccgagaccccaagaggccccgctaaggaatcggtcagtggagaaggggccatcagctccagggggcaggagagctagggagggcgcacagctgggctgaggtgggagtggtttcctccggaaaggcggggagggcggccctgtgctgacggtggaggctatcctggcccgctgcatcatggcccagccctgccccaggtctgtcggggcactggtgggacacaggcgaggtggggccctggctaagaactgtgaggcctgctcaccaggtgggtctcgcagtgccggcacccggccagggcagtcaggagagaggggaggacttggggtcctgcccccccggtctccaaggctggggtgctgctggctctcacgcacccacagaaaggccagggcgaggcagctggagcccccaaggaccccctttttgaagaccctttggagccggctccctggccccaccgtgagccaggccctccctctggaggccaagaccagagggctggacgtccactctggctccagtttggttcccaggccccacccgctcctcggctgcaggcgaaggtctccacctcggggctggcttccatggaaagagccctcagatcccagaaggtacagggagaagacgccaaccaatagctctgtatttgggcgcccctgaggtggggaacaggaaagcccgccgggcaggtcaggtgtgaaggcagaggccacgcacagcggccggccacacccgcctgtagctgcccggaaaccccaccgggacccaaggccgcaggtcctcaccaaacaggcccgccctttgcgcaggtcctcagggaacaggcctgccctttgtgcctcccctgggctcggctgagacaaccccccgcctgttgccacgctggcaacaccccgtcatcactcccgcccctcctcacaccgggctgatgtcggccgcggccctgagcagagtggacagggcagccttgctcctgcacgctgctcctggagccacagggccctgcccagccctccagcccctgttggaaaataacttttgtaaaaggtcactgccaggagcccccatccttcagcccacatgggcccctccagggcccacccttcccgccacactcagttactgtaagaaaagggccccagagggttcccgcctcaaaacctcggaggcaccgtgctgaggagggccgcgggcgggtccactggcccagcgccgcctcacttcctgggcccggcccagcccacgtcaccaaagggaccctcgccggtggccgagcgtggcgggggcccgcacggggtacagaggtcggagtcggtgtctgactctccctccgcaatgtagggcctgactttggcacaaggcgccacggccgcgtagcagctgttgagagcatccaggttctccttggactgggagatgctgaagccgctgaaggaacgctccagctcctcgtggtccacggacgggatggagatggacgtgtcgctgtcccgcaggttcccctcggggggcctgcagcccggggtgtcctcctgccgcaggaactccatgctggcgcggttgcccccgccgtaggcggacagcgaccgctcgtgggcaggcggcggcgggatgcgcaccagggagccgtggtcccccacgggggaggtgccgtggccctggcgcgggtggctctgtggctgccaggaggtggagggcggacactggacagggggcgcggccgggggcgccgagaagttcttctggcccgtggagctgctggagcgcacgatcttgacaatgcagccgtgcctgtcgacatgctcccggctgtcttccgggctgtggtacggcggcgccggctccggctctttggccccaaagtaggcctcggtctctgtcggggggatgcccatccgctgcatgtagatattcaccaggaagtccagcttcttctccatggacaagacctgcaaaaggggctgctgggctggggtgcgagggcccgtcccaggagatgtggggacccaggctgctcccaggaaatgggggggcccaggctggttccaggaaacaggagagacccaggctagtcccaggaaacgggggacccaggctagtcccaggagatgtggggacccgggctgctcccaggaaatgggggggcccaggctggttccaggaaacaggagagacccaggctagtcccaggaaatgggggacccaggctagtcccaggaaatgggggggacccaggctggtcctaggagatggggggacctggaccactcccaggaagtcggtcgacttgggctggtcccaggaggtggggggacctgggttgctccctggagaggtacagggaggggggatccctgctccctggaagctggaggagcgggaagaggaggcccaggagcagctcttcctccttcccagacccctaggggcaaagcctccagctccacggttggggcgtgtgttcagagccaggccctcctgctgcccaccgtggaacccccttcaggaaagccccacagggcaggacctggcagttccttactcactgctcaggcccggctctcagaagcaggccccaaaacaagggtcctctgcggtggttcctgagaatgcacccccagaagacagcggccagggtgtcgggcaaggaggacagagaggaggaaggccaggcaggtacaacttccggcacgttccacaaggaacccctgagggatccacctctcagcagcccccacccaggactcctggggactttggcccttgggtactgtcaggagggaaggcacccaggccgggggtgggaggctcacggtggggtgtgaggggtctgcacagagcagctgtcagtggtgacagggccatgtaaaccctagacttgaggagccctccgtggcacccagcccctgaagcccacactgccacaggttgacggcaggcaccacagccctccagccccgcacccctcccgcccagcctctcgcacctgcttctccaccttcccgagccgtcccatcatgctggggtcctcgggcagctccgcctcggccgggcccttggtgcggtccttgtccgtgatcgctgggccccgccccacgatctggtccactctaccgggaacagagaccccaaagcatgagttcgggtgggtgcagcagggcccctgccctctcctcctggaccaggccacagtgcccctgggtctaggctgcaggctcagcccagagccgaccagggggcagtgggtgccaggacagatggacggggtgcgccccgttctcagcccgtcttctggcaccgtgaggttctgctcctgcccgctctgtccccaaggggcctggcacattagcgaggagtaaagtaaggacgctcccaccagggccgagtcgcccggctcctctccgtgggctcccggctccataccgccccctccagccagccccacctgctcaccctcttccctgcccaaggcctattggccccacagcccacggagggtctcccactgcagggcctggagcccactccagaggatgcccctccccctacccgtgcccaccccggagctttactcctacgtaatgtgccactgaagccgtcggccccaccgggtctgatggggacggagttaaatgtctgcggcggggacaacagaagcagaaaaggcgtgagagctgcggctccatgcaccaggacaaggagagaaggcccagagcagcacaggaaccaacgcacaaaccagaagaggggagacaaagctgcgagggtctgtgtgtgcacgtgtgtgtgcactcgatgtgcatgtgtgtgccctcatgtgcattgcacaagtttctgtgtgcacgcgtgtgcatgtgttcatgtgtgcaagagtgtgcacgtttgcgtgtgtgcatgtgtgtgtgtaggatgcagaattcagctgagctgatctccaatgaggccacaggtcactcatgacaataagaagggagggaggctcctttgccctcagggacgggggcttctgaccagtctggtatccacagagtcacggccactgctgggctggcaggggccaccacggtgggtgtgcgctgaggcctgcagctacgtgggaactcacttggaaacaaagaccctgcagtaagtctacaaaagcccagctggacaagggcagctcaagacggggtgtggctgagcaggacccacccaggagaggccacaagctcccaagtctcccctggactggggcctggtacatgaagactgccccacaccagccgacggggccaagtcctcacttcctgccactgggctgccctacctgcctctgatggtgggggagggacttcctgccactgggctgccctacctgcctctgatgggggcgggacttcctgccactgggctgccctacctgcctctgatgggggcgggacttcctgccactgggctgccctacctgcctctgatgggggcgggacttcctgccactgggctgccctacctgcctctgatgggggcgggacttcctgccactgggctgccctacctgcctctgatgggaggggggagggtgggccaggggtgttatcttctttctgttgcgagaaacagagagggtttcaggctcgcgtcggccacagtgcagctcctcatgctccgcggggcttcatgctggactcatgcaatagggccaggagggcgggaggggacggcgggaggggaccctctggctccgagcagacgccagtggcgatggaggagatgggagtccctggtgttcggggcatccacacagtccaggcagatgctcagcaccttcgcccctgccacatgacgggccgcccgcctgctcagtcccaataggagccctggccacgggctcagcctggagctgctgctgggggctcctccaaggaccctgtgcccctcctgccctgggcccctggctggaggagacttgatccctgagtgctcagtgccccgtgaggtggggcaagcgctccaactgtctccctggccccctgtgtgaacctgcacgtctcctagccacaagaccgtccgagctcacagctgtggatgcccagctgctgtctcttgcggcaaggcacaggaggacggaggaccagccccagggcacagcactcttgggcatgggggacaccacagagcagggaacccggcaaactccgtccggggctaccctgggttgggcagtaacagacacggccctgcctgctcccagaaactccgttctcacgggaggagcacggggctgacatgtccagtgcacagacacttggcctcacaggcagaaaccccaccacagagggaggaggggtcagactcaccccagacgccgtccccaccagctcaggcctgggcttcatttgcccagacactggcattggctgtacccagaaactgtctgccctgagctgtcagggaaggccaggggtctatgctcagcctccaggcctccgccccaggggctctaccctccctcagccaatcagacttgccagaagacagggaaccaccgtcatctgaatagtccctgggaggcaagaaggccttggaaagtctgagttaatcactaaagaactggcttctgccagctcacgtggagctgggccgcacctctgttctgcccatcagccggggctctcgccagctcccttatcaaaaacactaattaggatgctggcagcttgaaagccagcaccggagctgctggagcgcacgcctgtgccgggcacctggcaggcctcttctcacgcttcttcccggtggcttaaggggtagatgctgtgaccgtctgtatcttccacgagagggaagagacacagagatgcggctccacctgctcggagccacccagggcccaggtctgggccgtgcacgtggccaggcccacccccacagtgggcaggtgctgaggggcaggtcagtgcctggggaggctggagagccctcagccaggaggggcctgtccagggggcacgggcagggccagagggatgtctgtgcaggtctgatggcatctgatcctggaggtgctgcccgggggcctcccaaccccagagggaaatctcacagggcatccacagagcccccggcttccccagggcacttgtcgagaggagcagtggggcccctggcagtcctgataggggcacagcctgcctggggccctggtggaggaagggccttctccctcttgtggctttttcaggaacagagaaaacccgagtgtcccctctgtcccggggaaagggtggtacaaggtgctgccgtcatgtggcctggagcgaaggggccggccattccacagacacgtcggagaggcgctggcatcctaacctaggtgagtactggggtgactctctcggaggggccgtgggtcctttggtggggtacttcttgtgccggggagttgaagggggcgggggacccacaatcatatctatcctggcagagtaaacaagaaaagagacaccggcgaaacgcatcgtaaagccacaggaaatgaggagctggccaggaactggcggaaacggaagcaacagggaggctccgtcgaaacaggtgctctcccacagagggtgtggacgccgcctcgctggaccttggatttgccaagtccttcccgtgtttcaagcaaagcttttgactcgggagcgggtggcgggcggccccactgcggagacccgggtgccacgtcccagagcgtggagtgcaggggaggtgcccgcagcaggagccggtaccagacaggccgcggcggggcaacgggaaacgcattgtcaggagccggccgaggactcctggggtccttggggtgtttgctttgttttgtttgtttttccagagagagagggaaggaaagggaaaatttaggacaagagatcctggtgaacaaaaacagctgaagtgagagagatgtggagacaaagcacagaagtcaagacaggagggcgttccgcacacacacgcacacgcacacgcagccagggttggccgctgctccagagaggacgctgggaaagaggcctcacagctggagcccagcggggtgaaggggatggctcagtggcccctgcacagcaggagtgggctaaggcctggaggcgccccttccctggccccctgaagcaggactgggcaggagccccagggtggggctctcgacttcctcagatgagagcttcactcccactggagggcccggagttgggctgtgacccccaggctgtccctgaccatcccagccttctccctgtaacaggggcccagcctcgcttccagggctgagaaactggtacagccttggttggggggcctgggagagggaggggaccctgataggcaggagcatgtcccctactgcaggagagactctcaacagccgtgtgtccccattacaggcaacataaacacccactcgtgtgtatatccttgtttgtatgtgcctgaggctgcacatgtgtgggcacgtgtgtggacttaggggacacctatgccaaggagggcaggtagaagaaaaggtgccaagtagcataactgatgcctggtggggcccacgggaaccctgcagcttcatgtctgaacagaattattccatccccaacacacatgcacacatgtgtacacacatgtatgcaccccacacacgtgcatacatggcagagcagagccacacgtgcatacaaccacacacatacacctgtgcagaagcatacatgtgtgcatgcgtgacttacacacacacacatgcacacacacattttcagggacccacacacacaggtgcacgcacttgcccaccgcggtgtggatgggggagagatgggagagacagcagaaatattaaaacagactttgtgaagacacaacagaagctgacagaggccgacgtgggtggggaggaggccccgcccacacaccccctgcactcccaccatgggccacagtgggctttgtcccagaagcccaccccgttcttgtcccctgctggacaggcaggcggggctcttgcctggactgcaggctcttaattcgggacagcatgtccaggtggccggctgagtactgctcgatgacgtccatcacgtcgtagggccgcaggctctccttgaacttccgcttggacaccaggaaccgcatgacactgcaggggggtgggtggggctgtgagccctgggccagagacccccggccacaggcaccaggaccttcctagcacctctgagacctcggcgcctggagatggctggacttgcccctcttgtctgccgcccaccagctccacacacagaagggcctttatgtggccctgctctgcccgggacaggtggggcttgcaggcctggccatgcccccttggactccatgccacagcaggcagaaggtggctgagttgcttcctaagccaggtggagcccggcctcaggcctcttgctgaaccggcatcccacccgaaacccgcctgagtcccagaggagtgcactccaggacattcagccaggtccacccgtgtcttagccctttcttttcccagtagactctgtctctgggcggctctgtccagcaccatgagcaccggcagcaggcaggaccaccgagcgggaggcccctcctcactcccccaggctcccggctgggcaggggcctcaccacacggctctgatgctgactttgaggcccggggtcaggtcctcggtcacaaactcgcaggggcagctcttgtcatccacaatgtcctctccggggaggcttgcttctggggggaaggagacaggccgtgaggggccgagggggccgggagacctattcccggggtcctgcagggcacaccggctagacagagcgccagggagcccctcgaggctccctgtggtgcccctcgggtgcacctgcttttctggaaacccacccatctgcacccagctgctctcgagtcaggaccttccccggcaggctgtggccacagggagtggccgatatggggcgtcaaaggacattctggccaatggatgaacagaacatggcgcatccacgcacagatgttaacggcggaaggtgcaggcctgacatctgaggctcagtgaaggaagccagacccaacggccccacgtgggagccgcagacacgcacggcccaagagcagcgggtgctggggctgaggcggggaatggggtgactactgatggggtcatggtttccttctgtggtgatgagaatgttctggaactaggctgaggtggtggtgacaactccaccgtgagcgtgctacatgccactgaattcctacacttttaaatagttaattttaggttgcacaagtctcacctcaattttagaaaggatagggggttcccactccaagagcaagcaaaagcagctgcgacgccacagggtggccacagtagcgtggccaccacatccatccccggagaggatggaccaggagaggatgcggccacacccaccttctgagttctgccgtgacgcggcacccttgatgcggaaagcctggcgtgcccggctgcggtccccgaagctccagctcttgggcaccttgctggggctgtcctcgaggctctggtcggcgctgggtgaccgcctcacagtctgggcctgcggggaccccttccccttggcagccacgcctcgggggctggagaagacacgatctttcaaactgaccttctggctgctcccacgggaaccgacagacagacagaaaaacagggagagaagtcactctgcaaagaacacaggccgtgtctgctcatggccgacgccgcccatgcgccggagggagacacaggtctgaagaacagccagccacacgggtggctcagagcaggtgccacggggaccgagcacccggcgggagggagggaggggaggccacggggaccgagcacccggtgggagggagggaggggaggccacggggaccgagcacccggcgggagggagggggggaggctaccggggccgagcacccggcgggagggagggaggggaggccacggggaccgagcacccggcgggagggagggaggggaggccacggggaccgagcacccggcgggagggagggaggggaggccacagacactgagcacccggcgggagggagggaggggaggctgggtgggcagcaagctcccccggctggctcaggcgtggccagaggttggccatgtggggagagttgatgtctgtggactcttaaatcactttccgctaccaccacgaggtgccggagccttcctcacactgtcctgccagcccctcacccagtgacactcagggcaacgggcatcccaaacaccggggctgtggctcttcctcgggcacctctgtctgccccggccccgcccgtggtttcccctgtggccttttcacacccgtaactgctcccaggaagcagcctccctcctcccctcccacggcctgtccctctccttctgccccagagtcgaggggccaggggacaacaaggacattgggggccaagtctgcggtggacccttgttcagccacactccggcctttccacccaccccgggggcctgcctggtgggatgggcttcaggagggctcaggcctcccctgtcaggctcccctcccaccaggtccgtgtcagagaactgctccttccggcttctggaaggaaggaatggataacggggctcctccgccagctgggcctcactatccaagtcctgccccagggcagggggaggcagcctccaaagccacagcgctgtggcccggccccctcggcctgcgaggcgtgaagcaggatttgcagctgtgtctggctgggtctccagctccatactctcggggggtccttgggcctgccttgcccccgagttttttggtgaccgtggagatgggtttgcacccgagttcttcaactccagcgtccgccgggcgacagtgaggggaggggagggttcactgtggttggtggttgggagacgccaggcagatgtggcctcctgaggtctggaaagcatcagaaccccctggctcccttgaggacagtggggctctcacgaactggggacccgctcatgcccagccatgcttagcagccacggaacttctcagggtggttctgggcagggcccagagcactgttgctggagcctgaaacaagccttcgggtggggaggccccgcagatccctgacacacttcagagaggaagcccagtgcctcacgggctccctgatcccacggcggctccccagccaacagcgagggactgaggccccggtcagcagccaccatcagccccgactccagacccacagccagagagacacgcccaccagacggcacagagataaccagccacagacatgagagcccaccgcgcccgtctgcctggcctggacacgcggatcgcttggctgcccctccccaccccatcccccaggcagcaggtgaccgcccagaccatctgtgcccactcagcagaccatctgtccccactcaggcgtctctgagagaaagaaagaagcccctgggtgttgtgcccgctcggggaagcagagacggagtggccgagatcccccgagtcccgaggcgtcgcgtgcttggggacgtcaggagccgatggtacaggctcgctcaggaccccagtcctgagtccacacccctgcactgcctgaggccaacacaccgtgcccatgggggccaggggtgctcagagtcctggtgctgtgggtgcctctgtcccaacggcctctggtccccatcccaacaacaaaagcacaggtggtcggggagaaccggacgggggccaggggagcacatgggcacaggctcagcgggactcctggaatgttctctctttctccaccgcacgagccatttcaaaggcaagaataggcccctcctgaccccgctcaggcaggcctcagggcaagtgggagtcactggaagactcaattcctctctctgcgtttccacccgaggcaggtccagtcaccagagagagaagcagccacctcctttctcacggcagctggcaaagcaccgggtggaggacagagccggtcggcccaactgtagcttcggggctgcccttggctggtctctgggcagagcccggtgctgagggcttgcagtgggaaaggcacagcttgaggaatgggcatcagattcccacctgcggccccggaggggaacgggtcaaatacccaggcggccacacagacgtgcgggccaggaagggtcaggccccacagtccgcagggagttgcaggaagggagtggcgtggattccacaggccccaggagagaagacccagccccgacgtctgcttcccatttttcaggggggaccccccgctgaccacgacaaggagccacagccccgccagcggcagacacaccctgctggacccgatgcccagcacagccccaggggccgccgggacgcagcccacgtgtactgccccagacagagccggcgggaaggagcctgccctggcctcggcgcggccctgctgtcccgggtctcgggctccgctcccacctcagatctgcgagggaggctctgccaggaagaggagggtggcgcgacctggacatgtccttccctcccctggacctccaccatgacccaaactctgcaccctccaagcacagctggtgaggctccatgctgcagacacccgaccccgccagcctgcctcagctgccaggagcacgcgtggtctcgcaggccctccctcggccacaagccaagaacaagcgcacgcgaaaagctgccgccacccacctgggaggagccctcggccagagctgccctctgtgtgcgaggggcgtccgtggcacctacgcttggggcttacggggccggggcaggctcaagaagcacctgagagcgcgccatccccacccggcctgccaccctccctcccaatggtgaaattcagatgtgcggtgcccgcaggaaacaggaggctgaggagcatccagacccctgcccagctggtgtccggaccaacgacgcccaggaagcgtgaggatgaaggggcctcccgtgggggctgctcgcagcaggacagggcctgccctgggttgttctctggcctgggctcccacccccactttcaaacccctctggtccccaagcagcctgacctcagcccctgccctgagggaccagcctgcggccagaagcaccctgaatagatgctccggacacgcaggacagctgctagcgccccagcaggccatgccccaggcagcccacacgcccgtctccctctctggagctgccaacagtctccccgcaagcaccaacgcccccagaagcacacaagcagcaaagtcacagggagagggtggcatggagtcgcgggccccccatggagcagggtccgaagcatgcacggatgcagataggcagcatgcagccccaccagccctccaaggccagcaccaccggcggcatgcacatgccaaggagagccccacaggagcacgacacagccacctccaccttgctgggctgtgctggccaggagggaggggcccccagcgcaggcctgcacacacccaacagcagacaggggacgcggggacaggggaggtgcgggtcacggtgcaggccaggagcccacggtgcaaagggggcggctcctcccccgtcctatttccacctgccctaaaccaggcctgttgttgggagagggagccgcgggcctctggctttctggggcttctgatgcatcaggaccctgaggagcccggcacacacagacggagctgcctcccgcggtcgaggcagccaggaaggctcagtcatcctcaggtacgcagcagaggtgctagagtgacagccccaggggaaacgctccctgaagagcagtcggggaccccaggaggcacggacgccttgctgggttcagagcccctggctggcccctctggctgtgcgcaggacatcgcctggcgtggggagcaagaagaagcaccttcccccagctccgccctgcacgcagctgtcggctagaatagagggagctgagcccgcaccgccagggcggtgggtcagaattggggttggggcgccagcctccccctggctcctccagaacctctagtaagcagggaggggcagaggagccgtgcagcagccgtcagtccgtgcggcgtgttccgcggtacctagagcgtccggggcagcatccacacaggggccctctgcacgggctgcctttactggaaatgaggagagcacagttagtcctgggcgccggcaacagcacacggccgggagcagggaaactgaggcactgcaaccacccagggtgttgtgtgcagtccccagcggcagagcttgcgcccaagcaaggccagcgaggaaggtgcaccatcgtctccaccgtccggagaagaaaacacttccctatttctgaaggaaaaaaatccctgttttttttttcctccaaaaataccttttccttccaaagccacagtttgggttcatgtcttaaaagatgtattattttttgcagtattcatgctgacaaaacaataatacatgtggcctcagacgccgcagaagccctgcttgggaaggacgtgaccccgggaaagggcgtgggtgtgaagcacacacatttgagagaggaaaacgtgcagttgtcccgctttgcaaaccaatcggcgacgtttggccatgccagccagtcccccagttggaggtgggtctcggtttacccaggaggcgtggctgccactgcaggcatggctatctgggggttcaagggctcccctgaggacagtcacgttggggctcagtggatcccctcattgtgaagcccttcaggagcgcagctccccgccggggcgttccttagaaaaggctcagaaaacacggaacgttttcccaagaatctccccaaaaaccctggcgatttagctctgcatcacaatgtgcaaatgattaagcaaaaaatgaaaccaatcaccaagaactcaagaactcttccttttccccaccccagccacccccaacctccttgccactgcttcctgagacagcacttctcaaactcggtgccccaggaaccccagcgtggcgacggcatccactcagaacacacaggctctaggaagaaagcacccagcctcccgtcttcctgcgcacacgtgtgtttagacaccgatgtccctgcacgcacccgcaggcagctctccgagcggcgtcacagacacggctagctccagtcacggcagcactcagccgcccgggtaggctgagggctctggacccttccccaagccccaccagcctgcaagactccaagggcgggtggccggcttccaccccagcccccgtgccggtccggctttttagtacacaagcgactttggggtccccaggcacgaagggatgtagtgcaaaggctggactctgtttgctggttaaccacgaacgcgacggtgggacgaggcaggagggagccggctccctgcgcctggcttgaggttctggctgctcagagtctctcccgctgtgaccaccccagctacgatgacacccaggccttcctggcaggcaaagacctcagactcccaccagcaccacccaggcccaagcacagagcccctgcctggagggccccaggagaccttccccaccccagggaaagagcatgaaggaggcagggtcccgcttccccaaacctcccaaggtctcctgttttgaccccagcatgatcgccttgaccaagaggcccctcccgggccggccctgccgcccgattctgcaatgggatcgtcctgtagccacactgaagctccggctgtcgccaccaggcacctgagactcgagagtgaatctctaaccgtgcccgttataatccatgttattttaacagccacatgtggctggcagctcctgtatggggcaacgtggtctgagagccggggagagctggcagggaggcgctgcaggcacagccccccaagacccccaaagctttgtgggggacccgtgcagctgcacctccccctggggtccgcagctggcactgggcttccttcctgccccatcagccacagggagctccacactgcgtgagaaggccctgtgacccgaggtcggacaggcggacaggcccacagtgagctcgagacccacagacactgaccgagacccgacaggacagacatgcaccaaaaacacgcggacacgtgtgcttgagaagaggagggggagcccgaacaggcacgggggagcccgcacaggcatgagggggcagccggtgttgggggctcctcctccagcacgggggcaggaggcagtgagatggggtgtcggacaagacagcacaagtcagaaccgccgtggccaaagagaccccccgggacccccctggggcagcacggcccgagccccgcagcctgcctggctccccacccgaccccaacgtagacgcttcctctgactccagcacagccccagtggtccctacgggaaccgagcccccgccagccgggtcgcctgccaccacgtgcctgtgttctgagccaggatgggggtgggggtctcagcagtgagtgagggtccctgtgtccacaccatccacctgccaagaccagctgacaccagcggggtcctgccatgcggggtgcgggctccacctccaaagggcaggcggaggcacaggtcccaccagactcacagagcccaggtcaggcagcagaggggcgccaggagccgagctccccatcaagcttcgcagagcaggcccctcacccagcagcccagggacgtggcaggcaatgattgcggaacaacttcctaagcacgaccctacactggacaggctgcggctgccccaggccagggaacagagatgccaccccgtgacctgccaggtgagcaccccaggatgggcggggagggtcttcaagggcagagactgctcctcactcccaccgcaccccaggcaccttccagaagccccagacccagcagccccacgtcccccaccacaggcgtcccaggaggagggccggggcgggtgggtgctcgcccgtgggggagggcgtgggaggcacaggcaaggaccccccggacacatggggaagagacgggggaggggtggggagccacagagcttaccggagagcccggaggctcccgcgtgtcctcacctggagttcgccttcagggccagcacctcatccccaaagagagggcagacgagagaggggcccgagaagggcagtaacagggattaaagcacttgggggcagcgggtgtccagatgggtggagtggagggtgggagggagagagagaaagagagaggctgagacgagaacgtggagcgggccgggctggggcagcgagcacgaggggccgtgaggcacggggcgggttccggcgtcgctcccagcaagggcgtggggccctgccacgcggaagccgtcgggaagcctcgcgtccacctgggacagcaccgaggttccgcccaaatcacagccaagggtgcccattgtggggggcacagtgctcatccccacagccactcccagcctcagggccagcagcaggggcgggggaggcagtggcagcactgggggctggcaccagcagaggctacgctgccgacccagctctttctgggccctcgtccgttttcttagcctctttgagaggatgaatgagcccctggtggttttcttggttggtgtgggccggaagcattgcccgtctttccagctcaaggcactgaccatgactccccttctgtgggatgtggggtggctggaaaaatgcagctcagccccactccatctccccgcacccaagccccgcagtgtctcgccagctgtcacccgcagtccaggaggggcagccaggcgtccatctcggaccccaggtccaaggggccagatttactctgcaacatgtggatggggcacagggggcccagagaagcctagcacctcctcagggtgatgtgtcgggggctggggctcagcagacgtagaattaacttgtgaaaggatcttgattttctctgtctccatccttcaccccagcagagcccttacacgagtcctgtctccaatctgcccgacccacagaacctcggggcccgggagagggaaccaggctaagcacctgcacccttggcccactttgaccttggcaaacagggagaggaggccagccagaatctccacccaggggcgtgagacagagaggatgtcccaccctcctcggaggacgaggggccctggtctgtgccacatgctccagacactctggacccagagcagcgggaaggccagaggcccacttggagctttcaccccagccggcgtcgactcaggccagctgtgagctcgggctatgtgcctgcagctggagggagcgcactaacagagaccccctgcctccgagaaccctggggccagacttgtgggcggggtgggggatcccccacccccgagaagccgcccagctgcccggatccacagtgctgcaaagtaaaaccgaatcactggggagggggtgagcaggaagagtgatttaagggcccacatcaccgccaggcgggggtctggacccgcagtcacacagtcacacacggaagcacacacaaggccctcacatctccatgacaggttgcgcacacgtgtgggagagagaccagacggccgtgcacacggcagacaccagggtagcagcagggggcactgaccttggagacggctccggcggggggtccttccttcaaacagaagcaacagagagttagtggccgcccactcagcacccatgagggtcccccaaccagtccagccccccacagtcccatgggtcaggggctgcaggggaggggggtctcagaaaaggctgggcaggggtggagctggcccacccaccccagagagcccacggccccaggaacgggcaccccagggcccacggaggcagctccgagagggaagagggactccatggggcgggggcctctgctcttctgacctgggggtctctacccctccacatttacagacactcattttaatcagaaccacaccaatattaataaagttccaaaaagcacgtgtttgctgaaggaagctctggaagggagtttaatttacaatcaattttcgagacagagtgagctgctccgactcttttttccacgctcatcctaatggaatgattctcttccgcgtgactttccaggggtggctccactgcgccacagtcagtgagcccagggtttgcaccgctgaccaactgtcccggcctcgtcctgcaggcaaagctgtctgggccttccggcgtctcatctggggctgtttccgcgggtaaaggcgttatggattgagtgagagatcggcggatcgtgatttggctcatccatggggaggccccagcgatctcattcgaacacctgggctggtgccccggctggtacgccgtgttacaagcaggctctttggtgcacttccaaatacttcatgtgacagggaccgtgttgccgtggaacatggtccacgctctcggggagggtccctcatcacctcctgcagctcccggtggcccaggtgtccttggcttgtggctgcaccgccccgtctctgcctccgtctctacacgacattctctgtgtctctgtgtcttctcctcctctacctctgtaaggacagctgtcaccgggctagggctcaagctgtcaccaggctcatcaggatgttccaggatgacctcatctcaagatcccaagctcagttacagctgcaaggaccctttctccaaatcaggtcacatttgcaaattctgggacattttggagaccagcattcaaccactgcattcccccgaccccccaaaattcatgtccatcttacatcgagaatacactcacccctgccaagatcccccaaaatctccaccctctgcagcatggactgtgtgtccaaaacctcatcgaaatcccatccgttggccaggcacagtggctcacacctgtaatcccagcactttgggaggccgaggcgggtggatcacctgaggtcaggagttcgagaccagcctgaccaacatggtgaaaccccgtctctactaaaaatacaaaaattagccgggtgtggtggcaggtgcctgtaatcccaggtactcgggaggttgagggaggagaatcacttgaacccaggaggcagaggttgcagtaagctgtgattgcgccactgcactccagcctgagtgacgcagggagactccgtctcagagaaaaaaaaaagaaatcccacccattcaaaacgtcccaaatcccatcctctgaagtcatgacaatcacttaaatcaggtatgtgtgagaccgtgggtgtgcgccaacctggggctaaagtcctccatgcatgggcttgtgaactagaaaacaagccatctgcttaaagtatcaacagcaggacagctcttcccactcaaaaagggagaatgacagaggggccgccggccaccacgtttccaatccggcggggcaaactccacgtggcacagctctggggacgctcctcgggggctctcagccccgccggcctctgcgggagcctcgggatcgttccccgtttcctaaagggcagctcgtgttcacagctgaggagcgccaccggcctgtttcctgcctgcagactcccgaagttcgatgccctcttaccttcgtccaacgctgtctctgccaatctagtttctgctggtatgaaactccccaaaacctctagggcctcctgaatatgccacaggccgcaacgccgttagacaagaggcccctctgcacatccttcccgatagctccatcttcaggcctctgtggagacggtggaggctgcagccgcacacctggtgccttcagcatgaggctgtctggccacacctgtgggcttctctccaaagcaggctttgccaacagtgaatctcctaatttaagaccctttgcaagctggacaggctgagcacctcccaaaccttcaagttctggtttcttacagcagttctgccctgaatgcctttttttttttttttaatagtcttttggcggatcggccaggtgctgctctgaatctccctgtttcctctcatactttactatgagcagcagaaataaattaggctgcaccttccacactttgcttggaaatcttcttggctaaatatcccagttcatcacttaaaaattctgcctctgcccaacagtagcgcacagcccagtggagtctctgccaccaacaacacaaggacagccttccctccagcttccaacacctgcatcctcacttcctcctgagcccgcaccagaagcaccttcaacatccgtgtccccacccaccatctcttcaggacacctcagtttcttccagcctgcacctcaaaatactcacgtccaaaatctcatccaaatcccatcagttcaaaaagtcccaaatttcatcatctgaagtcatcagaggccgggcacagtggctcacgcctgtaatcccagcactttgggaggccgagacgggcagagcccttgaggtcaggagcttcagaccagcctggccaacatggtgaaaccccatctctaccaaaaataacaaaacttagccgggcgtagtagcaggtgtctgtaatcccagctactcaggaggctgaggcaggagaatcacttgtacccgggaagtggaggttgcagtgagccaagatcgcaccactgcattccagcctgggcgaaagagcaagactccatctcaaaataataataataaataaaataataaagtcatcagaatcatttaaatcaggtgtgtgtgattgcaggtgtgcatcagcctggggctggagtcctccacgcatgaacctgtgattctaggaaacgagcccttggctcacccggttctgatgtcacacccgcgcttgtaggcgtttgccacagccgcacgcggctcccggtattaaagtctggattcatgtgcaacggctcctgtaactaagtgccgctggagtgtgtaacaacagatgtttgttctttcacagtcctagacgccagagtccaaaatcaaggtgcgggcggggcctgctccctccgaaagctccagggaagggtcctttctgcctcttccagcttctgtggctccaggcagcccttggcttgtggccgcatcacttcagtctctctctccatcctagctggctatcacctctgtgtgcttccaaatctccctctccttgtaaggacactcgttgttggactcagggcccgcccggaaaatccaggatgatctgagatcgtcctgataggttccagagcagaagagtgtctctaggaggcagaaaccagcatccaacccactggaagcccctgccccaccaagggctttcagacatggaactgcttggggacggctctgggcctgggcaggcctggcaggtgcattcgccttccacctctcctgctcagcaggcccttctgcaacctacctcgacagccggcactctgacagccgtgggctttgggcctgaaggagaggcagcaggcgccatcagcacctgagttaccaccaggcactcgagaggacgacgggctgggacactttgtcgtacgacccacgcgcctgggccccattaggagccatgcagagcccccggccccatatcaaccttcgcccctccctctctgcccgtcccccgaaccagctgcccctctgggggtgggagcccagaccaggtcagcagacgcgaaaagagaaagcaccaccatcaccaagtccagcgtccccgcgcgtcccagctccctggagtccctggggcactgtcctggcgtgtcttctgtgggcagctggggcccccaggaggactgagacgcccacccgccccacctggagctccccagctgacctgaaagcgagtccagatttactcttgaggttcctcagcagctccagctggttcagcggggggataagtctggggcaagagaaggagaggggagtgagcgtctcaccctcccgagtcctgggacacctccctctgcttgcacagctccatgggcaggcgcctgcagtgtcagacacccggcggcatgtgacgtggccaggctttcaggcagctgcccactgggccctgggctcaggcccacctctcttgggcaggcctgggagccatcttcattctctggctgtgcctggggccttgtcaaccagcagggacagcagggaggagggaagagggcgcctggccacccatgcagccccgaccctgcagcctggagcaggtggaggagggcgcgcaggtagggggaggcgctactcccccttctaatccctgaacatcctagagggacagcacgcgaatatatttagggccccggcccctctctacacagccactttctctgccaaagctggaggagttgggaggtggggatacagaaaaggattctgcttggcaaagagcagctcattctggagtctataggatgagcccagcctcatcaggcccagatgccttgggaatcctccgcaggtggcccagctctgctccgagcccccttcccagtcctggtcatacccacccctgtcttcctgccctgccgcccacagccaccagcaggaccaagtccgggcccgccgaagccccccaggcaggtatgcaggcacctcctcacgtctgggtgggacgtccccctcttcacccctccccactcccacccacctcactctgcccactcctcctcaccacccatgccctcacagcattccagctcgcttcaggaagagacaccctcctctggggcctcccccacccggctccctgacccacctgaaccccctccactccgcctcctcagcctctgctcccaggccctgccatcccatccacggcctccacccctccccacacccacctgtggagcactccccactggggccacgtcctggtctctcctctgcgttggaggcaggacggccacctcccagcccagccctcacccagctgactccctacgcggctatggccacggccaccccctggagatgcccctgcccgtgtcctccctctgccccaggctgggccgtggcccacatcctccagactcttcacctgccctgcctctgcccacccaggcttacttggtcctccagatgggcatccttgccactctcctgaccaaacactcaatggctccccactgcctccaaagcaaaaggatggctgactccattgtccctcagggcttggtgatcaccctactgccgactcccacttcgtccagccacactcctccctccagagctgtccagaagcccctccctgcaccccaccagcctctggtgcccccccacaggctaggcaggtgtgagctggtaaagccgtgcctggcccctctttgttccctctgcagccccagaggtgcccccaaaatgctggcaggagtggggctcctgtgagccccctccctgcagaggacagtccgctgtccaagtcgggatggagcaggaaccaggcagctggtgagctggtgttgtgggcgcagcagagcccagcctggccggagtctgtctgggggccacaggtggctccccacccctccttgatgggacccacacgcacgcaggcccaggtgagagacacacacgtcagccctcagagccacataggaggccatgcctcgaacacacagagcagcagcgccagggcagacaggcgggcggcagggccagggcaggacggagctgtgggacgagggtgcaacaaggggagggggcggccctgggagagagcagaggctggggaggaggcagccggcttcagcgccagcctcctggccccaggggcagcagggcctctgcagacattggagatgtcttatggctgagcatgtcgggggcagaggagccctggacccaccactgcccagcactgcacccacttcctttctgggaatggagagtcaacattctaacagttcccaggaagggcagccaggtctctcctccaggacgggtgactggcccctggaggagtcatcaagggcttctgtgcaggaagcccttctggtctatgtggggagtggctggccccaggctctgcagggcagtgtcatcacagagcacaagcctgcccacccgacaggtaaaggccctttgtgctgtatgggggtgaggcttcccatagcagctcagcgctctccagtctgaacaaacagccttgtttcctgctctcagcagtggggacaggggtgggacggcctggagccctggggttcccctgtgatgccagggcaagactcaggagaaacttgagtccagggcaggagaccctgaggcagacccctgaggctagctggcccgcagaggctgccctgtgagccacggtgggacaaggactgtggctggtctgggggtcctggcctgggagcacccttggccccagatgggtgcccagcgccagggcaggggaagccccccatccatcattcctgctctgctcacagatggggcctgtggggtggggatggaggcacgaggggagccaggccagaagcaggacagaacgagaccacgggggacacaggcgggctggcaacaggaagcagcggctggggggaggcaggacgagaagggtggatgggccctgggagggcagggttggcacgtgggctccaggcaggggagggcccagggtgatctggccgcccagcatggggccacgcagggcagggggcatagggatgctcggtgggcagggacagtggtcactctgcagaccgggtgggccacggggctccaggggcttgcccggtcacagttccagacacagaactagaaccacacacacacacagggcttctgtccatgcatttcctacctggaggccccgtaggtttgagtttgcgaactttcaagtgtttccacacacacaaagggaaaagaacggaaaatttcaaaaagaacgggataagaaaaagaaaatgaaacaaatagttgaggaaagtaggggaaacaacagaacaaagaaaattagcacaagggctggttctgtccctgccctgggctgagagaggtcactttgcagaaacaagggcatggccgacattcccaggaaagacaagcagggccaggctcctaaggtcgggcttccaggaggtgcaggggggatggtgctgagggaggggttggggcagaccccagagggcgactgcaaacatcgaggaccgccaagggctctggcatcctcctcccaagtgacaccctgaaaaggcaggtagcaactgaggactgccgcgggtctgtccaccctggccaactcaggatcctcaagaagaatcctgggccccaccccagcttagaattcccagccacactgtgcacctgccccaccctcagggaaggccccaccctcagggaaagccccgcccacagggaaggccccaccctcagggaaggccccaccctcagggaaggctccaccctcagggtaggatccacccacagggaaggccccacccgcagggaaggccccaccctcagggaaggccccatccacagggaaggctccaccctcagggaaggatccacccacagggaagactccacccacagggaaggccccacccacagggaaggccccaccctcagggaaggccccaccctcagggaaggatccacccacagggaaggccccaccctcagggaaggccacacccacagggaaggctccaccctctgggaaggatccacccacagggaaggctccacccacagggaaggatccacccacagggaaggccccagcctctgggaagtccccaccctcagggaaggctccacccacagagaaggctccaccctctgggaaggctccaccctcagggaaggatccacccacagggaaggctccaccctctgggaaggccccacccacagggaaggccccaccctcagggaaggccccaccctcagggaaggatccacccacagggaaggctccacccacagggaaggctccaccctctgggaaggctccaccctcagggaaggatccacccacagggaaggctccaccctctgggaaggccccaccctcagggaaggctccaccctcagggaaggatccacccacagggaaggctccacccacagggaaggctccaccctctgggaaggccccaccctcagggaaggatccacccacagagaaggccccaccctcagggaaggccccaccctctgggaaggccccaccctcagggaaggctccaccctcagggaaggctccacccacagggaaggctccaccctcagggaaggccccaccctcagggaaggccccaccctcagggaaggctccaccctctgggaaggccccacccccagggaaggatccaccctcagggaaggctccacccacagggaaggccccacccttagggaaggctccaggggacagaaaccccctaggagcaggtgacggggggcgcgggagctgggaagtcccggggctcagttccccacctcagagcagagggcgggcgggcaaggtggtgcccacacagacggactcgaggggtcaggcccgcgtggaccaggagaaaggccctcagaacccctcatctcagaccttaatttaagcaagagccaggcaacgaaaatcccagctggctgccacctgcccttttgtaaaacaaaaaaacacgggaaagccgccctccgaccacacaggctcacaggacctgctagcactgcctcgacaggcactttctaggcccccttctctgctgcccgaggggctccaaggttgtctgtgtgctctgtcctgttggggaacacctgggacccccaggataatttgagtttcctggtctgaaagtctcactgtgatccggggttactttcctgccccccacgccggagccctaggtccttgatgggggacggggtcatggtactggttccactcttgaagcttgggcacctcgagctgccggtccagagcagcccggggagcagctgtcggtccagagcagcccggggcggggggcatttaccttgagctccctggggagcgtccttgcaacgcacaaaacacagcacgacccacggccaggacgataaagcaaaggggtgaggaaatgaaagtgaagagaaagccgcagctctaacacaaagggcagaagcaacgcctcgaaataaaccacacacagaactcctttgtgaaaaatacattttaaagaaaaaaaatcaatcaaaataatgaacaacaaaaagtggggtttaagaacaaatggaaaataaaaaatgaaacagttgcttggtggcaggtgcccggcggcggtacctgtacatgggcacggtgaccgttcgctcgtagtactgccacgtggagtgcaggtctgtgcgcgagaggttggtggcgtagaatctccaggccgactgcggagggaaagacaaggcagttggcgaggggcaggcggcgaggggcgcgcccaggagggccgggcgtggagggaacggggcagaggggacccccatgctgtaggccaggcactcaggactctgggccagcaggccaggccccagtgctgcatcagccccacagcctcagtttaccctctgtaggacagacaggcaagcccgcttgtcagacggtggggcctgaaggaggggagcggttggggcttgactcggggccctgagcgagctcgcagggaggctgtgttctttccttttcatgactcttacctggcccctggcgggtatcacctgtcctgggggttaccttcctgacctcctggttgggccctgggcaacctgaggcgctgggagtatgggtagggccagggacctcagcctccaacctcccagggcggggactcagcccggctcggggcatgagcctgtacgtcagactgaacctcgcctggctggatttccgttctctatgcctttgttttgttttgcggtgctgaaatagacatatcctgaagttcaccatgttagccatgttaaagcgtgcacttcagtagcgcctgcacacacagtgctgtgcgaccactgcccctatctaactccacacctcttcgtcgcccccaaataaaccccctcctacccccgacgttcagcaggcgctcctggttcctggtcccccaggccctggccaccgccagggtgtacggggctccacggacttccccgccccgggcatttcctgccaagggcatcgcaagctgcacggccttccccgtctggctccctccactgagcgtgacgtccccgcggcccatccgcgtcgtagcaaggggcagcgcccgctcctcctgataggaggatcgtatggataaatcacattccgttcatccattaatagacatttcagctgtttccactttttggttcctatgagtggtgctgctgtgaaatttgtgtgcacgtttttggttgaaggtctgttttcaattcttttgtgtctgtctatacctagaggtagaatggccgggtcacgtgacaactccacgtttacgaactttctgagaaacaaccgaactgctttccagggtgactgcatcgctacattcctaccagcagggggggcggtgtccacacatcctcactacgctgatttgccatttgctaacatgtcagccgccctggcctggcgcagaggctcacaacaccttggaggctgaagcaggtggatcgcctgagcccaggagttcaagcccagcctgggaaacatggcaaaaccctgcctttacttaaaacaaaaaattagccagatatggtggtgcacacctgtagtcccagttactcaggaggctaaggtgggaggatcgcttgaacctggcaggtcgaggctgcagtgagccaagatcacacaactgcactccagcctgggcaagagagcaagtccctatctcaacaacaacaaaaaaaaaaagttggccatcctaacgtggagcctgaagacgggactgaactgctgccatctcaggataaaactctaacaggtgaggagcagcatttatggatgagcaaagtaagtggtttcttgggatggacggtgaacactgcagacagcagggtaaggtcacttctgtcaggtccaaaccaaccgaggccagagagtacacggcggcagggctcacgcctgcatggctgagatgaggacagtgtcaaagacattctaaaataaccccacaaggaattccttatcaggaatgcagcaattcagacaagatgctctaggaagaacactggcccagcagcggcatctcaaccagtgaacggctgccaactctggttttcagcctcagagccagtgaactctgtttccaagcagcttatgtgaacttctcagccagggagagcttccctgcccctccctctccggcacatgggtggctcgccacactggctcatctctcgagagtcccccaccctctggccacagtggttcatctctggttataatcctttcttctaattcccaaatacatttgacatgtgtgtggtttctttttttttttttttggtcgacagaatctactccaggcaaagatgttgtgaactgtgttgaaatgacaaggaatgagaacattatataaacttagttgatacagcagtggcagcatttgagaggactgactgcgatgctgaaaggaggtccactgggtaaaacgctatccaacagaatcgcatgctgcagagaaatctttcgtgaaaggaagagtgaatcgatgcggcaaacctcattcttgccttattttaagaaatcaccacagccgggcgcagtggctcacgcctgtaatcccagcactttgggaggccaaggcgggaggatcacgaagtcaggagatcgagaccatcctggctaacacggtgaaaccccgtctctactaaaaatacaaaaaattagccaggcgtggtggtgggtgcctgtagtcccagctacctgggaggctgaggcaggagaatggcaggaaccagggaggtggagcttgcagtgagctgagatcgcaccactgcactccagcctgggcaacagagcgagactccgtctcaaaaaaaaaaaaaaaatcgccacagccccagccttcagcagccccacctcatcagcagtggccaccagcatcgaggtgagaccccctaccagcacaaagattgcaactcgcagaaggctcaggtgattgttagtatttttttagcaattaagtatttgtaagtgaaagtacgtgcagtgttttactgttttttagacataatgctactgcacacttagtaagctatggcatggtataaacataactttttttttttttttttttgagacggagtctcgggctgtttcccaggctggaatgcagtggcgcaatctcggctcactgcaacctccgtctcccgggttcaagtgattctcctgcctcagcctcctgagtagctgggattacaggcgtgtgccaccacgcccagctaatttttttgtatttttagtagagatggggtttcaccatgttggctaagctggtctcgaactcctgacctcaagagatctgcctgcctcagcctcctaaagtgctgggattacaggtgggagccacggtgcccagcctgtaaacataacttccatatgcactgggaaaccacgaaatttgtgtgactcgctttattgccgtatctctaccgtagtggtctggaaccacggctgcaggtcctctgaggtgcgcctgtggagaggcccagctgtgctctggaaatgtgcaccagctgctaagagtgaccttcgagggaagcagggcgcatgggaccctgggtgctcagacgctgctttttctggcactattgtaaccttttcaccacacgtacgtggtcactttttaaaccgtcaatagtggagtgagatttgggggcattttggttcttcttaaaactcttgcctggaaataaatagctgtttgtagtttttatagtggaagataaatacacaccttaaggtaggctggacccagagccaagaccacaagaggcacatcccctgcagtggccactgacactccgcggcttgtggccacgtctccagtctccgcctttgtggtcacactgctttcccctcctctgtgtcaaatctccttcttataaggatgcatgtgattgcatttagggcccacctggggtaacccaggattatctccatctcaagatttgctgtctaagacaggagagagcctatagccacattccgctggcagggatcctggtcagctctgcgggtccagtggatggaagactttggggaggagctgcaagaatggctggtcccaagggggtcctgctgtctgtccatattttctctttttttttgagacggagtctcgctctgtcacccaggctggagtgctgtggcgtgatctcggctcactgcaacctccgcctccctggttcaagcgattctcctgcttcagcctcccgagtagctgggattacagacgcacgccaccacgcccagctaatttttgtatttttaggagagacagggtttcaccatgttggccaggctggtcttgatttcctgacctcgtgatcctcccacctcggcctcccaaagtgctgggattgcaggcgtgagccactgtgcccggccattgtctgtccgtattttcaaggtggctcaggaattacttgtggatgccacagtggtcactgcacgctacccacccccaaatggtgggacggcactgggtggggtccgggcgggcatcatgggggcccacagccagcatcaggggtcagacgaggtcaggcactgactcactgcagtgtgtgggctctaggagccttggccctgcagctgcagaacgggtgtgctcacctcccagggtgcggtagagaggacctgatggccgggccccagcacccacacaaggcaagggccaccccagcgtcctcacacgagccacccctgtgcagcctcaggggttggagccatttctcaacacacacacttcacatcctcgctccttccacagattcctgcagagggtgagcgctgtggcccatccacagacagggcaatgccaaagccccagcggcctccactcctcaacaaggtgggaccaggacaagggctgtgctggtccccgggggacacctggactcacctggatcaggcctgctgccgggttccgcctcttctcaaagtgcttctgcctgtgctgctcctgaaccttcagggcaaacccagaccccaagatgccctgcaattcatcagggtcaggtcacaccccagggaccccccacaccccaattcatcagggtcagaccatgctctggggccccacaccccccccaattcatcagggtcagaccacactccagagactcacacaccccccaattcatcagggtcagaccacgccccagggactcacacaccccccagttcatcagggtcagacccgtctccaccgatccatgcctcccccaccttcatcaaggtcagactaatccaggaacccatatccccacaatttgtcagcatcaagaggaaggaaccctctggcttgcaggagacatggcaggacccacactgaactcagagtggcctctttcccttccacacagaagagtctgcaggcccatcttgaagggcacacagtgaaggggacaccggggccagcctcttgccgtgcaccagctgccctgccctgccctgccctggggcaacaagggttgacagggcccctccacctccctctgagctgggtgggcctcactgcctagagacccatgagggacctgtgtcaccagccgccctgctcctggtcacaaggacctcctgctcagccccactcagactaagaggggccaccagtgactaacagagccccctgaagctacagccgcagccttgggcatgctcctgtcggggctggggaacccccactccagtccttggggaacaaggcctctgaccctgagctgccacctccagctcctgggggctgtggacctgctgagagctgctcctgccccaggtcccacctagggaactgtgcccaggggcctgtggtcacctcgggagcctacaagacctcgtccccctccaaggcaggcaggggcagctggacttactgcaggcagcgcgaagaaggagacaccgatgagggtgaaggttgccgcaaggagcctgccgttccaggtctgggggtacttgtccccgtagccaatggtggtcagcgtgatctgtgggaccgcaggctctagtcacacgaagggcctgctcacacccctgagggcaggctggacgcccgctggcgactcggggcttgggatgggacagatgcggggccacccccgtgtcaccatccacacggaggcccagtgaggccagggtcggtgtcggccgcccctcatcccctgagccctctctcctcttcccctacaggccagaagcggggtccagccaaaggctgtgtccccatctcacatcgagaaccagaggcccagcgacgtgactcccacgaggctcggctaggacagcagcccccactgcatccccgccaggtgaagagtgcagctggggagaagggagtgcccagagggacccagaggaacgggcagggcgtgcagggggctcgctgagcctgagctgagctgaggccagaggagaggggtgggcaggaggaggccaccacaagaggcgggggagtggtctccaccgagccatggcggggtgggctgctcctggagcagggaccccaggggttgtgcttagtttctctaggggtggtgggcaagggggaggtcaggccaggttggacctccccaagggtcccggtgagcccaggagcacccgactcggggcctggatgaggggaagcgaaggacggacacgtctccaagcagctccgacaagagatgcctgtgccggggccgaggaaggcaggggcaggcaccctgcactcagtgctggacatgttggggccgcagcccacccccgcctgccagaaccgcacgcaccacaagccacgggctcaggacagccgcacggaggccactctggctaggaccagaaggtgggcccaggacaggccctgtgagggcagagtcttagataaacagacagagggatcgaggcctgagcgcagacagcagggccgggaaggggagacctctcaccaggacctgcagccccaccttggggagtttaccctgggttccgaggacgctgctgtgtggtctgaggacagggtgggccggctgggccgcacctgctccacaccgacaggaagctgtggcctggtgcaaagcagcgccagcacctgggggccttggctgccaccaccacgcggagcgcacaggagactctgggaaggaggctgccacacagagtgggcgggaggctgggcgaggcctgaccaagaaacctctcctggggagactaagccagggcctcagccctctacacaatttcgttaccaaaggaggcgtggttttttgtttgtttgtttgtttgttttgagacagagtctcgctctgtcccccaggctggagtgcagtggcgtgatcccggctcactgcaagctccgcctcccaggttcacgccattctcctgcctcagcctcccgagtagctgggactacaggcgcccgccaccacacccggctaattttttgtattcaaggaaaaggaagccggaggcctggcagatggggcctggcctgcgggggaggtgagggcggggttccccccacactgctgaaaacccccaaaggctgcaagaaagggaaactgggggtagatctcatcccagtaggaggtacacagtcagcgcgtttgaatcaggaaataccagcatccctatttgctatttaagactaatcaggtaaaccccaaagaaaaacacagaagcagccgcatccgctgcagagggacccagaggggagggcaccgcggccacagagtggggctctattctcaccataaggcttagtaactctctgacatttaaaaatatacacaagcattactctgaaaaaacacccaatcgtaaagataagaaggctgttgcccacaaaagacctgggggatgggcttgtccccatcaaaagtcctagggcccagcagtcacagctcaggacgccccgggccccaccctgaccctgtggtggggcctgaaccacacaagatggctcagtgagtccaggtcatctgtatggtccacagcctgggccccggggcacgctcagctctcaacccccacccaagccccgactgggaagacagtgtccaggtctcatgaaattaataaaataacttcggatcagctgcatccggcttaggcaccaggtggagctgcccatgccttccccgcagggctgagcccactcagccggcatgtgcggggctaggcccggggtctggtctcagcctcccaggagagcacagaccctgcccctgtgcaccagcagcctgagggtgtctgtggccccaggtgaggaggagcccaggggccagatctgttcagacctgatcagagtggggcctgcagagccacctagtctccaaaaactcagggctgcccaggacagatctcctagggatgcctcttctcccctttcccccaataatcgggacacggagcaggtggagggtcactcaggaggaaggaagatgcccaccacggctgagctcaggaggaaggaagatgcccaccacggctgagctcaggctctctggggcccagccctccccacccactcccccgccagcttggcaaccaccaccccgcctcgaccacaagccatcatgaccacgggcagccagcaggtggccccaaagagatgtatggagcaggctcagccagtgagagcctggtcccagcacagggacaggggtgtatcagcagggaaagggaaaaccacaatgaccacaactcaccaggccccaccagagtgcatccgcgtaggtgtcaaagtggtcgttctcccccttctctgccaagtacaccaggaacgaggccaggatgagacaaaggaagccgatgtaccaggcagtgaccagctcctgagaggcagacggcaccaccatcatgaccaccatcaccagaagcatcaccatcaccaccaccaacaccaccaccatcacatcaacaccatgaccaccatcaccaccaccaaaaccatcaccaccaccatcaccaccaccaccaccaccaccatcaccatcaccaccatcaccatcaccaccaccaccaccatcatcaccacctccaccatcaccaccatcaccatcaccaccatcaccatcaccaccaccaccatcaccattaccaccaccattaccaccaccatcaccatcaccatcaccaccaccaccatcaccatcaccaccaccatcaccatcaccattatcaccaccaccatcaccaccatcaccaccaccatcaccatcaccaccatcaccatcaccaccaccatcaccatcatcaccatcaccaccaccaccaccatcaccaccattaccatcaccatcaccaccatcaccatcaccaccaccatcacatcaccaccaccatcaccatcatcagcatcaccatcaccattatcaccaccaccaccattatcaccaccatcaccatcaccaccaccactatcaccaccaccaccatcatcaccaccaccatcaccggcgccaccaccatcacatcaccatcaccatcaccaccaccaccaccatcaccaccaccaccatgatcaccaccatcaccatcaccaccatcacatcaccatcgccaccatcatcaccaccatcaccatcaccatcatcaccaccaccatcaccatcatcaccaccaccaccatcaccatcaccaccatcaccaccaccaccaccatcaccatcatcaccaccatcatcaccaccaccatcaccatcaccaccatcaccatcaccaccatcatcaccatcaccatcaccaccaccatcaccatcaccaccatcaccaccatcatcaccaccaccatcaccatcaccaccaccacgatcaccaccatcaccatcaccaccaccaccaccatgaccatcatgaccatcaccaccaccaccaccatcactaccaccatcaccaccatcaccctcaccaccatcaccacccgccacctgcctccaggagcactgcagcctcgccagtcagcccactttgggctctgtctccagggatataggggctggatggacccgtctcctgaggccagcagaggctccacgccagggtcggtggcagggctggcacaggggaaccaggaggcgccgctggcttcaccatcttagctacggcagcccattcccctgagcctcctggcctgggcaacagtggctcgcacggccagcccaccgtgccctccagggtcagtagcgtctattctggcggccagcagggctggagaatcttgggactgttgagaccctcccccaacctccctgagcctccgggcacagatgtgaaaagggtgcccactgcagtcagcactcaacccccacagcgtccagggagggagaggggccaccgggggctgacccctgcccattctgcagacaaagccaccaccctgccagggctcaagagggaagaaaatggggagggggccatttgagcaaatgagcccacccgtgagcaaggtggagggacagcacagtctggcaggatggggtctcggtcactggggggcctggggcccctggaactcagcatgtgtggccacagccaccctctgggtcccccggacagcggccgccgcaagccgcagcttaaacaaccaccaggcaggtgactagcactttgtattgatccaggcactaaaaacccaggaaagaagacacccaaccacagagccaagggttcgcggcaggaaggtgggggtggcaggggccaaaatggcctggcctggcctttcgaaaaagcagctttctggagacagatgacaaagatggcccaagtcacgagaagaagcaccgagaagaaaggggagggaggctcgttcacacctgatgggctccagccagagccaccactgactccatccctccacccagggctcttgaagcaaaccccaggcaggggtggggcccggtctgggccaggactctcgctggctgggggcgcccaccgccagccttggggccgtgactcaccttgctgtgggcatagaccacagagcccagcagcttccaggtgcctccccgccggtccatgcggatcatccgcagaatctgcaggaagcgcaggctccggagcgcagatgtggcaaagacgttgccctgggagccggcggccagcaccgcaatggaggcgatgagcaccatgatgtctacaaagcgggcgtggagctggtgagctgctgggccgctccccgcacccccttggagaaaactccccaccccgcgttccaggaggatgtgcagaggggcgggaaggtgtatgcccagcgcctggtgtgggctctgtcaggccccaggaaggacattactatcgtccaccctgcctgtggggcccaggatgggcagcccagcgccacattcctcttcctgacatttaggcagagttaaccacagcctctgactccaagtcagcaggtgaaaagaaacttccagaaggagccagtcctgcccagcctctctggcccacgcagacgccccagctccccccagggctgagtccgtccctgggtgcctggccctgattctagcaataccacccccaccaggcctcaccaatcacacagaacggtttccgggcaaacttgagccgccccctccagccacggtaccggcagcagcagcctgcggcccagatccgcacgaagtactccacgccaaacaccacgatagtcacgatttcctgcaggggaggaaagctgaggccaccttgaggcctgggggagggcctgggggcccagcctggacacccacaggagcagttctggcccagggaccaagccacagggcaggaggcccccaaaggaaactgcaagctgacccccccacccctctccagcctctgggcaggaagggttgggccctctggagaccctgcatccgggaacacagctgagcatgaacaccatggggccaccctccccacctccctgtctgagctggggactctatctgggctaggggaccatgtctgagctggcagggctgccctgtctgagctagggggttctatctgggctagggaaccctgtctgagctgggaggccctgtctgagctgggaggccctgtctgagctgggggaccctgtctgagctgggggaccctgtctgagctgggaggccctgtctgagctgggggaccctgtctgagctgggaggccctgtctgagctgggggaccctgtctgagctgggggaccctgtctgagctgggaggccctgtctgagctgggggaccctgtctgagctgggggaccctgtctgagctgggaggccctgtctgagctgggggaccctgtctgagctgggggaccctgtctgagctgggggaccctgtctgagctggttggggagctgccctgtccaagctgggggactctatctgagttgggggcccctgtctgagctgggggaccctgtctgagccagtgggggacctgccttgagttggggggtgcacagcagggctgagctgagggaaggccccaggtaactgcaaagggggccacagtctccacccagaccttgggaagccccagaacagaggagcagggcgggcagtagagggaggtgcatttggatggggaccagtctccttgagggccccccaccccgttaccaacagcaacacaggaactgcactcccgttgccatggcgcccaccctgccctggcacagggttgctgcaagcgtcacagcccccaccccgacgcccacgtctgccgtctgctggggacgccccacatctccggctccagagataaagtggggatgggaaagggagggtggcccacccagggtgggggcgatggaggcggggctgtcagccactgtgaggtcaccaggaggggtgaggtgagggctgagttacagccagggtggggctggggcatagcccgggctgtggggctgggggcagatgggaactgacagggcacaaagacatggccagagctggggctgggggcgtcagaggccctgtagtaacaggaacggaagacagacgcccaggcagctccagctccttcctgggcacttccagcccccgccctccctcggggctcaccaggatgtagagggccccctccgagctcttctcatactccttgatggtggaaaacacagacagcacgaggcaggagaaaaccaggaggaacctgggggcagggaacgcgcgctctcagacaggccgcagcagggcagcagcatggctgtgtctccagaactcaggaccccactccccaccaggccgcagcagggcaccagcatggccgcgtctccagaacgcaggaccccactccccacccaccccaccagagctcgctcgggccagagggcacccccatagccacctcccgggaccctgaactccacagtggcagctgccccctctatgcgcagctgccccctccaggacgcacccccctctccactctggcccctgccccttctgtctggtttcagcctggcagcctcatcctttggcaacgtctccaaaactctcagtcaaatgggaacagcaaggcctgcccatcaactgctacaaacacaggaacaagcaaaacccctggggcagaaggcaccgatcagccttcccctctcctcactctcggccacctcctccagaccccaacgcagagggcttctctctgccagttaaacccggagccaagcaacaggagctcctcggatcaccttctttccagcctcgtcctggctgccaggaggctccgtttctccttcctcccgggttgcaggcacctcctcccgccagtgacttccaccatgattgctcttcccattcacgtcccacgcgattacctcactcactgatccttcttcaatttcccctcagatgctcaagttcacaccccaccaaaattcccccaaatgcatgtgggtatttttgtttttgtttgttttgttttgttttgagatacagtttcacttgtcgcgcaggctggagtgcaatggcgtgatcttggctcgctgcaacctccgcctcccgggttcaagcaattctcccgcctcagcctccagagttgctgggattacaggcatgtgccaccacaccaggctaatttttgtatttttttagtggagatggggtttcatcacattggccaggctagtctcgaacacctgggctcaagtgatgctcccgcctcggccccccaaagggctgggattacagtcatgagctaccatgctcggcccaaatgcgtgactttttctcagccctgcattctcctctgatacaagcgactctgctacacttgctcccttgcccaccccaggaagctgcagacaggaggagcccgctagcccccgaagaccctgccgcgggaacccggcttgtggctgcaacaaggccacccacatagaagagacatagaagatctcccagctcttcctgggagcaaagctgtgcaacccagagcctcaagctgccgctttggcaggaaagccaactcccgcgtgctgaagtcactgaatgcacaccagagagaaacccacttcgcaggaagcaaatgctttgtctcatttacatttttcgcaggtgttctgggatgtgaaggggacgtgtccaacgtccaggtccttcgtcacagccataaaggaggccatgcgtgggacacgccctcattccaggcaatgtgagagacgccttcaccttgaccgtgttgctgcctctcgttccaaccgtgctcagaaccaggagccggcggggacggagccacagagcagccgcttccccgtgtccgcgcccctgtactgtcttcacactcgccatcaccttgcacaccctgcggcaccacacgaccgccacggagcctgtggggccctcctgtgtctcaaacccgagcccttccccggcgcccacatccaggtgggtgtcaagggagggagattccccacactcaggatctccttccctctgtccccaaagcagtgctgcagtccagcctgggttccgggcagtgtccccgctcccctctccccactcccacagaggaaatattccctggatgccccgacctgcagggccgagactgggcacaggcacgggcatcctgggggaagtccctccagcccggatacgcccacccctgacctgctgggccggggcactggccacaggcatgggcatcctgggggggagtctctccagactggtcacgccccctcatcattggagcttcggagcatcacagcacctgtctagacccacccctcctgtctcagccttgcaatttcctttccagtctgggggtgcagggatgctcatgggatcgaggctggccaaccacggccagcgagtggtggccccagaatctctgctggaactaccaggaataagacacccccttcccacaaaggttgccaactaggaggaggcaggcctggggcactggcaggaggacgggtgggcacaggaaaacctgcctgaagatgaggtcatgaggaaggcagcacagaaggatgggagaagaggccttaagacacataatgtgagcacctggatccagctgtgcctgaagccccttggacttccaggttatgtaagcccattccttacaaccctttgcatttgttttctgccccttgcaaataaaagaccatgacctttcacgctatgagcagctgacatcggtgtgtccctgctgcgagcccacgcctgactccaccatgctgtggccacatgctactctgacccacagctcctccctgggcagacaagccacgcggctgtgacacaagctgccacggatcaaaaaggaaaaaacaagtcctcgatgtgcggagctatttagtgagcacaggtcagcgttggccgcagtgcctggagggtctggagggtttggggagcagaggtcagcattggctgtggtgcctggtgggaagaggaccccactctgctcacggcttcactgtcttgtgggagagcccctggggagcaccgcagagagaggagggactcaccaaaggccgagctccacagcccgggagaagagggaaaagccccagcgtctgagctcctgggagaagagggaagagggaagccccagtgtctgcggcctgcagggagacttctcagacttttggccgcggaggcagaaggacagggccaggccatccgggcacaaacccggggcccccatcaccccaggctcaggctctgagcccccaaaccaggaccagcccactgggtggtggcagcaattggagcacgtaattgggcccacatctgacacacagcactcagagcagaccccgtcccgcaccatcagtgccatcaccagcacccacacccagcacacaaccctgcgctgcctgcgcccctggaacccgcccgccaccacacgagctcactgcctctgcccctgcaggcccctcaccccgcctcaccccctccctcacttacaggcccctcaccccgcctcaccccgtccctcacttacaggcccctcacctccaccaccactcctcccccacccctccctcacccaaagggacgaagtgccccaaaccctcttcccactgctccggagggacctagacgaaaccctggctgctcttccagaggtcacggcccagcacacgtgccggacgagggcggccgcagaggcccagcaaggccaccacacatgaggtcagggctggatctccctccccaagtggctttaggcttccaggaataaggcagcactgatgcctgcccccgctcccagggccctggggctgccccaggtgtgggacgctgtggctgccccatgcaagggccaggactccctgaggcagcactgggcgctgcagtcacccctgggggcagagccccagaagacctgctggggggtgggggaagactgctgggggtgggggaagacctgctgggggtgggggaagccaggagatccctagcgcagaggtcacacagggtcaaggtggggtcaaggttgaacaagagtggcaggcgcccaggtgagagctggcagagcagcgtctgtggagccgaggctgcgggggcttggaagcaggggagggcagacctgtgcagagagcccttggcataactaactccatcttaggaaaagactccattttgtctcacagggcactctaccaagaaggataagatgtctgtttaaaaaccaaaaagcaaaaaagaagaaaacctggccatgcatggcggctcacgcatcagcacttcgggaggaggccgaggcgggcagatcacttgagatcaggagttcgaaaccagcctggccaatatggtgaaactctgtctctactaaaaatacaaaaattagccaggcatggtggcgcaggtctgtaatcccagctacttggaaggctgaggcagaagaatcgcttgaacccaggaggcggaggctgcagtgagccgagaccatgccactgcactccagcctaggcaatagagcaagactctgtcccaaaaaaaaaaaaaaaagaaacaaacaaacaaaaaaatgaagaccaagtccaaccagataaggacacacacaagccagtcctccgtgctcagttctccctggaggcctctgtcttcaccgccgctgtctcacagtcacctgcagcagcccaggccaggcctctgggctggtattaaccctctgtcttgtgtctttttcctcatgatgttaaacctggctttgggtggaaagtggaatttgaccagatgagcacacggcaatatacggtctgcaacactgaccaacatggagtggccgtgaccgcagcatgacccagaagctctagggagaacctgcctgcttggggactccacgtagctcgtggcttttgtgattgaaacagcatcaataaaagcctgaccctgtggaaagacacaaacccgcgtggacctcgtgtcaagcccatcctgtgtgcaaagtgcctccaggacctggggacttgggcaagctcccttcagccaagaacaagagggtggccatgctgttccaggctcgattcacgacggacacccccacggcttccctctgcccggacccagtcatctccccactgaacaccctctggatgtggggaggccagcatggccccctgcagcccccctcccactcgctggagacccccaagtccaggcagcctgagtcctctggcctgggcaggcgcagtccccatagctccaccttccgactccccagcagcggcctctgctgcacggcccagggcgtccagggcagggaaggcggggcacagggtggtcctcccaagatctgccccgggaaggaccacggccgtgcttcagaagcacccgggaccacacagtctgaagcagaggtggaggcttcgggcacaggcggcccggccaaggtcagccccaccaactgcccattccagcaccagagccaactgaggcctggcactgctcagccacaggcagcggcggcagaaactgtgcctgtgaaggctctggcccagcacccaaaccaaagatgaaggcgcaggggccaaagccacattttaaagcgtctcatgtgaaaactgtcagcatctctagcgtgagcccaagttcagattctacccacgtacaccccgaggacgtcccagctccatgccattgagaagctgtaatccagtgcctgcctctgagctgagggcagcaggctggaaactcagcacgacttccatgttgcggtcttgaggaaaatcctttttcttccggaaacctcagtctttgctctcaaggcctcagctgctgggacgacgcccacccccacggcagagggtcactagcttcacttgaagtccgctgagctaagtgttcatgccgaaaaacacctgcacagcagcgtcgaggcaggtgcgtggccaccagccgggcaccatggcgcagctgcgtgtatacagagtgtatgcatacagtgggcatcacgggctgggagaggacacaggggcctcggccagaggcctgggactgcagcaggaacgggctgattcagcggtgcaggcacagaacaccctgactgatgctgaaggacagtggtggggagagccaggtctctcgccggcagctcggctccagggcaggtccaggccacacacctgcccaggaccccaccagctggcctgcagccacagagagaggccccaccgggaccctcctcgtgggaactgggagcctccacacaggccagccagaatgcctcagcccgggacgacgcgccagccggagctccagctgcaggggcaggggttggggcgggggcttccaggaagaatagtccctgcaggctgaggggagggtccagggcctagtgagaagctcaaagcgcagcaccgcgtgtggaggccgggtgggtccaagagccagagcctgccccacgctgcacccctccccgccacccccaagaccacaagccacagccaggtcctgccctatccagctgccgccccgcggtggacgtcggcacagcagcaccaggaaggccctgtgtcgggcaccccaggagacaccagtcctccgcccgccgccacaggcccacggcttccagctcgaaggcactggccctgaggcaccgtcgccagggggcactcggccccgcccacgtgtgcgacccagaggcctccgccaggaccccgaagctcccggctccaggcaggggcgctggcagtggtgccgaggcccaggcagacaaaccatacgcaagggacgtcccatttccaagccgcgattaatttcctgtgctcgttggccaagttcttcaattaactgagccctgggaaaaatgcgcagacatctcgtgcgccttctgcgggcgatcctctgtctgcctaacggggttttctctgaactctcagcggggtaggagcaggggaggacgcgggggtccctggcttcccagtcaggagcccagaggcttgggaggcaggaggggcgccgcggggacacagagggcatcacacatcacaggaggggctcagggacccagctcagcccagcagagccacgcacataatcctgtgggcttcccggaggaggcgtgtacaggggcgggggggctacaggatacagaggagttggccacagggggagaaggggaagggcattcccagcagagggaggagccgctggggaggcctggcgagagaagggcaggcgtatctgcatcccaccgaggatgaggctgaccagacttgagaacagggcggggtggggacaacgacagccccacagacttgaattctgagtcctcagtgccgcatccaggaaggcagctcctcgggctgcagggaaccttcctctaaactaaaaaaaacgaggcccaggtcccaaatgttcaggactcagcctgcttcctaaggtggctccgaccaggcatctcagagcattccagaaaccctggagacagaatgcagccggatgcggccgagatctgtggctcctcccagcaggcgtggaccaggaggaataaagccagaattcagggagatgaatctcgcagccaggccctcagaaggctccagctccttccagctcagcttccgcccatctgcccccgcctcgccggcccgcagaccctgcatgaaggaagcagctgcccctcccgccgctgcccctcctgccacagccccacccggaaagtgcaggcaacagctccgacttttgttttttaagtttttggaacagatggcacagatggcgctgccgggggcggccggtgcaggggaggcagagagacggacgtgcgagaagagccttggaggagggaggaggcggcacggggtgcgtctgggcccgtctgggggacgcaaagatcccggtgcctcggccgtggctccaggccccaggacagaccagggaagaaacctccaaactgcggatagttcccaaacgcactggccagccatccggtcggccgaaccgtggggaagacacaggggcttccaggcctccgcctacaaaccgtggtgtccccaagacatccacactcatgcccatcttagagaaggggaaactgaggctcactgaggcaggtgagggcctctgcctctgaaccaggggagggagagggcggcaggagacccctgatggcatcccccaggcctcgggagaggaggctccccgggaacactgggacacactccctgcccatgtggcctcagggtcccaggcacgacgagcgtccaaatgtgggacactccctgagggccagctgccagaggcctctcgggacggggccatcaccacctcagacccaggcccacagtgtgggtacagcccctcctgcactaagctgggggacacagcccaccacggggcactcagctgaggtctcgctggctcggcaagggctgcccgccccctcctgcccaggcagcggccaagtctgcaggaaaagaaagaagagacttcctacgggagaatgggggaggatgaggggaggacggcgggaagacgatgggaggatgggaggacggtgggaggacgctgggaggacgatgggaggaccgagcagcttctctgcagcccagaattacaacacaaagggtttcgaagctaattatgataatgggttcaacttccggagcttccctggcagccgttgccaaggagataaggcaagtagctggtccccagccccagattcaggcaaagagtcaaggtgggggcagggaggatccacagagccctggcacccaccactgagcagaggggcagggggacacctggaccgcgggcgtcggctggggctcaccgcacgtccctgacgcacagcccagccccgtgcccatcagacagccccagatcacaagagaggccatggcggggatcaggcaccccgaatgcagtcacagactgagcatggagcagcgggggatctcctcctgggacctgggacccaagtgcaaagaggagaagttggggcagggaggggcccatgggagggaccaaagggtcaccaggccagaggggtgcccagttaaggccggaccacagtcctggggcccccaccgcccagttaaggccggaccacagtcctggggcccccacgctggcaccctcaggccttgagatgcaaaaactcctctactcacggggcccccacctccgggagacccctgtgctcacggaccccccacctccgggaggcccctctgctcacgggccccccacctccgggagacccctctgctcacgggccccccacctccgggagacccctgtgctcacgggccccccacctccgggaggcccctctgctcacgggccccccacctccgggaggcccctctgctcacgggccccccacctccgggaggcccctctgcttcacgggccccccacctccgggaggcccctctgctcacgggccccccacctccgggaggcccctctgcttcacgggccccccacctccgggaggcccctctgcccacgggccccccacctccgggaggcccctctgcccacaggccccccacctccgggagacccctctgctcatgggccccccacctccgggagactcctgtgcttccaggtctcccccgccttccttccccattctggttgaaggggatatttcttttctgggaaagcatgacacagacgccgccaccccgctcctcactcgcttcatgcacttggggaagaggactcgacgcaggaggggtctgggccccccgagtcagtcccacagccagccccctcgctctgcgactctggatcctccagtcaggccccttccccagaggctgactccaagttggccagggctgttcatctcatcttgcgtatttagttaaatgaaaacggaacacgtgaaggatgggcgggcaggagggaaggcgtcaccacctcaccgccaccctcagcccctgcctcagacagagccagggttgggtcaggaggggcccctgacatcaagaccccactcccactccacgggctaagcttctcagcacacccatgacctgccaggagggaagcagccctacagtcacgtgcccatttcacagtcgggaaaacagaggctccggagactctcagaggcccacgtgcggattggccagagctggctggctgcacggcccccaccatgcacccctctcccactgcagggggtcctggggggtcccacgcagcctccttaggcagaaattccctgtccagaacaatgtccatgctgatgaggctgcacctccccggggctggggacctgggagcccagcagggccccggggatgagcagaaagccagcgtgaggccggagtgggcaccaggtccaggactgctcgagcctccctgggggccccgctcgcctcgtccattaggcagccgccacgctgcaacctggaatctaatttcaccatctaatgaactgctctgtttccaggacacacgccacctcccacctcagaagtgacgggcgcgggcgccgctgacagagtccaggcgtgaaccgggcatgaaccaagcgtgatggatcactgcagaccgccggggctggaggggacaagggccacgctcctgcagagctgcacacagagacctctcgcgtggagccgcctcatgctgagcactgcgtggcttgtacctgccaggccagggtccaccctcattcggagcttccggcagcacccacctgagcctaaggccatggggcagggacgggaggtgacccaggtgggaccgagcctcccaaacactgggtgctcaactggaccctgacaggacacaggtcaggaagtctcaggtcctcagaaggcccagctgctagcctgatgctcacggcctccaaacggcctgggcctgcctatgcccgcctgcacccacctggcacctacagccctccttccaacatcctgggcagggaggcgctctcagggggctctcgatgccccacactgaccatggccccaggatggccacttccttcagccagctgtggctccctcgggaacaggagtggaggagctggaggcgggggtcctgcccacctgcacgttgctccctaaccactcccgcagcagacgcccaaggcccacagggacccccagccccctgcattgctgcagcaaccacaggtccttccagggccttcgccccggcccagaaagagggggcatccgccatgcaccccaggggctctgggagctgcagctgtgggcagactcccaggccctggcaggaaacccgctggctcagcacgtggttaaatcagctccccgggcactgcctcgtgacttcgcagcgcctgctcacggtccctggagacggaagctccgcagggctcatttgttctccattagtcacctgtcccacccagaccacaggtgctggacagagacccagccggtgcaccaagcagggctggccaaagtgcccagcccagccccatgcagaggtcctggcccgccctccccgaccccgcaacctccctgggctcgcagcccctggcctggggtcccctggactttactcttcctcccggcatgccccggctacccactctccactgccccatcccaacccactgagcccgcagagaagcgcccctgtaccagccactttgatcccagaagcatgtggagaagctgggtgggaatggcagccagcataggcgagccccaggccctgaagatagaccccaccctggcctggccctcgaggccgctgcagtgcctcatggtggaccccacgcgacccatccaccctgctcccctcctgccctcggcaaacgccgtccctgccccagggcctttgcacgtgcacttcctgctgcctggaatcctctcctacccgcaggtcccagagccgccccctcatcccccaggcttcaatctcaggtcactttctctgaaaggctgcccgaccatcccttccccgggcagcccccaagtctccctggtgtattctctccagggccctgagcctgaccgagcactgtccccccagagcagcggtctgctcgccctcccggaggcaggaccccacatcctctgctcagacagtggccccaagtgcccagcccagaacctgcacagaggcgtctccccacatccaggcaggcggcagccaagaccctgccctggccaagttgaacctgctcgagagcccaggctggcagctaggcctggggcccacactcaggcgtcactgcaccaccttccgcacagcgggaagagcaaggcgagggctccgggagggggcctgtgtgggtctggggggctgagatgaggagggcacggcccacccagggcacctggccacatgtgacgcaggcttcgtcccaagaggaatgacgaaatgtccagagacactcaccgcgtgtccacagcagcctcacggcagacgcaacccaacatccagttggtgggtgggtagataaactgaggtccgtccgtgcggccacaggaaggacgaggcagcggcccccagacacggagaggatgaaggagtaccctaaacacgaaggaacctgagggcaggctcggcaaggaaagccaggcacaaaacggcaccacgatgacaactccacttacacgaaacatccgaagcaaacaggccaggcccggcggccacgcctgtactcccagagcttggcgaggccgaggcaggaggacagcttgggcctaggagttcgagaccagcctgggtaacacaatgagaccccatctctacaaatgatttaagttagccagatgtggtggggcacctgcagtcccagcgactcgggagacggaggctggaggatggctcgagtccaggaggtccaggctgcagtgagctgtgattgagacactgcactccagcctgggcgaaaagagaccctgcctcaaaaataaataaattaaataaaataaaataacaggcacgtcacagagacaggcaggagaccggcaactgccagggacagggtggggcacacgatggcagagggcaagagtgtccacatggggtgacaagttttcaaatagggctggtggcggcagaccatcactaaattctccactctaaacgcctctgaattactcgctttaaaatgctatctgcatgttaggataatttaacctctatttttaaaaaacaaaataaaccgtgttgtcaaggtctgggacagcaagcgcacacaggtaacctgcctgcccatcagtggctctgtgcctagggtgtccacccacctgtgcctcagtttctctctgaataggatagctttgggtggggagagttaacactcaccacaccttgtcccctccagactcctccagtccatggtgctgttgtctcggtaggaaggctggaatgtggacaggtgcgtttacactacaggaagcagacggcacccggggaccttgtgagctgtagaatcgccccttcttctgtggctgaagcttggctctggccctggccagtgtccccatcccagcccagcctactcctccccaaacccgagccccggagcttccctgtcatgcacacccccatccccagcacctttggggacccctgcttggcctggcctgggctcctgaccctgcaggtccctccctggccttacccaagcccttagcagctttggggagcaaaggcttcatgaggtcccaggggagctggggtggagaggggctccccccaccctcaacaagggggctcctcctgagacatcccacactcccttcatgggctcaagctgcctgtcagccccacccgaaacccattcaggtgctgagggcaccccaacagtggcactcctgaccgaggctcccagcaggccttcccccccacagccccctgagacagccacgcctaaccccctcccaagcaggccagtgccctcagctggtccacggctcacagctccagtccctggccccctacaaacgtcctagtgagtgctctctctcggcctccacttgcacacctccggcgacggagggctcaccccacagaaagaatctcgttccaacacaagcccctcctgggccagcctgcgtcctccctctcccctcaccagccttcctggccagggtggcctcatcacctaatcacattcaggcagacccggggcctgcaggacagccctggatgggacacatgtggattccccaagcctcatgtggacacgtccccaggacagctgtggtgtcgacatccacgcagggacaccacacaacacagggactctgccgtcatccatgtccacaggtggctggacaggtgctgcggcagccccaggtcagagacaagccaactacctggcacgcgagactcatcttgcccatgagaagtgtggacagtatgccgttaacaccacagcgggacgggaccgcctgaatcctattctgtttagaaacgcacaggcgggcgcagacacctggaaagaaaccaggaagagcaaacgtccttccctgttttccacgctttcccagtctcctgcggtggatgtgcttactttgcagtcagaagaaaataagccacgaccaaacgtttatttaagaaacgagggcggcaggggccgccagaccccctcaccctgacagacgcagccctgtccacccgccgctcaggccaaggcccccccaactttcttcacgtgatcttaactcagctcttggctaattaaatggcacccgtgggaagggatggtctcagataagctggctcagtgctaattgtaaaggagagaagccggtcgtgtaccttgccccagcagccaccccccaccgatcattcctcgggcacctcccaaacaccagccccttccccatagctgcccagaggtgagccaagcccctgactctatggcctgggcggatgccaaacaagaatcacacaaggggatcctctggcccacgaggagccgcaactgcagctcctggtcaggaccatggccagcaccccgggggccggccctcctcccccatccccaagagtggccccagagcctaatcaggtaggagggcagaaatatcacctaccccaggcagcagggaggaggaggctgcacctaccccgggcagcagggaggaggaggctgtacctaccccgggcagcaggcaggaggctgcacctaccccagggagcagggaggaggctgcacctaccccagggagcagggaagaggctgcacccaccccagggagcagggaagaggctgcacctaccccggggcagcagggaggaggcagcacctaccccggggcagcagggaggaggctgcacctaccccagggagcagggaggaggctgcacctaccccagggagcagggaggaggctgcatctaccccaggcagcagggaggaggcagcacctaccccaggcagcagggaggaggctgcacctaccccaggcagcagggaggaggctgcatctaccccagggagcagggaggaggctgcacccaccccagggagcagggaagaggctgcacccaccccagggagcagggaagaggctgcacctaccccggggcagcagggaggaggctgcacctaccccagggagcagggaggaggctgcatctaccccagggagcagggaggaggctgcatctaccccaggcagcagggaggaggcagcacctaccccaggcagcagggaggaggctgcacctaccccaggcagcagggaggaggtggcacctaccccaggcagcagggaggaggctgcatctaccccagggagcagggaggaggcggcacctaccccaggcagcagggaggaaaatgcacctaccccagggagcagggaggaggtggcacctaccccaaggaacagggcatctgcccccacatcaaccacctgagcagcaggcagcctagagtggtgccccagagcctcctctccctgcacacaccttctgtctccagcctggacgggtttccacaaaaatgtaacttttcaatgacaggaaaagtgagtgttaaacttctctgcatatttggtcctttgggatgagaacatttttacagccaccaggcagcttctaggaattcatcctgccgacctgcaccttgcgtgaagatgtgcatggagccccacgcagcaccatttgcagcggcaaagtcctagcacctgcttcaaggtccatcactgcaaaccggtcagagaagtcgtgagcgcccgacggagcctagagggggacatgcagggagagggggccacacgcacaaggcaggacacggagtgactccacacatgtgaaaagaagtgagtgaacacacacagacacacacatgctgtaccgtggcacgcatgcagagaacggctccaggagatgggccatggctgacccggtacggagatggggcagcgcagagggggcaaatcatactggctggacatcattttatatatttcagggtttccgtgggtgtcttttctgtgtgtgtgtgtgtgtgtgtgtgtgtgtgtgcacatgtcatgtgaatttgacctattctggaagaacgggtaagaagggggtcatctcccagctactcaggaggtcaaggcaggaggatcgctcaggcccaggagttctgggctgcagtgagctacaatcacaccactgcactcagcctgggccacagagcgagacccccacacttaaaataaataaataatagaatacggacatcaggccctgcctggccttatctggtctacaaaggggactccaggctgcctcctgctccgtcctggggtggcgctccccgatatccctgcctccctgaccaccctactccaggagaaggaagcccagccggccgagtgctgctgcccttccccagggctcagcctccatgacaaactttaaagtcccacacacgtgccctctgcaccctgagtcccagcttagaaccctgcacccgcacacaggggcagaaacacattaaccaggcgcctccggcctcccgcccacagcccctcagggcagacatcccaacctctcatccctgcccgaggcttctccccacctcctcccaggacagggagccaggcagaaactggccttttgctcccactcacccttctcatgttttttccaaacctaaacagaaaagcaagctcgaaagttctcaggtgttcagcttacgtcacgggtaagggctccatggggaggaacaaaactagagaagacctggaggatgaggcgggggcagacagaggcagcagatgcctccacgccacagatacagaggaagaatctagaaggaggctccctgcaggctgggcagcctggagcccagcccctgccacacccccaggagctgcccgtccgcccccactgagatgattcagggatgggagactccgattgttcaacccactccccgccggacttcctggagcaaccatgctctcctatgcatccacaaagccattcccagcaacccaaaaaaatgaaagacctaattttgttcaagctgggtaggcagcagagcctaatgtcagttccagagcacgtctggaaaacatcctcatccccaaagcgaggcagccactgtctgaaaaccaccactccccctgcgagaggccgcccagcatcccctgtctggggccagcacaagctgctggccctgggctgggagctctgggcagctggtggccagagagaagccttctcagaggctggcctctccactcaagccgatgtctcctgtgggggtggaggggccgccaagtgccccgaggcctcggggcaggtaccttagcctcacccaccccagcccctcacctggcacggggtctgtggtttagacaacagaagggacatgaagctctgtggagagctcccgtcgccccgtcctccaccacacatcatcctggggacctgcgtgtgatgccccccacgcacagcagcctgcaccccagggctatgagcccctttcaagactgaagctcccaccggggccgcctaaccccacagggagcacagcacaggcccactgctaacaggagaaagcacctgcacactagctccccgacgctggaacagggccatggccctgcgccccacactccagctccactctccacaggaaaaggctcccagaatccagccactcagtgtgtgggggcaggggccctgctgacttagaaacaagtggcacattgatccgcattcaaacttgccagccaatcaaccacagccccgcgcacagactctcccaggtgggactgagggggtctcccctgtccttggcaggggcgtctcccccacgcacccccagtcccgtcctctccacaggctccagatgcccacatccccagaacactcaatgggacaactcagagcaggttacagagaaagaaaagccacacaagctcaccaagggcacgctatttcagaagtgccttctcctcctggaaatgtcgaccccaaagctctcactgggaaacctctggcctggccccgggaagcgacaggcgcaggtttggggctgaggccgtcccagcagctctgtggcctgccagacctcagagcactcccatcaggggccacaagagcagagagctcttcagccccatgttctcctggacgaattaaaagcacgacccatcccagcttcagaaaacaaaaagtctaaccctccatttcccagactccagaccaacctatttgctaagcagcatcctgagccactccctcctccagctctgtgggtacagctttctcaggctaaaggggaaacagaggggcttctcagggcccacccgccttgtgctggccgcctccctcacaccccctcacccaggagccatcaaggacagagcctcctcctgcagggcccacactccatcacccgctgctgaggccagcggtcggcagggccctgccactcagagcccactagggaggcaggaaccagaacccactccgaaatcaacagagaaagctcggcacacgggctggtgagcgtaggggtcgcacgcaggggccagcgggagccatttccagagagttcctcggcgacaagctcagatctgcaggcccctcctccttcgaccttgcatctgttaggcgtgttgaacaggtgccgcccaccctacccaggacgcgcttcctcctctgaggatgtccagggccctcccctccacaaaggcaccgttttgagactcccagagctgtcagccaagtgttgtcggaaggcagagctgagctccagccctgcaaagggcatccgcgttccgggcaccgccgtttccgctcgacgctccgtgctaaaggcggcctcatggctgggcgcgtgtcggtgctgaggcgtcccggcgggtcctctgctgccgtcccgaggcggcccggcgggttctctggcgcggtctgcgtggaaactagaagcttgcactgcagctctttcacagcttaaggggttccctggtaaaacctgcccacagtggtttctcaagccgaagatcattcctgtcctccaagcctcaaccctcaggatgctgggaacacgccggaagccacgaacaggaagacaatcccccaaactacccggcacacacagggcaggcaccttcgttccaagtgaacagccggcatctccgcggccggtcccacacgacaaacaggcaagcttcccacgctcgagcccgggccccgcgcttcaacccacgacccccgcaggcttcccacgctcgagccggggccccgcgcttcaacccacgacccccgcaggcttccgacgctcgagcccgggccccgcacttcaacccacgacctggccctcaacagcagcgcaggcctctccgtcacggcccagccgctgaccaatgggactgagaatcggccggaggggcagagcgacgccgtcccggaccggccagccatcctccctcctggcctccacgctccgtccggggtgaggccttccactctgctgaaggagcctcacggtcacggcgatgacagctacgagcttggggaacatcgcacgcatcaggcatcgtgtggagtgactcacacgttgaatcccggcggccatcacgtgacacagatgcagacaggttacccccaccacgcagacaaggaaactcgggtctaggagcccgacgctggccagtctcaggatgacgcccccggccagagccccagccctgccctccccgagcctcacgccccacgggtcacgcagggtcttcacaggtcacggccacacaggagcacgtctcacacgggcggaagcacagaggggagcggggctgcgtccacagaccgcgcacacacgagcagtttcccgtctcagagctgcctggcatgcacactggaaaatagttaagacagccccccgtgaggtaacacgcttgggctctgtctgtgatgacaagatgtcggacacaaggccaaggtctcccccgggggacatcgcaggcatcaccccaccatccttgccccccatcctcccaaaacgggcacattgctcccgcctgagcctttaacaggacacggcctggccgctggccccagcctcccgtcaaacctcaagtggaccttcggagggcccagggcacaggctgcccctcccctgcctctgggcaaggcagctcggccatcccatatcccttctccccatattcaaggcccccacaggtcccccttggtcctccagacttgcccattttcctaggagggaacccactctgtgtagcagattcatctccccacactggaagcagcttcaggcccagctcctctacggctcctctacggctgcggaacgtcattcctacagggctgaggctagcccggctcctgtgcagctatggaacgtcactcctacagggctgaggctagcctggctcctctacggctgtggaatgtcattcctatggggctgaggctagcccagctcctgtgaggctatggaatgtcactcctacagggcagaggctagccccgtgctcttgcgagcagctgccagacggacttgctgagtgtgcacacaggggccatggacgtgtcaggagcacagggactaacggagatccatagattcatttgtttattgactaaaacaaactgggaaaatcactatgttaagccactctccaccactggactcagcctgtgccgtgagaagtgaccccagttctgaaacactccaggatttaagcattttcaaaactggagacaggattcccacgtggtcagcatcctgggggccgagaatccttagtgcccagcagtgcccatatccagggcgccggcacctctggagagaccgcgtctctgcagagattggcttgcagtgatttctaataaaacagattttctctgctctcactgtggaatggtcaggaggagagtttctgcttatcctttagctcctatcctctcacagacacagaatgtgcacagagattgactccactgtgtaactaagcagcatcatgtacaatgtcttatcactccagagtaatttcactttaaattatttggtgaggggcagaaatcctgcgaggaagcccgagacctcccaaggggtccaggaaccagagaaatccaggtttccccagaaaccacaactctccgaggcttcttcaccttttgggaaatttccataagatttcctacacaggaggctgtgggaagaaggggaatgtggccgttcaagcactcgagtctctttctcggcacacaatgctccgtcagcagagactggaccctggtcctgccagggccccgctctgtgctgggtaaagcccaggcctgcactcacccctcaaagcagcctgaccaagaagagagtgtctgaaccccaccactgtgccaggcgcctgcccaccccagccagcccttcgagggctcacaccagccccagagctgaatgaaggggtgggaaagaggcccagcggcctgtgctcagcaccacccgagttctccaggactgtgaggggaagcgcctgggccccggcaccgggggacttgaacataggccctccgtcccaggcccttccctgcagtgaaatgggacacagcacctggtcaagcagcccagggccagaggcccctaaaaccctggaccccagctgaggcctggcgcaaaagccaggatggcacagcgagccccagggacaggccctccccggtgccagatttcccatctggcctattttaaacacagcttcactctggccactccacgtggctgggctgctggcaagatcaagcaatctgcacccccaagctctcatctcaggctgggaccccccctttcagttaagcaggacaactctggagctcactcaaccttcctctgcctcagtttccccatccacaggaaccaggctgcgtgaccctctggcaggctgtaactaagcggtaactgaggtccgcacccagcgggaacagagcggagctccctttcccacacccagcaacccacgcggggatcctggacgaggaggttcaactccgtggtggagcagtgcccggctccagtcctatgcgcagatgggctgcaggagagaggctggagcccgggattcaggctccgaagggccccccatggtgatctggcccagagtcccctgcggcagccccaggggcacatcatctgctagttcgggccatttctgcagctcacactccctttgggaggtctgggagaggtggcccagcaccccgccccgaccaggcagagagcaggtctgacgcccttctaactcagagaaggccctgtctccagagcctctgggaaagcacccaggcagtgcgagcagaggccacggctcccacagaggagcaacagtggatgaagtccctctctaactcagtgctggacgtccccacctccccagagcgggggcagcaggggcctggcctgacgcccaccaagccctggggccatggggcagcagccaccgccctctctaccccagacagtggctaccccgggtccaacagggatgcccagagaggttctcacaacttgacctctccgaagccagacactggtggcaataggcaaaaggcaggtgggcctggggacctgtattcagccacagctgggtgcggcagcacaaggagccctggccttccccccactcccggctgccccaggcccaactgagctccgtctccgtttagctgatgaacaaacagaccaaatgctgcctaacacgccacacgggccagtccatgccgggccagaggacatggggccatcaggcctcccaagtggaggtgggggctgcactccaaggatgggctgggccacggggacagcagcaaacaccacaccaggggtctgggagccgggcggtgagctgcaccagcagtgctgagccacatcccctttcacagagggcactgggccggcctggaagagtgtgatgccccccagcagtggtgttcacaaagccctgggttgagaagcagctgtgccgacgttaccgacggaaaactgaggtttgcagaggttctgagaccagcccccagtgtccaacccgaggcaggaccagaaaccctgctctccagccccgccgcttagaaaaaatccccctcccaaaggggccgcctccctgagtccaagccacccctgcccacagcaaaggagctgaggagagcctgggagctcagggaggttcagggagctccgtgcccacagcaaaggagctgaggagaggcctagtgcaggctggaaggcggggctgttcagacgttgagggtctcgcctgaagcccccgcatgctgctgctctatcttagagggggcccgtccggactgggggtggtcaggaagagacggctcagaccccacatgtgcaagtgtccccatgctttgccccagttctggactgctgctctcaggaggcagagacaggaaggagagacagaggggctgacccacgcaggcccaggcagggggcggccatgcggagagctgctgacccaacgggaaacctcaggaacagccacgctgggcccttggatcatggactcaaagcagaaccaaccctgggtcagacgcagagcggggcgctggccaggctgtcagggcaggagggttgtgggggtgggttctatcctaccctcctccggggagtcaccttgggcagggacctggctgaccagtaccggcccaccaagagcccctttggcccccagccaggtgggggccatcaggggaggccattcctgagaacacagaagctcatctggggattcgggaatgaaccctggactggaaaagctagactcacctcctgggggccacagggcttccaggacccaggaggtcggagaagcttctgcttggggagtcccaggctgggtgcccaggggccctccacggagacaccctccctgtaagcggcctggcatttccctctgggatcttctccctaccccagaaccctctcatatcacagtccacggagggtctgctaagggcacactcaaggccacacgcaggctggggcacactcgtggggcacacacccctctcggcccaggtgggcgcccgaccagcttgtgaccagtctgcccctcactcccatcccaaaatgcctctcacacaaaatggccggtcccggagctcagcgggtcccttgttcagctgggatgggagagcaagcgccctggcgcggggaggctgtgcacaccggccgcacaggccgcacacgcagcgggccgtgcaattccacatgcgaacacccaggtgcacacggacgcaggcttcggccgccccccgccagccctgccccaggaggcagccgttccctgagcctcgcccgggaagaggggacagccccttccaggcccagggctgggggtcccaggtctgccgcagcccctcccccgggcctcgctctgccaaggaggggtcctgagcccgggatgtgcacgggggcggccggcggctgcagagatgggacagcgcaggagctgagcgcaggagctgagggggttcgcggggccagggaggggcgtcggcgccgagggggcaggacagacagctgcgctcagcccgggctggggtgggggggtcatgggagggcccctcccccatctcaggaacccagaagctcaccctagtctgagggagagcggctcgggaggatggcggaggacaggccagacccctcccccccgccctcgcttggtcgggcggccccagccccgcgggtccccgagagtcccggagagtccagacccagcgctgccgccgtccctccccggccggccctttgttcggcgcagaggccgcggggaggggcctcccaggctgaggagggggctggggcggccgcacgtctctgtcctgcgggcctggagcccccaccccgacctgagcggccccgaccccggaatccttcctgcccgcgcgctgtacaatcgctctccggtctcggcccagcactcccgccggggagcgccggccccggacccagacccaggggcagggagccaaacccgccgcagccagcctggccggggtcgccgatggggtcgccgatgggggtcgccatgggggtcgccacgggggccccgccggccactcacacgtaggcgtggtagatgaacgcccagccgcgcggccgctccagcacgttgtagaggaaattctgcagcttgcggtagaaggcgttgcgcttggggggcttcccggcgcccgcgccgcccgcgcgaggtttgctgaggatgctgccgcgcttgggggcctcggagccggcgatcagcagcgccccgtcccgggtggagtcgggcgcgccggggtccagccccacgaagcccaccttcagcttcttctccccgctcgggccggggtatacgccgccgttgcgcgacttctgcaccatggtgcctggcgggaggcgccccgggtcgggctcaggctcagcgggggcggagcgcggggggcggcgcgggccccagcccaggccccccggccgggagccgcatggccgaggcggcggttccgcactcctgccgggcttgggccgcgcgcggagacgctgcggccacctcgctccgcgcgcacctcggcgcctggcccgcggccgcgccggctccgcccgccgcctcgccccgccccgcgttaacccccgcgacgccagtcgaaggagaggggaggagaagagagggaggggaagggaggggagagggagggacggggaggggaggggaggggggaaggagaggagaggggaggagagaagagggaaagggaggggaggggagggagaggggacggggagaggggagacaggaggggagggggaggggaggagaggggaatgggaggggaggagagtggcggggacggggagaggggagacaggagtggaggggggagacaggagtggagggggaggggaggggggagaggagggggagtgggggagggggaggggagggcagggggagaggagggggaggcagaagggaccaaggcccgcgggaccagagctctgggctgagcctgcccaatcccccggccatgtgcacactgaccctgcggtcacctttgagtccggtagtactaaccaagtggacctgcctggtggccccagcgctcctggggtcccagagcggtgcccagccgcctgagcaggactggagtcttctcagctgggccctgggagtggacgcctccgggaagggatgggggtaggggctctccccaagactctgttagggctcagcccatggtgacctcatgctctcggtgtcagggttgcccaggcagtaggaccccctagaccccagggtgtgtgcagggagggtctgtggaggctggaggcaccctgcaaggaaagcagcccaggggaaagggggtggccacagaggccgggaggcaagaagaggagcaagggccatggggtgggggatgggagagagtcactcctagagggccttgaagccccccaaggggcctggacttagttatgcagaccccagaaggggcctgtggcaggggcagggactggagggtggccccagggcagcagacaggccagcaggaagcccagtgccacacctcgggacaaaggaggcagatctgtgcctcctggacacagatgggacggtgtttccttgggggcaagtgcgcggaggtggcctcccccctgccggcagccatgtgtcctgggaggggtccctctggagctgctgctgggagaccaagggacccctgcggctcagtgctgcccgccctgtgaggtgccccgccactgggccttcctctgcacatccaggaggggtgtcatcttcgagtgcgtctctgactacatccagcctgtttgcacgttcgcctggcaccatgggttctacccagagaaaggccctctgctgaatcgctggcgccgtcctcgcaggtgacctgctcataaaacagccctaaccctggtgcagagtgagctcttgagttgtgtttgccctttggtttccagagctagtggccacggggcctgtttttgttgttgttgttttgtttttaactaggctgaatacagaagggtcggtgcaggcagaatgctaacctgtacgttatccaggacgttggggatagacggcaacttacacaagcttgtgcacatccaggggtactttctggatccccgcctccctgcctctgtgcccacgcattggctgtgattaccagcatgaagtgggcttgccccaagcggctgcggtttctctcgattgttaagggaggaggcaccagcctggtgctttcaggggagggagaggacttcagtatgcagaaggaagagagcaccgtggcatctccctgcacacgctggctggtgccgctggtctttcccactcaccagaagacccgagggagcagccgtagctcaaaatgtaaaccctgcagggctggggcccctcatcctgtggggggaagccccagactatccggtgcccctcggcagtgcccgggctacacgtgacctctcctgggcaagcagtcatctcaggtttgatgtcagagcccagtgggacccaaggtcagggctgatccacagaggatgaaggaaaagtgaccccagttcccgtttgagcagatgcaccagagctgagatgggagcaaggattaaggtgctctggtgtccaggacattgggagagacaaacctgttcatcttatttttcagaaaaaaaaggggaaaaccctgctgaggtcttggggagccatcggctggcttcacagcctcctgggggtggccgagagtggcatcccccgtggggatgccgggctggaggggccggctcaggatgcaggtggagctttgcaccctgcagctcgcggttctcccgtctacaaatggcgttggctccagcagctttgccacaccttggaaggttctggaaagtgaatcctgcatcaaggcttgaaaatccttgcttcctcctttgtttaggatgtcctttcaaagagctagctcattaatcatttatgtttttaattttgtgtcttgcacacccacgggctacattgtcagcaatctggttacccgcatgcctgccccctgtcccctcctctgcgcccaggcaaagtgggtcgtgaaaatgcccagttggggtaaatttcatccaagcaggaggaattccatttatgtaaaaatagatgggaaaagcgttcaggctcaaacaatctttgccaagaccgcatcgacaggactccagagaggatgagcagaattcagacgtacgtggtgcccagctccagcggaggagacagtcagtcttcgcccaggcggccagggcagcagcggattccacgcgggcgctgtcccttcagcacctccagcaccatcctctccccggaacctgcaagcccagccccttctctggtctcctccaggcaagtaacctcaaggcctccccagtgtcccacgtcactgggctgcactaagcgaccagagaacatgaagattgtactgccagaactggctgctcctgccgatcaaggccagctcatctgtccccaaagtcctctggtgggctccctccccagcagaaagcaaaccacaggggctgtgaccgcctactgcccgggctcccccgggcttcccgaactgtcctccctggagcctggcgcagagaggggcccagagtcaatggttgttggaggacaaactgaagcacatctgggtcactgccagggagaacccacagggtaaccctgcccatatggtgctggtcacagagcagactcggtgccctccagaacccacgcctgtgctctccctcaggtgcaggtgcagtcctgctgggtcatgactccagtctcacaggctcggcactggaatggtgggaccaaaagtgaaaaaccgaggccaggccaggcggctcatgcctgtaagaccagagttttgggaggctgaggtgggtagactgcttgagcccaggagttcgagaccagcctgggcaacatagaaaccctctctctacaaaactgcaaaaattatccaggcttggtggcctgcctgtgatcctagctgcccaggaggctgaggtgggaggaccgcttgaatccaggaggtcccggctgcagtgagccatgatggcaccactgcactccacctttggtaacagagagagaccctgtctcaaaaagaaaaaaaaattaaaaattagctgggcttgctagtgcatacctgttgtctcagctactcaggaggttgaggcaggaggctcacttgagcccaggagttggaggctacagtgagctgtgattacaccactgcactccagcctgggcaacagagcaagaccctgtctcaaaaaaaaaaaaaaaagaaaagaaaagaagaaagaaagaaaaaattaattaattaaattcaaaaatgagggctaggagcagtggctcatgcctgtaatcccaacactttgggagtccgaggtgggtggatcatctgaggtcaggagttcgagaccagcctggccaacatggtaaaaccccgtctctactaaaaacacaaaaattagccaggcatggtggcaggcacttgtaatcccagctactcggaaggctgaggcaggagaatcactcgaacccgggaggtggaggctgcagtgagctgaaatcatgccactgcactccagcctgggcggcaagagcaagactccgtctcaaaaaaaaaacaaaacaggccgggtacagtggctcatgcctgtaatcccagaactttgggaggccgaggcaggtggaacacctgaggtcgagagttcgggaccagcctgaccaacatggagaaaccccgtctctactaaaaatacaaaattagccgggcagggtggcgctcgcctgtaatcccagctactcgggaggctgggaaaggagactcacttgaacccgggaggtggagtttacagtgaaccgagattgcatgattgcactccagcctgggcaatggtgcgagactccatcttaacaacaaaaaacaacaacaaaaaaaacaaacgaacaaaaaccccaggaaaccaagcatgggtagtgacttgagaggcatatgagcttcctctggccgccctcctgtgtggggccgtcagcagcgggatcggggaggcggggactgccactgtgagtttgtgcaagacggctacatggtgctggtggcccccgcgggttgtggcccctgctagaacaggccagattttatgctcttttgacgctgtgctgtcatgggtgggatctgtgcccaggtgctcagcttcacctgcgttctgagggcctcggcaccagtgacaatagcccctgcggacactggaaagcagggcctcccaggccaccaccccgtgcctcccagtggaaatggagggagctgcttccccgtcactgcgccttcagaaaaacagacgaccccacagaggcctggaggaacaagatttaatctggggaaatgaggagatgaggagagacaggttctcagtcatctcacctgggcccgtgcctcccggtggaaacggagggagctgcttccccgtcactgcaccttcagaaaaacagacgaccccacagaggcctggaggaggaacaacatttaatttggggaaatgagatgaggagagacaggttctcagtcatctcacctgggccagagctgctgcgggtttaaccctgtaatttgggcgacaggaagtgcctccccagacagggaggcccagcccccccaaaggaattttacattattaggaggaggaaaggctgtatttatccgcttgcgggggagcaggggagtgaggaaaagatttaagatatgaaagcattgattttttttaacatcttacactaaagtcaataaaaatttaatttacagttttttctaaaggaccaaggctctcaataagcttccctagcccctggcaagccggctaattgcatgagggagttgacttgtacttcccagccaccaataataccgtcaattgaggagcccgtggtcagctgtgacggctggggagctacggtggctccggaggcatccggaaagggcagaaatccacctgtagctctgggacctcgagggaactctctgcttgatgctgtgccgtggcatccccaaaccccatatgttgtcatctctggtccacaggtgtcacaggtggcctcccacacgccccctcctatgccttcaggcaaatggagaagctgtggcaatcgtccccgttctgtggcagatatatcgtgaggaacgcaggcgccacgctcactcgtgggagagaccaggccccaccgtggatctacacatccagactccctggcacctcgacgctacccaaatgctttcctcatcaaggcctcctcgctcctgagacctggccctgccacacgctccaagaccaccgacccctctgcccccgtcctcccttcctgggcacacggccaccccgacatccctgagcaggcaaggagctcttgcatttgctgtctcctctgctcaccaggatggcagacactgcttcttctcagggaggccctggcgcggggtcccctccccaccttctctggagctggtcctcatcccgatgggaaactgttttgcctggcgctgctgccccactgcacagagcgcacaaggtgtggggggaggggtgggcacagacactcacagccccacctagcccaaggaaggtgcatgtcaacctgtcagatgacagatggccactttgacctggggctggacgtcgctggagcccccagccagatgtggcctcagtcacaggcctggggcttgtgtggctcagggctgccggggagaccccaagaggacatgggcagctggagctcaggactagcggagcggccagacgtcctgcccatgcaggctgcatctgtgccctggctgcccacccaccaacgtcctgcccacgctcaccagggccttgcttggccagatgtccagtaggctttgggcggggccatccagccttggcaaggcccatggactgtcacagccctccccaccccacatccaggacaaggtcatctagcgccacaccaggtggatggttcagaaaggctgggttctccaagctgcacaccagaggctgcacagagctgaagtccggcgagtcccaaggctcccagggcggcccgctgccccacaccctccggcaaacacgaaggcgccaccctcggcacccagcagcatctgcctcagcccctgcagagggcggcgctggtgtgggctgcagagagtatggcccgcaggcagccgccatgggcctgcccgagctgagtggctttcagcagaccaggcggccactcaggcctgcgtggactggatgtgtccccagaatccacatgctgaaaccctcactccagtgtgatggtgttaggagagggggcctttgggggtgactgggtcaggagggtggagccctcggaagaggaccagcaccctcaggggaagagacacgggcgctgggttcccttctctgcttcgtgccatgtggggacatgggaaggcatcgtctgcaagccaggaagccggccctcacagaaccgagtctgcccgctccttgatcttgacctctggcttccagaactgtgagaaataaatttctgttgtttaaggcaccaagtcaaagttactctgttgtagttgcccaagtgagacagaacctcatgctacccagacaagtggagagagtcagcccccaccccacgggagggtggggatgggagcgagacagcgagagccttattctgagagggcgtcaggaggagggcaggaaggtgcccaggtgagtcaatttcccggcttggacacgcccctcttccctggtctcacacaggaaggtgcccaggtgagtccagttcccggctcggacacgcccctcttccctggtctctctcgggaaggtgcccaggtgagtccagttcccggctcggacacgcccctcttccctggtctcgcacgggaagtcgcccaggtgagtccagttcccggctcggacacgcccctcttccctggtctcgcacgggaagtcgcccaggtgagtccagttcccggctcggacacgcccctcttccctggtctcgtgcgggaagttgcccaggtgagtccagttcctggctcggacacgcccctcttccctggtttctcacagatcctcccactggttgaattgaagagagcatgatgtgtccatccctgcggctcggacgagctggccccatcctggagaccagccttttgcttaatcacacttcctggcatcccacctacagagatgaaatccatttaggtcaattgctctcacccaggggttttgttcccaagggagcatctagagagtctggagacagttttggtcgtcacagcagaggggcagatggtatggcatccagtgggtggaggccaggggggtgggggggcaccaagcaccctgcagggcacagggcagcccccacagagcacagcgtcatccagccccaatgccagtcatgctgacattaagaaaacatggtgtaaggccagtcacggtggctcacacctgtaatcccagcactttgggaggctgaggtgggcgaatcacaaggtcaggagttcgagaccagcctggccaacataatgaaaccccatctctactaaaaatacaataaattagctgggcatggtggtgggtgcctgtaatcccagctactcgggagactgaggcagaagaatcgcttgaacccagaaggcggaagttgcagtgagccgagatcgcgccactgcacagccagggcgacggtgcaagactccgtctcaaaaaaaaaagaaaacatggtgtaagttaacaatgtcctttcttaaaatgcaaataggacgggtgaggtagctcacacctgtaatcccagcacttcgggaggtcaaggtaggtggatcacctaaggtcaggagttgaagaccagcctggccaacatggcaaaaacctgtctctactaaaaatacaaaaattagccgggcgtggtggtgggcacctattatcccagctactcgggaggccaaggcaggaagatggcttgaaccctgggagcggagattgcagtgagctgagatcgtgccattgcactccagcctggcgacaagagcgagactccgtctcaaaaaaataaaaataaaaaaaaataaaagcaaatagttctggtatgttagccattcacattttagcatgaaacagcataaataaatggacttcctcccaagagttcctgaatatgtaagccaagggctgagaatcttcttgagaaaggagccaggagtccgggcactgggtgggggagcacccaaggagtgaggttgggtcggggcagcagtggagttcagcaaaggaatcctgggcgttctgcattgctggttcctagcctgatggaaaaatgctgcttttacatcatcgcaggacactggagccattgctgtgtttcactcactgtgagcttagtttgtgtggctctgggcagctgcaggatctctccgcacctccgcctctttacctgtgatgtgggggtgctgaccatagatagacaattgcggtgatggaggaagggcgcaaggtttgtaaagagtctccagcggtggcaggaggaggcgtcacgtgagcgggaaggtgaagatgctgagtcagctcctggctgccccatgggtaccgcaccccgctgtgtgccacccgcctcacacccaagatgaaggcctgggtgtcgggagatgcagagtaaagacagagcagtgggaggcagttaaggcccctaaagtgccagaaacccccacccctggaggcagccacagcctctggggagggcggggccacagggacccttttatacttaaaggttcctccccacaccctgaagggtaaaaggtttacagagactaggaaatggagagaggagatcttacagcctcccaccgtgggactcagtggatttctccttccccctcgcccgttccctccaactgcccagttcagcaccgccccctccccccaggcagctgagccctggaaccccacagctggcagctcgcttggcctgacctggcttcagacagtggctggcaggatcctcatagccagagcctggggcagaactgccagcccatgacaggctgtgtggcagagcctggggctccttccccctagatgttcagggagtgggcagggcagggggcgtgggtttctgcccctccaacccctccaggctggtcctgcctgggagctctgcctcctgccacacccacggctccagtcctgtccctgcaggaggcccgcaggctcttaggaactgctgtcctgcagcaggaggcctgcaaccaggccccacgtctgggcagggggtccaggggcaacggcttccttcctgctcccaccccacaccatccagggcccagaccctctctcccctcctctgggtgttggtgcctcctgcccctgcctcggagcccccacagaccaagccagggccctgatttggggccgctgaccccacctgcatctgctctccatcctggagctgttctcagcctcacacatcctcctcagggtcttccccacctcccccagccgacccccaaagtaagatgccagagcggcatgaagccaggaaataagccagaccccacagctcctccaaagacccctgacgctcctggttgaccctctcatggggacggggcttctctcccctcagcagagccaggagctgcctcaaggcccatgcacctgccagtccagcctgtcccccgggctgccttctccctccctggcttctggatagggaccgttgcccagtgcttcctgagtccagccacctggtgggcacccccagagactcagccctgactccaggcggccagccggcagcacaggtacagccggatgcccgacacacagacatgcaggcacaaatgaacagacgcacgagcacatacatcctgaccgtttccaggggctccaggacaccccgccaagttctcccctgcaccccacacagccacccacaggtatgcacagctcacccaggtcacacacacgcaccagggtatggatgtaaccctgtgcctgcagccccactccgggacacactaagtcacccacaaggacagtcattcccacagtcacagcacatgggaaatccccggggtcccattgtggaggcctgaccggctgccgcaaagcccagccccttggcagggagcccagaagccgctgctcaaacccaggactgccaggggcacccaggcccttccagccacgctgggaacctgcacggggtgggaaggtccttcccgcctgggttacaggagggcaccgggagcccgggagagacaagggcaagggacagatggcattcggccactcagcagggccccacagcctctcgaggcctcaggaatttttcggtgacgtgcaaagtgcagaccaaagccgccaacagggcgtcttggcggactctgttttaaattattcaccaacccggccgggcgcgggggcccacgcctgtcatcccagcacctgggaggccgaggcgggcggatcccgaggtcaggagatcgagaccatcctggctaacacagtgaaacttcgtctctaccaaagatacaaaacttagccgggcgtggtggcgggcgcctgtagtcccagctactcgggaggccgaggcaggagaatggcgtgaacccgggaggcggagcttgcggtgagcggagatcgcgccaccgcactccagcctgggcgacagagcgagactcaaaaaaaaaaaaaaaaattattcaccaacccaagtagggtggagctccttccgccacccatgccctccctgacttcaggacctgctctggggcctcagcggccccaggactgaccctgagtcccagtggccgccagtcagagccactctctgggccttggcgcccccttcagccagacagcagcccaggtgtccagccagctgcaagcatccatcaacaccccgctggggccctgaggctgcacggtcccacccttgcagggctccagggcactgtctgcctgtggtcccctgccctcaccccggccaccgccctccagctgtcctcaggctccccaagccgacacccacggagcgttctgtcctgaccccaaccccagtgagctctgcccccccacccccctacccccacctgctatggggaaaaacccaccctcctctggaccccagggagcagctacagctcacacctccactgcagcccctgttcagggagctggagaggcagccgcagaggccgcgtgaggccgtggtttcctttcatcctggcccgaccctcagggcaggtgccacacaaccccctttcaccgatggagaaggggcaccgcggcgtctctggccccattgcctggcctcaggtgccagagctgggaccccacccctcgccttccccactgctccgccgcctaaagcctcggttcacaaagcacggtccaggccccccggggctcccgagaaccttcgagaaagccccaaggtcaaaatctgttttcacaataatgccaaggcttctctctcccgtcctggcttggacagtggagttctcagaggccataagaggtgtgacactcccctgctttctcgtgtcttaaatatccacacgtttagtttctagcatactaaacagtggcagatgcaacctccctgacatttaacactgtgcaagggtcctaacacgaaagctctgagcattactgtcctggaggcaacgcagagctctgcctggtgtccccccagccccccttcctgattaacgagcacagcttgcttccctgggtctctcacccgccagaagctcctcctgccctcggtgggtctctcacctgccagaagctcctctgccctcggtgtgggtggcaccagaactccccagagaccgagggctggggaccccagggcggctttggccaagcccctgccctccccagagctgacagtgggctggacacagggtatcccctgtccggcatccagcagggcaatcctggcaccctgtgggtgctgcccccacccacgatggacaccaggagcccagtcccagatcctggcctcctccagccactgccggtccccaccccacagccccccacctgagcacgaggggcgcagcaaggcccggagccctgccaggcatcagacccaaggacttgggcctgccttcattaccccagaaggggagccgaggtcagagaccctcccaggagacccaccctccaggctaccacggccaggactctcatctgctggggaccccagtgggaacagggagtgctcccatctctctgccctccctgtgctcctccccaccccagaaacacacccacctggagggggccctgtggccccagcacagaccatggcaggcaggctgggcttgccccccaccagcagtgcctggtgaccaaggctgccagagtcatccagagttagcaactgcaactgggacatgggggtgaggggacccctgagcacctcagggaccacccaagggggattcctgcaactccagctgggggctgtttttcacttttgtcccatctcaggctggcaaatttctcccatttggccccagttctagccaggtcacgtgtgaaaggacaacttccttccagacaggccctgcaggtcccactaggcccctcccatctatgtggccccacagaggcccaggatgggccagggtccatcaggaacacctgtgtccttgggtagggccaccagataaaacacaggacacccagtcagatcagaattttagataaataaggagtaccatttttgtgtaaatatgccccaaatattttacagtaaacaattatttgatatatatccaaagtcccgacgtgactgggtcctgtatcccctccttggaggcctcgtggctctgatgttcgtgggttcaaatcctccccatctggggccgtgggctgccagcaccacctgggggcccaaactccctggttgctccactcttcctcccattctacctcccttttgtgtgggtttgagggaccccactttgggaatggagggagacatgagcaggccctccaagggcgcccctagacagtgcccccatcaccactgcctgtcacctgggctgcctcgtttccgtcctcacctagcacagtgggtccaacatgccccaagggtatcaggacctcaaccctggaatctgtggctgactccatgtggcaggaaaggatcttgaagatttggttgaggatgttgagatgggggcaatcccagattatcccaggtgggccctaagtgcagtcactcgcatcctcatgagaaggagatttgacacagaggaggagagagcagtgtggcgacagaggcagagactggagtgacgcagccacaagccaaggggtgtcggcagccacggcaaggggtgaagcagggaaccgactctcctggggcctccagaggagcagagccccatcgacaccttgatttcggcagggaggctggttttggcctgaccccaggaggcctcgccatttgccgtcattggtcgcagcatccctaagagactaaggcgctatgaggccctgcggtcagcctgcctgctctgcggaaccctccgagtcaggtacccggctgcaggctgggagctgggggctgggcgacagagaggcctgcctcagtgctgtgtacagggtcagggaacctgcccaccctccaccccaccctccctgcatcctcagggaacctgcccatcctccaccctgacctcacctgcatcctcagggaacctgcccaccctccaccccaccctcctccgcatcctcagggaacctgcccaccctccaccccaccctcctccgcatcctcagggagcctgcccaccctccacccagaccctcctctgcatcctcagggaagctgcccaacctccaccccaccctcctctgcatcctcagggaacctgcccatcctccaccccaccctcctctgcatcctcagggaacctgcccatcctccacccaaccctcctctgcatcctcagggaacctgcccaccctccaccccaccctcctccgcatcctcagggaagctgcccaccctccaccctgaccctcctctgcatcctcaaggaagctgcccaccctccaccctgaccctcctctgcatcctcagggaacctgctcaccctccaccccgaccttcacctgctgcagcatgactggctgtgggccggggccgctttcccagagcagggaggggtggaaaggagctgtcctcccctctccccacccctccactcttcccagccaaggtcggggcaggttctagcccagagagactagggaagacccaaagcccccagcccactgactgaagtcaccagcctcccgggttcgggggctggagttcctacaaccacgtacagagggcctggacctgggagcaggatggataggtacaggctgcagccacaggtgaccggcttagcaggagagtgagaccaggtgtgcggggccaggggaagaatgagtgtgtgtgtgacagtcactcgcggtggaggagccctcagctctcatgcggcccccagagatcccaaaacccgcagcctggttctgtggatctgaaggcaccattctctgccctgagtagccatggagaagcccctcaaagccacccaggccacctggccttcggatggggtcttgctgctgggccacggcctgggggacaccaggccctcctcagcgagcgctcagcgctcaccctgtgcagcgcaggggaccactcttgcaggcccaccgcccaccctggggtccccgggcagggagtgaaggatgctgggccggccacttgggcagggagggggtccggggggcgcggggcccaccccccagcagcaggcgcacacggctctggggtcgctcagtttattggtaaaacgggcactgagcgtggcgagcgctgggcgcggaagcctggggcgggggcgcctttcctcttgaagaacttccactggaccttgatggcgagcatccagtcgctgaccgagggcctctggcaagcggaggtgcagacatgcgcctggcgggggtgcggggcgccggaccggcgcgcggggcgggggcggggcgggggcccgggcccggggttcggagcgcggcaccgccggggagggtcgcgccgcgggcgcccgcgcttcacttgcccgccttctgcgccttctgcgccgacttggtgaccttgccggcgccgccgctcttcttctccacgttcttgatgacgcctacggccaccgtctgcctcatgtcgcgcacggcgaagcggcctggggggcggggggcggcgtgtgggcggggccggaggacttgaccccccccaaccccagggctctggccgggcgggggcgcaaccgcgtcgggaatgtcctcggaacacgcttagcgcagagcgcgcccctgtgaagacggccggcctcgcgggagtcctgcctgggcggctgctccacggtctgcggggcggccacggggcgggggcagccctaacgctgccactgggcgaccgcgggccttcctcactcgcggggcctccctcactttcggggcctcgtctgcacacagggcccaccccagctcgtctgggcagggtcacctgcactcagtgacacggaggccgtggctctcctgccatgctctgggccaagctccgcaggaaagggggcccactgctgtccccagcgccccatccccgcagtcctctgccctcagcctggatcagccacagcctgggggctgcacctccccggaccaccccggctcaccgagaggcgggtactgggagaagctctccacacacatgggctttcccggcaccatctccacgatggccgcgtctccagacttcagggacttggggttgtcctccagcttcttgccagagcgccggtcaatcttctccttcagctccgcaaacttgcaggcgatgtgggctgtgtggcagtcgatgaccggggagtagccggcgctaatctgccccgggtggttcaggatgatgacctgcgagcggagccacaggcggccatcaggcacatcggcggtgggcaccgggagggcgccagagcggggctgggaggcccagtcaccggcgcccctgcacgggctcctgggcccggagtgctgactggagggggctcaggctctgaggacccagcccccagacctgaacctcaacatcctcattaagcaaaagataaacaactgagattcattgtttcgaaggggcaggggcagcacttacacggccaaccccagctggaactaaggcgggggggtgacaaaactggacctcaattcctgtgtttcagttgtatctcaataaagccacttttaaaaatcatatgaagaggccaggcacggtggctcacacctgtcatcccagtactttgggaggctgacgcacgtggatcacttgaggtcaggagttcgagaccggcctggccaacatggtgaaaccccgtatctactaataatacaaaaattagccaggcgtggtggcacatgcctgtaatcttacctacttgggaggctgaggcaggagaatcacttgaacccgggaggcggaggttgcagtgagccgagatcgcaccactgcactccagcctgggcaacagagcgagactccgtctcaaaaaaaaaataaataaatcatatgaagaggccagcaaagaggggcaatgaagactgtagagaataaaagtatgacagagatgtctcagacagtaagttaacaaaagcgtttttctaggacgaatgtaggacctcaaaggctgggcatcccagcagtgcagcgtggaagacagacccgcgattgcacacaggctgggagccacagggcctgcacccctcccagaactgattgatcccctcgttgagtgctcggtggccccctcggtggtatgcgggtcccttttctttttttttttttcttttgagacgaagtctcgctctgtcacgcaggctggagtgcagtggcgcaatctcggctcactgcaacctccgcctcccaggttcaagcgattctcctgcctcagcttcctgatagctgggactacaggcacgtgccaccacgcctggctaatttttgtatttttagtagagacggggtttcaccatgttgaccaggatggacttgatctcttgacctcgtgatctgcccgcctcggcctctcaaagtgctgggattacaggcgtgaaccactgcgcccagcctgagggtctggttttctccccacgccaggccacctgccgacagcagcctcacccaggacagtcctgctgctgtccagcaggcgccagccccctggacccagcgcagccccccacctgggaggtgaactgagcagcctcctgcggcgggtcagacttgctgtccccacacacgttgccccgccggatgtccttcaccgacacgttcttcacattgaagccgacgttgtcgccgggcagagcttcgctcagagcctcgtggtgcatctccactgacttcacctcagtggtgatgttcactggcgcaaaggtcaccaccatgcccggccgcaggatgccggtctccacccggcccacgggcaccgtgccaatgcctgcagaggggagggggtgtgaggggaaggtggggcccgaggggatgctggggcaggatattcggggacagagcctggaaaccaacaaagcctgggactggatccccccgacaggcctgggggttggggccacatgggcggagtgcaggggaagggaggccagggacaagggcagacacagagattccaagggaagtgggggctctcccacccagctggggaaataagaggctgagcagcagagctcccaggaacccacggaaaagccacagggacagagaagcgggaggatgggcagagaggggctgtctgaacctggggtcccatccttgcccccggagagcactttccctcaaaggaggcactatgggacccctcctttgtctgaggactcctccctgtgagtgtgggcggggcgactgactgcttctgcctggggcctggtggccctgctccctgctccctgcaggccctgctccctgctccctgcaggctctctgggccccacttggatgctgcaggtctctatcactaaaggggcctctcagccagatgcagcacaggcacagcggcacatgagcgtccctggcatttctcatggatctacttaaaccaattgtgcagctgccacatgggggtcttgtccccccccaggctactgggtctccaccctcacctcccagggctgtgagggaggcctgttgtagcctccagccaacttcactgaggccagtggctgtgctctgtgctggggtgagcatgatgcccccacagtgcacacagagatgcctgcaacatctttggctgcagcccactggctgggggtctcctatcagtgcccttctctagggtctcagatttgtttatggtttctcttcttggtgggatggatggatggatggacggatggatggggaggtgggtggatggatggatggatgtatgaatggggtggtagatggatggggaggtggatggacagaaggatgggtggggagatggatgagtagggagatggatggatggattggtggatggatggatggatggatggatgaggaggtagatgagtggatggacagaaggatggatgggtaggaaggtgggtggatgaatggatggatggggaggtggatggatagatggatggatggatggatggatggatggatggatggggggatagatggatggatggatggatggacggacggatggggaggtggatggatggatggatggatggatggatggatggatggatggatgaggagatgaacggatggatgagatggatggatggatgatggagggaaggatggctgggtggggagatggatggatagagaggtggatgggtggatggggagatggatggatggatggatggatggggaagtggatggatggggaggtggatggatggatgtatgggtgggtaggtgggtggatagatggatggatggatggatggataaatggatggatggaaggatggatggataggtaggtgggtggatggatggatggatggatgtacagaaggatggatgggtgggtaggtgggtgagtggatgaatggatggatggatagatagaaggatggatgggtgggtcaatagatggatggatagagagaaggatggatgggtgggtagatggatggatggatggatggatggatagagagaaggatggatggttgagacaatggatggatggatggatggatggagagatggatggatggatggatggacagaaggatggatgggtggggaggtggatggatggatggaaggatggatggatggatagagagaaggatggatgggtgggacaatggatggatggatgcatggatggatggatggagggatagagagaaggatggatgggtgggacaatcaatggatggatggatggatggatggatagagagaaggatggatgggtggggagatggatggatggatggagaggtggatggatggatggatggatggattgatggacagaaggatggatgggtggggaggtggatagatggagagatggagggatggttcgatagagagaaggatggatgggacaatggatggatggatggatggagtgaaggatggatgggtggggagatggatggatcgatggatggatggatggatagatagatggatggagaggtggatagatggatgggtggatggatggacagaggatggatgggtggggaggtgggtggatggatggatggatgtgggatggactgtcccacagaaagtgtgtggtaaggggagagattggagacagcccagtcttgagatgccttgtaggggcccctggtctagggcaggcagagctggccaggcaggagctccagcacagcgcccttgctcaccgccaatcttgtacacgtcctgcagcggcaggcgcaggggcttgtccgtggggcgcgtggggggcaggatggtgtccagggcctccagcagggacacgccgcttgcgttgccctccttacgctccaccttccagcccttgaaccacggcatctggaccaaagggagaaaatcaatccgttaagagacattggtggcctccccaccctcaggcctccccagggtgcttccaggagtactgctgttcaggctaaacttgcctcgtgccctttgagatgaggaatttccccaccctgctcctccccagcccatagccccagcatcacagggactctgggaaggagatccctcttaaaaggaggaggacaaagagggaaagcacccttcccagcccaggctgctcaggagttgctgacactgtgaacaaatccccagtccagccccaagtccccgaaaccccgggcccctgaccatcagctccaggcagggcagatgacttgactaggaggatgctgagtctggccaagggccaggccagggacagagctggaggagcctcgccccaccctagcttctggacaccgtgctgcctccgagcttggcccagccttgtccggagcttctcctagtgtggcccccactcccatcccatgaagcctccctctgggccacctgccacaaacagggagcaggggagggggccggcagcacagtgccccagccccccagggcctgtgtaagcacgagccacctagcagctcaggccagaggggagtgcagggtccctgatggctggaggcctccctggggaggggagagtggcgttcgccacatgataccccatgaggaaaacgccatcacaggtaaacaacaccgagcctcgtgagatggaggcggagctgggggagtccctcccagttctgtccccagacctcagctccaggctcagtgctgctggtctgtctccctgctgtctctagactccacacctgcaccctcactgtgggcagcgacagtgctggcagagcctagtggtggccattctggggtctcctctggcttggagaaccctgggaacagtctcaggttctgcaagtgtctccacgcgtcacctccagccaaggcagagtccctgggctacagactgttcgcacgttgagctcccaggtgaccggccaagagccaacccttggccatcccagcaagcccagaagcatgcacacttcccaaagcccaaccctgctccaagatcccaggggaggcagccaaggaggcccccacggcccagcccaaagcccctgcacggtgtccaggaccaggacaatggcctggcagagatgaaaccgaccgcccccatggcagggctctggagaccaagcacatgggcctggtgctggaggccgctgcccctgctgtgttgacatcgtagatgggccctggccccggccagccgcgtgggaggctgagtgtaggagcaaagcccggtgctgaggggcatggggctccccgccgggccctgagccagttagggaaacccagcaggtttcgaggggaacctgcatttcccggggacaggccctcgacctccccgtgccacctgccggtgcctcgctctgggccagggggtccagccagctcccgtggcccgccccgccctagccgccactcacgttgggggagggctccagcatgttgtcaccgtgccagccggagatgggcacaaagggcacggtggccgggttgtagccgatcttcttgatgtaggcgctgacttccttgacgatctcgtcgtagcgcttctcgctgtaggccggctctgtggagtccattttgttcacgcccacgatgagctgcttcacacccagcgtgtaggccagcagggcatgctcccgcgtctgcccattcttggagatgcccgcctcgaactcgcccacgcccgccgccacgatcagcactgcgcagtccgcctgcccggcaggggacacagtgagccctgccccgcctgcctggcaggggacagagcgagcctggccccacctcacttccaggcctctccaggcagcgggctggggcctgagcagcccactggggccttggggagggaggcatgggggtccccacttcaagggcagcatgggggctcatcgccaggccctgggtcaggggaccgaggttcagccctggctccaccaccagtgggctgtgtgtccctggacaagtcactcagcctatctgctcctgttcctcacttgaggacggatagaagtcacagttatcaaagcagtttggaggtggtggcatgtgtcctgctgtctgcagggtgctgtgtctggggtgtccgtgcgtctctgtgagtgccctgaaatgtcatacagtctacacctggcgggtggcacctctgcccactgctcactctccccatcctggcctccaacccctccatgtatgaaggtgtgtccacgtccccatctgcccccatctatctggggactctgacactggctggatgccttcacaggcactggttcagatgccagagcactggattcatccttaggggggctctgagccagactgggtgagggtggcccaggtgaggggtcccctgccctcacaggaagcacaggagaccctaccatcccagtgaccccaggggcccccagtgtcccttgaagggtgcagcggcctctcccccagccccgcctgctgtgccctgctcacctgggatgtacccgtgatcatgttcttgatgaagtcgcggtggccgggggcatcgatgatggtgatgtagtacttggtggtctcgaacttccagagggagatgtcgatggtgatgccgcgctcacgctccgccttcagcttgtccagcacccaggcatacttgaaggatcccttccccatctggagcgggtgagggtcacggctgagggcgggacccgggacccaggagtccctggtggtgcgagctgcttgttacagcagagtggccgcgagaggcgggagatgggctccagcacccccttgctctccgtcggggtcctgggacgccggccccctccgtcgggaccccacacccagaccctgccccccagggccggcctccgcacctgctccgaaatgggcgcggctacgcaggtccaccagcaggtggcgcaagggcctgggagtcgctcgctctacgagcgaagccgccagatgggataaacccctcccgggcgagggctcccctttatctgaagctgcggacgcccccagatcccttcctcaaccagaggccaataataccaccgtgtttggggctgtcagataaataaccctctgtgtgtgtgtgtttttttaaggtaaggagaaaggaaaactgaatgaggtcaggaggagggcctggccacgcagctccttcccgctgctccagcctccccatccctctgaggcttctcctccccttcctcgctctgccggacacgggaagctggggggcctcggccagtgagacccccacagaaggggacgggcttcagtcagggcagcagcggcggtcactacccagctgggcagaactcctcgccagggcctcgcacagacaggactctgccctccaggaggctgcccagtctggagcagacccagatgggacccagctggggcctgaaacagcggccctctgaaacccccgcctcctcctgacaaggccaggtaaagggtgatgcagcccaaactcaggggtgcagctcagagcacccccaaccccgccagggcagaggctcagcccaggacagcgagtgcccccaccttgggccctggcctccgccctcatcatccaggtgagagctcccacaggccctcccaggagtgggcttctccccagagtcctgggtgggggatggggatcagagagcagaccccgtctcatgaccgctccccaccaccgtctcagccaccaaagagaaatcgcttcaaaaggtcagctaggaggtcacctcatccaggacccccaccccagggctgccctggacagcagccctccacagcccagcacaagaaaatggagcagacgggccggctgcccatcaatcagctattaatagtagcgtgtgccctggcagggccctaggacaagtgagggcagtaccatctccagccccagccttggccctggggggaagggggtaaggctccagcgccctccagccccagctcaacatggcagagttccagagccttctgcagaccctcccaggtcacctccctcaccacagggcaagtccggcagctcgatggccacccctcccccaccaagctccccctaagagagaggctgccccaccagaccctctgaggcctgagtgccccacagcgggggtccctcctgccctggaggaggtcacctgagccccatgccctggggctgggagatgccaagcctggccaccacgggagttgggggttccttctcagggggccaagaccatagcctggggagctcacctcagccgcctccttctcgaacttctcaatggtccttttgtcaatacctccgcatttgtagatgaggtggcccgtggtggtggactttccggagtccacgtggccgatgaccacgatgttgatgtgggtcttctccttgcccattttgctgggagtgtgaggggctggcgggacccggggtgctctggctcagggcgaggggggctgcagtgattctgtggggccagtggtggtggggagaccggtgatggggagccccagggggagacaccagcagagactgtcctggcacaggctggacaggcatccctgcccacaaaccaagcccccatgtttggtggggagggaagggcccccacccacagctgggcctggccagggcaagcagaggctgtgcactgcccccaccccacacttgagcccaaacagccccatctgctgtaaataactgggcgttggagcccgcgggctgctccttgggaaggggttagccaccatttggagagaccacgcagcgccaggctgggtacgtccgtgaccagcagagccgggtgatgagtcacctgcccagcgctccagggccctgtcctgcacgcgcactcccctccccggcggcagggccagggacacggcgccccacccccacccgctgccaccggggagagatggccactgctccccactcccctcctcaggcagggacggcgccatcttcccctcatccctgcccggcaggctgggccagagccccgacggagatgcgctgcccagattaggaacccagaatagctctaggcacccccctcccggactctcacagggacagacagcggccgggaggtgggggtccctgttccagcctgaggaaggaggacccggccctgccgagcccagcaagtgccaggtggagatgccctcggccccgtgggggtatagggggcaccctccctccccccctccctgtgactcaggaccctgggtcacagccctgtcccatcacagaggtcagtggagaaacccacgctgctcctcgcggacaggtggctgggggagggaaagaggacagaagccaccctggggtgggaacacgggtgggggtggggaggccagggcccccagatctcaccacctccctcagcgtcctctggcccagcgccccgaagcccgacccccatcagcccccggcccgcagggtccccgcggccccaaggtcacggctacggggcgatcgccgcccaggacccggccccgccgccccgcgccgccccccaccccgggcccagcccggccgacgcggggacccccggaagccggactccgggcgcgcgcgggggcgggtgcggggcccggccaccctctgccccccaggaccggccccgggggtccctcttcggaagacgggggcgggggcggaggcccgggggccgagcgtccttacccggagccgaggtctcagccagagggactggcggcgccggcgccggcggttttatctccgggagggggtccacctattgacggtggcggcgcagtgcaccgcgccctgcagcacgccaatgcggaaccgcgcgggagggggcggggcgcggacgcgcgcgggcgggcgccacggggacgcgaggcgatgcgggaggcgcgggctgcaaagacggacgcgggaggcgggggagaaacgcgccgcgggcgggggcggggcggggggcagggcagggaggcggcgggagggagggaccgggacggagacggcgcggggagagcgcggcgggcccgggagacggggcgagagccggctcagggcaggaacacgcttgagccgcgaaaagcggtccccggggacagggcagacgccgaggaccggagccggcaggcgggggaggggagcaggtgggctgcagcctgggagacgagcctgggtctaccggcccctccccggccctgctcatgggggacgccccagaaccaacgaagcccggctctgaggggctctccctaatgaggcccgggggtgcaggcctcagggtggaaatctgctggtttccagtccctgtcctcacgtgcctgccctcctgggcgcaccatgacaggccccgaggatccagcgcagaaccaccctccccctgagaggctggtctcccacggtgcagggaacgccggaagcccgctcccagacccactgacatcttccagggaccctcccctccgggtgcgccgacctccggctgctgctgggaaacagcgccagccaagggcgagtcagatccagacagacccaggcccccccgcccagcgccccaccccgctgcacctcagcgccttgtagctgatgctcatatggggtcaggatgccaagccaaagaccgggccacgctctgtaggaagtggggagtccctgaggtcctggcacacgcgggtaatgaccaacgtgggttgtgaggaaggggatgtggcagccatgtgttgtgtgaagaccaaggttaggggctttctccagaccccaagatcctgtcgtctcacccaggtattcaggtcttccctcccacgctgcccccccacccccacgcactcggatcttcctgccagcggggtctcgggaggtgtgtgctgagtgggggcagagccctggcacctgtcctctcagccctgagttcccactgggtgttgacatggaggccccgggtcgggcccagcagctgcgactgggcaaatccatggggatccccagcgactggacccctacctggcctgctggcaggtgtgaggaggaaggaaaggtgggggcccagggtcggggccaaacagttctccccagcctgtggagagggcctctcaggaggaccctggtctgtggctgcgtctgccccataggagtccagggacttgggctcctgggccacaggcaggagaggaggcagggagggcctgctaggtgccccggcacttccgagtgctgccgatgccgtcaaacaggagccaggaataaaaataaccgcctggcaagaaagcaaggcccgccccaccccacccagctggtctctatatttaacgcctcccctgcagcctgaaggttaggcagggatttggaagtgggcttgctgcaggtgctcgagtggcccaggccggggtcccggggatgcccaccccactcccccaagggatcaccaggactctgggctaccttttccagacaccccttccccctcggctcccggctcacccatagcagtgccaggggctcacatgtgccgtggggccttgccacccacaggagtggcccctgagagtggaatgtggcaacctccccaaagcacctgtgtgctgactctgggcaagggtgtcggtggctgctccaaagggtctcccaggcgccaggacacgtttggtccacggtgtggcccctcggggtcctgggagccaccgactcagttccgcagacacttggaacacacagctaacggggctgcggtcacaaggctaaacactaacacactgatggttccgagccaccgcggagactgaacaggactgaatggctactaactacggaatgctaactgctgaataacggcagtggcctgaccacgtccccaaagtgcacgagttgtaacttaatccccaatgcaacagtgttgggggctggcgctttcgggaaggagtctgggtcataaagggtttgcccttccgaatggatttgtgccctataaacaggactcatggcagtgggttctctcttgctcttccgccttctcccatgtgaggacacagcaagaaggccctaccagatggcagcaccttgatcctggacttcctggcctccagactgagaaataaacttctgtttacttataataatttataaatttataaagcaaactttataaatgtttaaatttaagtaatgtataattacccagtctcaggtattctgtcatagcacaacaagcaggcaaaacacttgtcaatggccgggtagcaccaaatgacttcaagtaccaagcatcctaattagtcacagccaagtcgcccagctgtgtgagttcacagtgtgggggacgggggacagggggccgtgcacgtgcacagtgtgcggggatgggggctgcggggacagaggctacaaggtaggccccacaaggctggctggaggaccttgagaacctgtgaggcaactgggcacagaaaggccaagattcctgtccaaggacacgcagcaagtaagggggcctgtggcctgtgctttccctgccctcccccaggtcaggacttgggcccctcttcttgcatctgagtccctggtcacagtgccgtcctcaccaacaacctggggggggtggggggaggggaaatggcgagtcaagagggcaccagccaatcagggcttccctgggggcaggccccgcccctcctcgacccctcccagagcccccaggccccgcccctccttgccgcctcccagagcccccaggacccatccctgagctgtttggggagacacaggcaaccccttctttggctggctagggtttcacgagcctcgggaaagaagatgcagctaaaattaaccgctatcaagctgtcagccctggaaataaacctgcctcccattggctgccggtgacgtcactgctgggttaataatagccgccgagtgcctaacgaaccacctgtgcatggggcacagccaggccatcaccccggggccaccgtcgcaggcaggtggaggctggcagcccagaggcagacaggggcttggaggcagggtggggagcaaggccaaggccgctctctggcccccagtgtcacaggatgacctcagccctggcctggccccagagcaggtgtggattcattttccggtcacggagcatctcgtctgctggcccacctgggccccctggacggccaccaggacaaggcccacccccgcggccatgccttggggctggctcccaggggactgagcatgcccttgaggcagcgaattaaacagtctccatggcagcagaggagctcctgcctctggagcctcccttagaggagcagctcatgtccccccagatcagagaagctggggctgggctggcagcgggcaaacatgcctgcaggtcaggccacagaccagggccagccacggccccgacagcccaccctccaacccggtatctgggtgtgcctgaggcagacctgagtctaccagggaggcccaggagggatgcagcccctccgccagggggaagggcggcctggcctgccaccccgacctgcaggccccagcagggagcgttgccatggtgagaggcagcagcagcaggatgccctccctccaggccctgctgcccgggagcccagcacccaccctggtggggagcagacagcacgtgctcctgccgcaagcagcactttctgggcttctgggcttccagctgcagtccccgctagcccctcccggcccctggccattacagcccattgcaggctgggaggctaaacaggaggccggggtcaccgaccagggtggggtcacctcttggacccaagaagggcagcccctggtgccagcacaggggcgctgtgccctccagtgcccagaggcagaggggagagcctgggtagggtctgcagaccattgaccctacagctgcctcctctgggccctggaggaagagggggccatcaattgtgtctcattctgcagctggtccagagagaatggggggtccaacgtctgtggtcaggtctggagagaatggggggtccagtgtctgtggtcaggtctggagagaatggggggtccagtgtctgtggtcaggtctggagagaatggggggtccagtgtctgtggtcagggccccctcaagggcccactaaagcagagctcccttcctgggccccacccaaggtcccatctcctctcctatgtagccggcaccaggttcaagggggatctctcaaggtgggaaattgccctggggaacctgaagttcattagcagctctggaggccctgttttcacctctttgaatagcccttccctcaattaggcagctgggaatcttatgaagggaataacaggaccctgcctgcaccctggggatgagcctcccaggggctgccgcccaccatcgcctcccacagagattcagagcctccccacccctggagggacctccccacacggccaggaaccgagcagctgggccagggcaggaggaagggcagggagaacacagaggggacgtctgcctttttaaagacgtgactttgagcatacatagagaaaagtgacacactgcaaatgtgcctgatgagttatcaccaggaaaacacacccagaccaagaaacaacattccctcctgcccctcggtaaaggtgacttctgacagcacagatcacgtttgcctgtttttaaactttatataaagggaacacaatgcacagtgtgtatccttttgtgtggcttctttcacacacgaccgtgtctgtgagatgcctccatgccgtcccgtgcagcaggcatttgttcattttcatcactgtactgcattccacttccagttctgaacgactacaaataaagctgctacgaacacttgtgtgcgtctctcttgtgcgggtgtacctgctcagtacacaccccaggatgtttcagccacatgataggtgcattatgccaaccactagtttattgtcttttggctcgaaatttaaccttcaatacctgctccacagcagtggacagaattactttaagcatttctcctttacactgggcagattcattttttttcttttctttttttctgagacagggtctcactctgtcccccaggctgtagagtagtggcacaatcatggttcaccacagcttcggcctcccaggctcaagcgatcctcccacctcagcctcccaagtatttgggactacaggtacacaccaccacgcccagctaatttttgtattttttatagagatagggtcttgccatgttgcctaggctggtctccaactcatgggctcaagtgatccacccgccttcgtctcccaaagccctgggattacagacgcgaaccactgcacccagctgagattcacttttttgaggaaggcaataaagggtgaatttgcagctggaaataaatcaattgataattggcttttaccccttgagcgtgggttgcattgtcctgtttcttcgtgtgtctagtgatttttgactgaatactgaacatcatgtggagagtctactctgcttcctcctctgaagctgtcggtgtttgctttgcaggttggttcactgctgggccctgtggacttgttctcatgctttgtcagtgtcgatgtcgaaagcccaaagtgtttcccaagtcctgctaccttggtaagactcaaccctcaatctcagtctcccctgcagatctctgtggggcttggtctgaactttcgttaggtgagtgtggagtaggcattattgtacattgtagtcctttctcctcaaaaaaaaaaaaaaaaagtaaggtctctccactctagccaggtccaaatgccaaatgccaatgccgcccaagtctctccactctggccaggtccaaatgccaaatgccaaaatactgcccgacacagcttgtcctctactatctttgttctgctctaacctgggtggatacaacctcaggtaatccctggtgagtcgcagccttgagtactttcctccgagaaacactacggtttgtgtccagcccatagaacacagaaaggtgataagtcactctgtgattggctgcatcattccaggctctgtcctgggggacggagcagcaagacacccctgctgtctgtgaagatatggctgttggaaggcatgggaggggcctcgtatcagggaaccagtgagtggccccaggctgccagccaacaagaaagcagggacctcagtcctacagccacaaggaactgaattctgccaacaaccacgtggccttcaaagaggacctcaagcttcagaaagaaataccaacaccttggtggcactcttgaaaccccgagccacccagcggaattgtgtgtgggctcctgaccccccaaaactgagaataaatgcatgttttttaaagctactaaatcggtgttgattggttatgcagtgacggataacagcacagggcctatagtcactgctctctggtgagcctccggcacctcctcaccctcagccacaggcttgcagaggtcccaagcactccccaccagcaacatgcacacctaagcccctcactccagtctctgcctctcatcccagggggactgccgtgctctgcctggagccctgcttgtggggttatggccaaggagagccgggagtgtgggcgcctccaagcaccctctcggtcttgtgctgtcctcaccccactgcctgaagagagcagcgcacgaattttgtctggtctcagagtcgtttctggagggagacgtacctggcagcagctactcccccgcaactggaagcagcggttgactccacatcaatacaaagacaaggttacttcagtctttttacttttatattttattgttttactattttcacggtatatacattgggcctgtctttttaaaaatcttttatgacactgaaacttttgaagaatgcaaaccggttgttttgtagattgtccccgcattgagcgttcctgacatttctgcatgaacagattggcaccaagagccaggcatccttcccagcactcgggacgctggctgcccaccagcggcaacggtacctttgatcctctggttaaactggcatccacaagcttctcacagtaaagttaccactttgccctttgtaactgataagtaagccgggcacggtggctgacacctgtaatcccagcactttgggaggccaaggcgggtggatcacttgagcccaggagttcaagaccagcccggccaaaatggtgaaaccccatccctactaaaaattcaaaaattagccaggtatggtggcacatgccggtattcccagctactcaggaggctgagtcacgagaatcgctggatcccgggaggcagaggttgcagtagccaagatcatgccactgcactccagcctgggtgacagagtgagtgagaatctgtctcaaaaaaaaccctgaaaattaacaaggaagtacttttgatactggtggccaggggaggtccccaaatgcgaatgggaccttgacccaggccagtgtcctgcctcttaacaccatcacaaaacgaattcaaggatgagttaaaaaataatgaaagtagagatttattgcaaagcaaaaagtacaccctccagaaagcagagtgtggctgggtgtgaaggctcacgcctgtaatcctaacacattgggaggctgaggcaggagttcgagatcagcctgggcaacatagtgagaccctgcctcataaaaataaacaagcaaatagaaaaaaaagtcaaagaagaaaggggagtatgggtgttctcaagaaagtgagtcgtgaggcagggtttggggcccctacctttaatgggtttctttaaccaaggagtggaatattcataaagatttctggaaaaaggtgaagatttctaggaactgtggtgccacccttttttacaccaaatatgtgtgttcctggaactgtcatggcactgccgagtgtgatttgtgtgttgatgagcatataattaggtcaccggtgaaacccaggtcaagtccgctgccatgtgggtccagtcgtctcggccagcgtggcccagtgggtccagtcatcttgtccagctcggcccagtgggtccagtagtctcggcccagctcggcccagtgggtccagtcgtctcggccagcgtggcccagtgggtccagtcatcttgtccagctcggcccagtgggtccagtcgtctcggctcagctcggcccagtgggtccagtcgtctcggccagcgtggcccagtgggtccagttgtctcggctcagcgtggcccagtgggtccagtcctcttggcccagctcggcccagtgggtccagtcgtctcggcccagctcagcccagtgggtccagtcgtctcggcccaggtcggcccagtgggtccagtcgtctcggccagcttggcccatgtcctggtcttcagtgtctggtcaccccctggcctctgcagctttttcaacagctctcttttgatagccatgaaactgctacctggaatcatctgttctcctgcggccaccctgtcgtagtcctgtctcactttgggttaggtaaatgtcctgtccctcatcagaatccatctctggacttagcattcgtggatgattcatggatcagtgtttactatgatggctgtgcgtcttaaatcattgttttatctgtcattatttttttgaattgtcacacagtaagttgacttttttggaagatgtacgactctgtgaatattcacacacacgtattgccaccgccgcactcaggaagcaggacatcccacgactcggaaatctccccagacataccgtttgcggtcacccatcctcttccccctggaaaccccatttgttctaagaatgtcagatgaggcccaggacgtagacgcaccgggttgcgttgaggtctggcttttctgacttggcacatcgctgtggacacccacccagggggtttcacggatcgacggctcgttccttctatcactcagcagtatctcgtacacgacacaccacagtctctgttcacccgcagaagaacacctgcaatgtttccaggttgggcagctatgaatagagctcccataaacatctgtgtaccgtcctttaacgtaaacctgtttgaatttgtcttggataaatgctcagaagcggaattgctgggtcatacgtcaggcgcaggtttcccttcaccagaagctgccgacctggcttcgggagggaaacccgcgccgtctgcacccccaggggagttcccggagcctcacggccgctgcagcacttggtgtccttggtgtttggaaatttttttttttttttcagctgctctcataggtggcctctcatggtgcttttaatttgcatttccctaatgttgctgaagaacatttcatgggctagttagtacacggtctttggtgaagctcccattaagtcttttatcctttttttttttttttttttttttttgagatggagttttgctctcgtcgcccaggctggagtgcagtggtgcgatctcggctcactgtaacctctgcctcccaggttgaagcgattctcctgcctcagcctcctgagtagctgggattacaggcatgcaccaccaccctggctaatttttttttttttttttttaatagagacagggtttctccatgttgcccaggctggtctcgaactcctgacctcaggtgatccgcctgcctcggcctcccaaagtgctgggattataggcgtgaaccactgcacccatccttttatcctttttttaaaacagctttattgagatatcatttacatgccataatattcgcccatttaaagtgcatgatgcaatggctcttagcatatttacaaagccgagcaaccatcaccataatctaattttagaacatttcatcaccccgaaaagaaaccttgtaccatttagtaatcagtccccattcctcctccacctctaaccaagccctgggcaaccactcatctgccttctggctccatgcatttgcctgttctgggcattttgtatgaatggaaccgtgcgcagtgtgtggtctttgctgactggctgcttctgggtttggtttctctgcgtcgcagcctgcgtcagtgctttcttctttcttattgccaaacaatcctctgctgtagggacgggccacattttgttcatcattcatcagttgatggacatttgggttgtttccacttttttttgagacagagtcttgctctgtggtccaggctagagtgcagtggtgcaatctcggctcactgcaacctctgcctcccgggttcaagtgattctcctgcctcagcctcccaagtagctgggattacaggcacctgctaccacactcgactaatttttgtatttttagtagagacagggtttcgccatgttagccaggctggtctcgaactcctgacctcaggtgatccgcccacctcggcctcccaaagtgctgggattacaggcatgagccaccgcgcccagcctgtttccactttttagctaacatgaataatgctctatggtggtacaagttttttgtgtgtggacacgttttcatttatcccgggtagatattgaagagcaaaatcctgtgactatatttaaccttttgaggaaatgccaaaatgttttccaaagtggttacactatttcacattcccagcagctgtgtagcagggtttccattcctctgcttttattattgtgtgtctttttatcagagctctgctgggtgtgaagtgttgtctcattggggtttggatttgcatttccctaatgactaaccctatggatcttttcatgtaccttttagccatttgcatgtcttttttgcagaaatgtctattcaaatccttgacttttttttttttttttttgagatggagtctcactctgttgtccaggctggagtgcagtggtgcaatctcggctcactgcaacctctgcctcccaggttcaagtgattctcctgcctcagccccccgagtagatgggactacaggcacgcaccatcatgcccagctaaattttgtatttttttgtagagacagggtttcgccatgttggtcaggctggtttcgaattcctgacctcctgatccgcccgcctaggcctcccaaagtgctgggattacaggcgtgagccacggcgcccagccccttggccaagttttcaattgaattgtttatttttattttttggtgttgagtcttgagagttttctatgtattgtggatacaagtcctttgtcagttctgtgacttgcacatattttctccaagtctgtggcttgtctttctaatctcttaacaggatcattcacaatacaagttttttatttcagtgaagcccagtttatccatatttttcttaagtggatcatgcttttaatattggctgctcaggtcacaaagattatctcttgtactttcttctagatgttttatagtttacattttatatttagatacattatccatttgtatagttaatctttgtataatatgtgagatttaggtcaaggtttttgtttggttggttgttttttgttgttgttgttttgttttttttttttttttgcatgtgaatgtcaaattcttccagcaccatttgttgaaaagattatactctttttttttgaaacaaggactcactctgttgcccagggtggagtgcagtggcatgatctcagctcactgcaacctctgcctctcgggctcaagcgatcctcccaccacagcttcctgagtagccgggactgtaggcacgtgccacgaagcccagctattttttgtagagacaagttctcaccatgttgcccctgctggtctctaacccctgggctcaagtgatccgcccgcctcagtctcccaaagcgctgggattgcatgcgtgagccactgtgcccggcagaaaagatgatacttgctctgtcaaatcactgtagtgcctttctccgagaacatttggtcacatttgtgtgaggctgtctctggactccatcctgttacactgatgtctgtatctgtctcctcaccaagacctcactgtcttgttttttttttttttttttttttttgagacagagtctcactatgtcgccaggctggagtgcagtggcacgatctcagctcactgcaacctccgcctcctgggttcaagcgattctcccgcctcagcctcccaagtagctgggattacaggcacacgccaccatgcccagctaatttttgtatttttagtagagacggggtttcaccatgttgggcaggatggtctcaatctcctgacctcgtgatccacccgccttggcctcccaaagtgctgggattacaggtgtgagccaccactcccggccctcactgtcttgttttgttttattctgttatttttgtttttctaagacatcttgttatcgcacactgtgttcaatattgcgattttgtagcaatttctaaaataagatcatggccgggtgcagtggctcacgccattaatcccagcacttcgggagcctgaggcgggcagatccctgagcccaggagttcgagaccaggctggccaacatggtgaaaccccgtctctactaaaactacaaaaattagcggggcgtggtggtacatccctgtaatcccaactactcgggaggctgaggcacgagaatcgcttgaacccaggaggatgcagtgagccaagattgcaccaccgcactccagcctgggcaacagagtgagactccatctcaaaaatataaaataaaataaaaagtaaaataaaataaaatgaggtcgtatatggaaagaatagtcttttcaacaaatgacgttagaaaatctgcatatccacctgcaatataatgaaacccgctcttccctcacctgtcaatcaatatcatgaagccggctcttccctcatctgtctatcaatatcatgaaaccacctcttccctcacccgtctatcaatacaatgaaaccacctcttccctcacccgtctatcaatatgatgaagccggctcttccctcacctgtctatcaatatcatgaagccggctcttccctcacctgtctatcaatatcatgaagccggctcttccctcacctgtctatcaatatcatgaagccggctcttccctcacctgtctatcaatatcatgaagccggctcctccctcacctgtcaatcaatataatgaagccgggctcttccctcacctatatatcaatatgtgatctaataaaaatatactactatttgaagaaaccataggtgtaggctggacacagtggctcatgcctataatcccccagctgtttgggaggctaagatgggaggatcacttgagcccaggagttcaagaccagcttgggcaacacagaaagaccacatctctacaaaaaagtaagaaattagctgagagtggttgtgtgcccctgtagtcccagctaccagggaggctgagatggaaggatcccttgagcgttggaggtcaaggctgcagtgagccgagaatgtgccattgctctccagcctgggcaacagaggaagactgtgtctcgaaaaaaaaaaagaaaaataggtaaattgttcatgaccttcttagataagacactaaaaccacaagcaaagtaagaaaaggtaggtaactggactttgccaaaattaaaaacttttgagcatcaaaggacactgtcaagagaatgaaaagagaatctatagaatgggggaaaatatttgtgaatcacagcagataagggtccagcattccgaatatacaaaggactcttacaactcaacaatacaaagacactcaatatcattagtcattaggaaaatgcaaatcaaaaccacagtaagacaccacttcacactctctgaggtggctataatcagaaatatgaaaaatatcaaggttggcaaaaatgtggaaaaatgggaagcctcttccattgttggtagcaacataaaatgttccagccactgcggaaaacagtctggcagttcctcagtaagttaaacatagacagcgatgtgtgagccagcaattccactcctaagtacagacccaaaagagttgaaaacaggtattcaaacaaaaacttgtacatggaatgtttgcaacagcactatttataatatccaaaaggtggaaacaactgacgtccataaatggatggagagagaaatgtggtctatccatacaaaggaatgctattcagccacaaaaaatgaatctagaaaagtgggtgaagaaaccagaaacaaaaggcacaactcgtatgattccatttgtatgatgtgttcagaataggtaaattcagagacacagaaagcatattagtggttgccaggggctggggacggggacaggggaagagactgtttaatgggtgtagtttccttttggggagatgaaatgttttggaactagtcagaggtgatgggtgcactgcattgcgagtgttccatgatgctactgaattgcatattttaaaatgcttaattttatgatatgggaattttacctcaacaaaaattattgaggtagcataatttctctatatcattatctttgagatagagtctcgctctgtcacccaggctggagtgcagtggtgtgatcttggctcaccgcaacctccaccttccaggttcaagcaattcttctgcctcagcctcctgagtagctgggattacaggtgtgcaccaccaggcctggctaatttttgtattttttgtagagacggggtttcaccatgttggccaggctggtcttgaactcctgacctcaagtgatccgcctgcctcggcctcccaaagtgctgggattataggcgtgagcctccgcacccggcctctgtatcattattttccaaaattgttgtagttgttctagttcatctttccattttaattgtgggaactgcttgtctatatcttcagaaaatgtggctgagatttgtactggaattgcatttaatgtataaatcaacatggcaaaaatcagtatctctactgttgagtccaaaacccaggaacacagcatgtctctccgtttgcctgggtcttgatactttcattaacatttcatttttttaaatttctgattctaactgtacattgcaggtagaaatactgtattagtttgtccttgcactgctataaagaactacctaagactgggtaatttataaagaaaagaggtttaattgactcacagttctgcaggctgtacaggaggcctcagggaacttacaatcatggtgaaaggcaaaggggaagcaagcacatcttcacgtggcagcaggaagagagtgaagggggagttgctacacactttcaaaccaccaggtctcgtgagaactctataaccagacagcactcgggaatggtgccaaaccattagaaaccaccaacatgaggccgggcgcagtggctcacgcctgacaccccagcactttgggaggccgaggcgggcggatcacaaggtcaggagtttgagaccagcctggccaatatggtgaaaccccgtctccactaaaaatacaaaaaaaaaaaaaaattagccaggcatggtggcgggcgcctatagtcccagctactcgggaggctgaggcaggagaattgcttgaacccaggacgcggaggttgcagtgagctgaaatcgggccactgcactccagcctgggggacaaagcgagactctgtctcaaaaaaaaaaaaaaaaaagaaagaaagaaaatagaaaccaccctcatgacccaatcacctcccaccaggctccacctccaacactggggatcacaattcaacatgcagttggggactcacagccaaatcatgtcaaatacaatggatttttgcatgttgactttgtatattgccatcttgctaaccccacttattcactgagtttgcttttttgtagattccttgggattttctacatagacaatcatgttgtctgggaatcgggagaggtttatttcttcattttcaatctgtatgcctgtactttgcttctcttgtattttactgactaagacttccaatagatggcttttttgttgttgttattgtttttgttttttgagacagggtctcactgtgtcacccaggctggagtgcagtggcatgatctcggctcactgcaacctccacctcctgggttcaagcaatcctgcctaagtctcctgagtagctgggactactggcacgcaccaccacacctagcatgttttttgtttgtttgtttgttttttagtacagatggggtttcaccaccttggccaggcgggtcttgaactcatgacttccagtgatccacccgccttggcctcccaaagtgctgggattacagttgtgagccaccgcgcccggccggtaaatgttgataataggagtaggagtggatgcgctcgtcctgctctcagtcctgggaaaaggattctctcacctcagtacagcactggctgtaaatacttcatcagagctctttcttagattgaagttgttttctgttcctgctttgccgagatgttcaccgtgaacgcacactaaatgttgtccaatgctcgctcactgtccatcgcttgatgtaaggggcttacaactgcaggttggtgcatttttacaaatcccagcacctgtgccatctcagtgttagcatttgctgactgtttttttccatttatttgttttttcggggtttttttgagatggagttcactcttgttgcccaggctggagtgcaatggcgcaatctcagctcactgcaacctccacctccaggtttcaagcaattctcccgcctcagcctcctgagtagttgggattacaggcatgcaccaccacgcctggctaattttgtattattattattattttttttggagatggagtcttgctctgtcgcccaggctggaatggtgtgatctcagctcactgcaacctccacctcccaggttcaagagattctcctgcctcagcctcccaagtagctgggattacaggtgcccgacaccatgcccggctaatttttgtatttttagtagagatgggattttgccatattggtcaggctggtctcaaactcctgacttcaggtgatctgcctgcctcagcctcccaaagtgctgggattacaggcatgagccaccatgcccagcaactgagattttcctggttcacttatgccaagtaattttggattttatcctaaagtgtagggttttattcttttttttttttttttttttgaggcggagtctcgctctgtcacccaggctggagtgcagtggcgcgatcttggctcaccgcaagctccacctcctgggttcacaccattctcctgcctcagcctcccaggtagctgggactacaggcgcccgccaccacgcccggctaatttttttgtaattttttagtggagatgggttttcaccatgttagccaggatggtctcgatctcctgacctcgtgatccgcccacctcggcctctcaaagtgctgggattacaggcgtgagccaccgtgcccggcctcgttttccatttaagttgagattttcctggttcagttatgccaagtaattttggattttatcctaagtccagggttttattctttttagagatggggtctctctctgtcacccaggctggagagcaggtgccatcgtaattcactgcagcttccagctcctgggctccagtgaccctcctgcctcagcttcctgagtggctgggaccacagcgcgtggctctttgatgaataaacactccttggtttgctgtttgcctttggttaaattccaaagcactgacatggttgtttctgacttttgtttagatttacaggtacattttggagagagggtttgttgacctcctcacccctccactctggaaatctttaatatattttattatgcaattcaaccttccatccaatatacatactggacgcctgcctcctgcatggctggctctgcctcagccactgggacccagggtgaacagatacaccaccttctcccacagtgcttgtgtaaccaccaagccaatgtcctgagttacttccaacagtgaaaggtacagggattaataaggaactttcgctgagcacctgccccgtgccagatactggtccaagcacctgcaggaagcatcttaccctcaaggtggccacaggagttagctatgcccgtctcacgcgcagggacactgaggaacaggcagccttggctgctgccccccggacttcacctgccacatcaggtgccgccggcatagcaggccttcatcaaatattagtcagcacttctgttttcttctgcaggtggtgacaccatctaagaggcactggccagagagctgggcagcagctgccacctgggatgaagatgggcagagctgggccaccagggccgtggtgtgaacacaccactctccctccaggggccgaccaacgagctccgggggtccaaccctggctccggctttggcagaactctcacctcgcccccagacacctgtgggaggagcacagtgcaggtggcgacagctcccaggggccgagcaaggctgtgagcctccgcactaggggcctctcccatctagtcctccccacacgctggggttaacgcattcttaacatatgtatgttaacccaaccataacaaggtgccaccatcgtcccgtccacaagggaggagacagtggctacagggtggcaggcagcccttacaagtgggactggaagcctttccctcccgccctgtgggaagcctgtggccgtccccgccctcgtccagctgtgccctgtcctctccagctgaccgtccccgtcaatctcatccctgccaatgatcacatcctagcagcaaccgggcctgaaccggcctgctatagcttgcgcacaatgcatcttccgtccgcttagcttttctgcccccatttcctacagccggggaggctcgggtgcagtgtctctcctcgctcctgcttcctgacccagagcccagacctgggacttcccaaaagcccccagacacaccaagggcaccgccgaacccctcagagccaagggagaggagagctagcgttccctgagctcaccttgcctggtggcacgggtcccctctgtctgcggccactgtcatgggagaagccaggctcagccactggcaagagcaggcagccagcaagaggtggatgtgggtccaagcccaggccacacggctcccagcaagagccatggccaggggccagtcggcagcccctctgcccgacaaggatgtgggccagcgtcgtctgcacttcagaggagacgagaaccaggaggcggcccccgagggcatcccgcgggtcctcacggaggctgcgttctcccaccttggccaggatgccccgggaacaccatgcagcgtctctgaggcttcctgtgcagaggggctcacagagcccccaccggcctggtttagtaaatgcagtttttaccttttcactttaaaggaaaatgaaaattcctcctttcagacgctctgtgactgatgttgaccggtgttgactggtgaggttgagaatgaggtgagctgggtcaggccagcctagagggaagcgggtgacctggaaggccgtgctgtcaggcgtggtcggcagtcggccccacggctccttcagggtgggcctggaccacagacacctcaccagggtctcccgtccctgggcggctgcatatgggtccaagcaagccacaaaggctgtgccagccaagcccaacgcaggccgcccctacagtccctgcccggccctgcaccctccccaccccttcccaggtgctgatcaccagtactcactctgcaccccaaaccccaaaccccgtctcagcgtctgcccctgaggaccctctgagtgtcaacccaactgacccgtctgcctcatcagtgacccctcggggctgcacacctctcccatcgcaggtcctggcactgctctccggcaccgagctccccctcccaggtggggctcaggcggttccctgccctccgtccttagacctcagctgaaacctgagctctccccaccacccgcccccgccagcctctgcactgctccccacgggaaggccgttctcccttggtttaccgttccctgcgcttggctcggccatgtgcacatagtaggtgcttaccacactcgtgcaatgaacacacagagcggtgcagggcccaggacagcgccttccccacgtgctcagggggcacaagggcgtccctccaagtcttgctcaggggcctcccagggtccctgcccagctgtgggtcctcactgagcacccggcgaggacagagtacggcatccgttggcctcgatctccggaacaacacgggcacacggccgtcccagccagcaacgagagccacgaaacaaatccacccgggctgactcccgaagccctcggactgttccgccccacggacctcccggaccctctcttccacggggaagacaccgcccagccaggaccgggtgtataaagaaacgggatttccgtaggggcaggccgatttcccctgcggggccgagggaggtgtggggaggattctgcgctggggggaggaggagagggaggacgcctttctgcctgggaagggaaaacgcgccccctcctgattggcatggcgggccgtcccccgggccccagggccctgccgggaacgctctgggctccccaaacatggggtctccgagcagtggggcccagcctctgcctccggcgactggagactcacctcacccgcccaaatccgccccgctctccgactgggccccgcctcccactgccccgccatccgcccaccctttcaccgccccctgcgggcagcaggcgcgtcctggggctgggcaaccggggtgcaggttccggagctgccagagctgtgagggggactcgggagagatccaggttcctctggctgcgaagtccctggaggccgggccggagggctccgcgcacgtagcactttttggcccgcccggcgcccccgtcgcctccacaagggctgaagaggacgggcgggctggaccaggcggggctccgagacgcgtccgagacgggggcctgggcccgggagaggggcgggggctgggctcccggacccgggcgcggggccttttaacccctgcagacccaggaccggccgggccgccccaagacgaacgccgcagggctgggctcagcccaagccagacggcgagagtcgcaccgaggtggaagctgggggcgcggcctcgccggggccaggaaaggggcggggccgggtggggcccggggaggagcctgtgcgccccgccctccgtgacgcgccgcggcccccgcgcatataagtgggcgcgtccgcgcgtgcgcaccccgcgcgcgcctctctgtcgtggcgcggcttcccgcggtcttctctgcaaatgggctccgtggcctagcgcccccgtccccgccacccgtgatcgtgcgccgaggcccgcgaggggtcgccgcccaggtgaggggcgccgcgcgcgggtgggacgagcaggcccgaggggcggggggcgaggggcggggctgggccgggggctcctctcctctccgcctggcgagcgctgggctcggggtccccggcgggctcctctcgggtcgggcgggttgggacggcgcccaccaggttcccgacgtctgggccggggccccgcgcacaaagcgcctttgttccacccgctcggccggtttgggctggttggagccgcccgcgccccgcgcggcgaaggcggtgccgggagctggggagccccgcctcggtaaataacccagcgcggcggctccacccgctggggagcgcccttcatgacggaaggccgctgacccgaggggctcctccacccccatgcgcagatcccaccagccagcaagctaaagcatggcggccatcccctccagcggctcgctcgtggccacccacgactactaccggcgtgagtagcccctgccccccatccacgcggatgctctgctggcgccagtgccggccccgtgcaggctgcggaaccagcgctcggcctgaaggccggtgggctggggggctccgcgccccgcgttgctgacgggacctctcctctccaggccgcctgggttccacttccagcaacagctcctgcagcagtaccgagtgccccggggaagccattccccaccccccaggtgagtgcaggatcgcccctttctccccccgctcctccaggagctggcagcatcaagaccccacttcgcttctctcaggtctccccaaggctgacccgggtcattggtgggccagcttctttttcgggaagtccaccctcccgttcatggccacggtgttggagtccgcagagcactcggaacctccccaggcctccagcagcatgaccgcctgtggcctggctcgggacgccccgaggaagcagcccggcggtcagtccagcacagccagcgctgggcccccgtcctgacctgagcggttaccaccagccccaggcctgcggaggcgctagtccaccagagcccctccccgcccctctccccactccgcatccctcgcccccctccccacctcccaccccccaccctgtaaactaggcggctgcagcaagcagaccttcgcatcaacacagcagacaccaaaaaccagtgagagccccgctctctaccgcccggccccagcactcgctagctttcctgacacctggaactgtgcacctggcaccaagcggaaaataaactccaagcagccagtagccccgatggtgtgtgcctgagctgtgtggcccgaggttccatttgagtgtgagaaatggctgaatccctcccgacctcactgccttgtgggggctggccctgctcccaggcctttctgggcctcctcacgctgtgaggctgttgctggggctgataagggtggggttcactgctgcttctggagagccttggacagcaggcagtcctggagctggacaagcaggacccagggcagccactgaggtgggcccccgtgccacctttagcggggggaaagggagcagggagggctggtcctctgagggattcaggccccttacccgagggcctgcggggcggggagtagcctctggctgtgagctgggaagccctcactctggagggacctggttcctgctggtaggtgtctcccaagggcctcccataggggtgttgccccaagacaggctgaggggtaggggctgcaggcaccgtggaggggtcttcctgccacaggcagcccagcttaaagtgagggtggctgcatcattctggcctggtataggcatggagtgttggagtccgggagtgctgcaggctggcagggatgggggtccacacacaggagtgcatgggctgtgagcttagtagactccttcataaccaaggtgggtggtgtccccacacctctgccaggagcctacagggattgactcagttctgttgagaggcagcttagtgagcaggtgggagtcagtgagatagctggagacttgatgtgtggccagggacatggtgagaggaggggcctccgtggggtgggaaagggtggggttcagtggtgggggagggactctggggaggggtggggatcagtgggtgctccctgcctggtaccctgttccactgcactataaatagctgtactagttggtgggaagctggtgggaaggcatctggcttgtggcctctgatggctgagcctttgtcctgtccacagggtggaggcagcctcacccagccatccaagccggtggtcagtgctgaggctgggtgggggagcctccgatggacccaggagtgggaggctgctcctaatggcagttgagccccctgcagccttttgcagtgtccagatgaagcccacagagaccctcctccatgtacacacagctgtgagggtagcaggagttggtgttgaagggagagcccagccacgctcaggtccccaccacacatggcctgggggggctccgcccttggctgagctggagggcttggggtcaggaccaagggtgggtccaccctgcttggaaagaagctgtcctggcttttggagtcagcgggggaggggcactgcccgggagctggtgtcttgttggaaggggcagctgggagtagggagcagccgagccacaggctgcccgcggcatcgtcccctgcctcgggtcagggggccccttgactggaggacctcacaaccctgggggtgtccatggcctgttcctgggagctgcaccctcatcagattctctgtagggggagaagtcatatcttttcctcacccatcacaagcttcatggctgagacctgttagaaacaaaatgcttcctcggtgccacaaagaaatagcactcaaacattaattttctcagcaaggcaatttttacttctatagaagggtgcgactcgcggatggagcaatggtgagagcgcacctggacaagggaggggaaggggttcttattcctgacacaggtagcctctacggctgtgtcattcccctgttgggtggggttggactgcacactctaaggtaattctgattgactattttaaagagagcaggggtgtgacccagagtggtggggtgagtagtttggcaggaaggacaggaacaggtagctaaagatgacttaggtcagagcaggtgaccaggggccgggtgcgatggctcacgcctgtaatcccagcactttgggaggccgaggcgggtggatcatgaggtcaggagatcgagaccatcttggcaaacgtggtgaaaccccgtctctactaaaaatacaaaaaaaattagccaggcgtggtggcgggcacctgtagtcccagctactcgggaggctgaggcaggagaatggcaggaacccggggggcggagcttgcagtgagcggacatcgcaccactgcactccagcctgggcaacagagcgagactccatctcaaaaaaaaaaaaaaaaaaaaacaggtaccaggatgagtcaggacggagcaggtgaccaggggaacagatgtgaactattgattaaaactggtggaaaaggttgtttactgaaactatgcacgagttaaatggagaacaaagaactgaacatacatgctgagtcctctaagagaaatctagaactcactgtatccaacagacccttgaacaaaagacagattaaactgggcgcagtggctcacgcctatattcccaacactttgggaggctgaggcaggtggatcactagaagccgggacttcaagtccagcttggtcaacatggcaaccaacacggcaaaaccctgtttctatcaaaaacaaaaaaattagccagacgtggcggtgcatgcctggagtcccagctactggggaggctgagatgggaggatcccctgagcccgggaggcggaggctgcggtgagccaagattgcgctactgcactccagcctgggcgtcagagagcaagactctgtcttaaaaaaaaaaaagaaaaagcatacaaacatttaatgcgagttccatgtgatgtgggccccttcaaaacaaagaccaaagaaatggtctatttcacagcggagcaggagtgagcggaggatggaagggtgtgatcaaggcccgacttgactctgacatccctttcctctggttagggggcgggacaccacgtgagggtctgcagggagagggtctgggagtggccttcctgggttttatggcctgcttcagggaagaaaggcagggaggttagaatggcctcaacggtgaaatatttatctttttcttcctccctaatcccagaattcagaaactgttagtgggtttgcataagttcaatgagaatctgttcttgtaatagggcacaattgaaaacattggttatattaccaaggctttgactggaatgtcctattttcagatacgactaaaggagttagggttgactgcatggtccaataaagccccttggaaaaaagctggcctggtacctcacatacgtggttcccttacagatgagtaaagaatgtcaattcctggcaggtcccagaatcttaagataccttagggacctcaagaagagaggaattcccctaaatctgtacttattgcaggcaaagtctgatggcaagtctttgcgatggcttcctagcctcaagaggcttttaaaagcccaatctcagattccttataaaaagttccagtaggccaggcacagtggctcacacctgtaatcccagcactttgggaggccacggtgggcagatcacgaggtcaggggatcgagaccatcctggctaacacggtgaaaccccgtctctactaaaaataaaaaaattagccgggcatggtggcgggtgcctgtagtcccagctatgcgggaggctgaggcagaagaatggcatgaacccgggagacggagcttgcagtgagccgagatcgcgccactgcactccagcctgggcgacagagcaagactccgtctcaggaaaaaaaaaaaaaaaagttccagtaaagcaaattttaaaagagcccacgtgtccaggtgtacctataatcccagcactttgggagcctgagatgggaggtttgcttgagcccaggagttcaggactggcctgggcaacatagtggggctccctctctactaaaatacaaataaattagccaggtgtggtgtcacatgcctgtcgtcccagctactctggagggtggggctggaaggtggcttgagcccaggaggtcaaggcagcagtgaaccatgatggtaccactgcactccagcctcggtgacagggtgaggccctgttggaaaacaaaaatgaggaagaacctatgtggttaatcactattcttgttccacttacataaataaccacaccaggtttaatgaggccaaacttactctgcaatcaaatcaatcttttattatctttgatagaaatgtgttaatttgaaaacaatcctacttttattatctttgatagaaatgcgttaatttgcagccggtcacggtggctcacacctgtaatcccagcactttgggaagccgaggtgggcggatcacctgaggtcaggagttcgagaccagcctggccaacatggcaaaaccctatctctactaaaaatacaaaaattagtcgggcgtggtagcaggcacctgtaatcccagagacttgggaggctgaggcaggagaatcacttgaacccgagaggcagaggttgcagtgagccaatattgcgccattgcactccagcctgggcgacagagcgagactccatctcaaaaaaaaaaaggaagaaggaaatttgttggctgggtgcggtggctcacacctgtaatcccagcattttgggaggccgaggtgggtggatcacctgaggtcgggagttcgagaccaacctgaccaacgtgaagaaaccccatctctactgaaagtacaaaaattagctgggcgtggtggcgcatgcctgtaatcccagctactcgggaggctgaggcaggagaatcacttgaacccgggaggcagaggttgccgtgagccgagatcaagccattgcactccagcctgtgcaataagagcgaaactctatctcaaaaaaaaaaaaagaaaaagaaatttgttgactgtagagagaaaaattatgtttcaaaataaaactcgtgcccccactattagactctagcccggtttgctgtctggaggttttgtcgcccacctgtggtccggaccgggtcctgaacttcagtttcctccaatatttgcctacagctcaccaaaccactctttccaattttttcttccaccattcctcatggagtcactgaaaattaaaactgctcttttcccaaagccctgtaagctgaagctgccccacttgatacagacttcagagaaatttccccagcaactctcgtacagacggctttcgtgcccaggctgggcgcagcagctcaggcctgtagtcccgaggcaggaggattgctagagcccaggagttcgagaccagcctgggcaacatagcaagaccctgaatctcctaaaaaaaaaaaaatttaaaattagccaggtgtggtggtgcattcctgtagtcccaactattcaggaggctgaggcgggaggatcacttgagcctgggaattcaaggctgcaatgagctgtggtcacgccactgcgctccagcctgggtgacagagcaagaccctgtcttcaaaaacaaaaacagaaacaaaaaacgttttcttacatctggaaaacaaaatattaaagaaccgtaatgcttcagacaaaagtcattaaacagtaaacatcctcgtcagttcattcattcccatgtcattaattcttgttctggttgatcctgggacagaactttcatggacctgccaggtccctccttcgagttctggaaatttgcacccaatccaaggctatgacctgaaccagaaacctgtgctccagagcacctgtcagaatccttcccaggaatctctttgaagaataaacaatttgggactagctgattgcaaagctttcagaaaaaatcaaagtaagataataactgtgaatgaccgaagacttaagatagccatggctcaggatctgatgagagtttattatattcgtgacacggttggcaaggaaacttggttatttctgtggcatgcagcattttaatgtaataaccaaaattatgactgataacattgcaccagatttctaggaatagcatgtgagataggatatatatcataggataacgtatcagatttctaggaattttatagagtttctgcaacattcatatcaaaaccaaacccgtaaatagaacctccagaagacttagtgtgacttactatttcacacgctttccatctcatgtagcacatcggataagcctgattagtctgacatctgtctttcacaaggcagaagacaaatccttttgagaaatcctagtacctttccagaaactcccaaaattatttttctttctttcttttttttttttttttttttgagatggagtctcgctctgtcgcccaggctggagtgcagtggcgcgatctcggctcactgcaagctccacctcccgggttcacaccagtctgctgcctcagcctcccacgtagctgggactacaggcgcccacccccaccaccacacccagctaattttttgtattttttagtagagacggggtttcaccgtgttagccaggatggtgtcgatctcctgacctcgtgatccacctgcctcagcctcccaaagtgctgggattacaggcatgagccaccgtgccccgcctattcttcttttaaaccaaaaaaactttcaggtgagtcaaaaccaaaaccaataagctttttatgacttaaccatggatgaaagagacaccttcaaaatcaggtgcaaaggaggcagcccccccagcccggaaccaccccacagacagtagagaagggcccttgtcagcgcaggagtgaggggcgctttccagcactgacccagcgacaaaggtgaaggtgggaaaagccccttgtggacgtggacggtgaaactgagctggcgcctcgggcagtgatgcttgggctggcagagaccagggagagagttctcactggtcataaggccaagctctcaagacacaagacaaacaggaaagaaacacctgcccctgggaggaaagaacccttgagcaccaaaaccaaatttacatgagcgtcccgagccacgcgaatgactttctcccaccaagctgaactgggaagagcaggaacaaggcgtgtttgcctcccaccctcagccgggcactgcagacagacagccagagagcgggctgtggtcagagtcccctctgacctctgctggcttcgtgtcagtctcccggatctcatctgcaggctccagagcaggctgcgtgtcagcagctgagacccaaggcacacacgatggagtaaggagaggagcacacgcgtgtattggacgcagacactccacatttgtgaacctttcctgcacccatcacctcagtaaaccccagggaagcgcgtgggccttgatcccaggtccaggccctctgcccaggcccctcctcagcagggcccggccatgcccgctccacagcagctcaggtcgggttctcgtagctggtgaagctggagagcctctcccgcagggccttgaagcagggtctctgctcggggtccctgcaccagcatgtcagcatcagcttgtgcacgctgggcgggcactccagagggcagggcatgcggtagccggcgtccaccctcaggaaggcctcatggttggacatgcctgcggccgacagggatgagaagagctggggcccacctgcctaccctcccccaagaagccacaccagccatccactgccccttcctggggccttccccgcagcctcagctgccatgccttggcgccacccagcacactgtccactgctaacacctccctctggacagggctccaacaggcagctccaggcaccagcctgggtgctcagagaatggtgcaggtgtggagttcaggcgatggcccgcggagggccctgaagcccgtgggggaggcaccccccagcgtccctgccggctacccaggacctcccccactctgcctctcatgcccagtcagggacagtggggacagtacctgggtagggcacctgacccctgctgaacatctcatgcaggagaatcccaaaggaccagacgtcggatttggtggagtaatggcctcgggagagcgcttcaggggccgtccacttgtaggggatattgtggtcatgggagaggtagacgtcctcctgcaatcagcctggagctgagtgggccgtgggggctgcctgtgccctgcccccgaagcatggacgggcacagcggccgcattgccccagcagtgggacggtgatgaccccactgtctgacccacgcacggccgctgcagctaaggccacactggggcctgaccaccttcaggagcccaacttcccctgggattgcaggtgtgtggggaccggagggcccgggggacagggaactgggaggctcccaggccgtcagaggggcccagggctgggccagtgaacaaggcacgtgaacaaggcagcggctgcgtggtgggccctgctgtgcgtgccattcagaatgggggccccaccggactcacggtggcttcccacctccctgcccagcctgggctcccgagggcaggggccgcatcctgctcccagccgagtccccagctccacacacaggaagcccccagccctccggccacgccccggccacgaccccagccacgccctctgagggccctaccttgataagcctggctaacccgaagtccccaactttgcagagggtgttttccccgacgaggatgttcctggcggccaggtcccggtggatgtaattctgcgactccaggtaacacatgccctcagccacctgccaggcgatgtccagcagctccgaaacgggcaggactttctcatcagagtctgcagaggggagtggagcagagcctggggtcagctgagccagctgaggtggggaagggttggggaggctgggccatgtctcatctgcctccaagctctgcgggctcagaggaggggccggggcaaagggcagctggcctgattgaaaattggaactgcaggccagctaccgcccttctggaaggcaactgtttatcacgaaccaaggagcaagctgggcgtggtggctcacgcctgtaatcccagcactttgagaggctgaggcggatggatcacgaggtcaggagatcgagaccatcctggctaacacggtgaaaccccatctctactaaaaatacaaaaaattagccgggcgtggtggcgggcgcctgtagtcccagctactcgggaggctgaggcaggagaatggcgtgaacccgggaggcggagcttgcagtgagccgagatcacgccactgcactccagcctgggcgacagagccagactccgtctcaaaaaaaaaaaaaaaaaatatatatatatatatatatatatataattagctgggcgtggtgacaggtgcctgtaatctcagctactcaggtggctgaggcaggagaatcatttgaacccaggaggtggaggttacagtgagccgagactgcgccattgcactccagcctgggcgacagagtgagactccgtctcaaaaaaaaaaaaaagaaccaaggagcagttcctagtggtctagcccagcgatttcccttctggaagtttgtgatgacgcgggaggagctggacgcagaaggaccagcgaagaggctcatgactgcgtgatgtaggcagtgggaactcgaacaggagaatggctgtcagcggcttgcggcctggtggtgcctgttttaccccacattccctcccggaggaccctgaagggcgtggggactgtctgagatgatcaagccctttgtgtgagggcgaggggtacggagcctttcgctcagagcgcaaacgtgcgtggtgcctcagtgtagctctcctcagacacacacggcatttttcctataccacaacgttccctcccattctaacatcggaatccaaactgcgccttcacgcacgggcatctccattccctggcagcgattgtctttggttttggtgagaaaggaaataatggaacttagagaggatgaagtctttgagccaatgtgatctgtgtgtgtctgtgtgtgtgtctggatcagtgtgtgtctgtgtgtgtgtgtgtctgtgtgtgtccgtgtgatctgtgtgtgtgtctgtgtgtgtccgtgtgatctgttttgtgtgtctctgtgtgtgtgtctgtgtctatgtgtatgtctgtgtgtgtcatgtgatgtgtcttgtgtgtgtgtctgtgtgtgcatgtgtatgtctgtgtgcatgtgtgtgtgcatgtgtgtctgtgcgtgtgtgtctctgtgtgtctgtgtctgtgtctgtgtgtgcatgtgtgtgtctgtgtgtctgtgtgtctacgtgtgtgtgtgtgtagacgtggggggggggtgtgcactttatttcctcacgtgcccccgctgcctccagcaagagccccggcccatgccactcaccgcggagcagctccagcaggctgcccttggccatgagctccgtgatgatgtacacggggtcccccacggacaccacggcgtacagcgccaggatgtgtttgtgccgcagcttcttcatggcctggatctccgactgcagcatctgctggtgcaggaggttgtctgcggggacgggtggcctcggtggatgcagcccctgaccccccaggccccaaggaagaggccaaggccctgcccccacacacagcagccatcacacccagcagctgtgcaggacacacagacctcctgcccccgacagggcacctggctcccgaggccacgaaatggcagatgcagccggccccacagggccccagcctggcgtacccacggggctgtggtggccacccgatttcttcctgtgcccggcccagacctctgacatagaggccagacctctgctggggcccagacgggttccagggaagttttacccatttccagtgatctattttaatggctttccattacgtcaaggattttaaattttctttctttctttcttttttttttttcccaagacggggtcttgctctgtcgcccaggctggagtgcaatggcgcgatctcagctcactgcaatctccgcctcctgggttgaagcgattctcctgcctcagcctcccgagtagctgggactacaggcacatgcctccacactcggctaatttttgtatttttagtagagacgtggtttccccatgttggccaggctggtctcaaactcctgacctcgtgatccgcccaccttggcttcccaaagtgtggggattacagatgtgagccaccgtgcccggcctaaaattttcttttataataaatgtatttaggtaaaaacataggtgcaattgaaagggaaccactctcgcatggacgctgtgggtgctgcttggggctcgaggccagaggtccctgttggcggggtgggagggtggcccagggcaggcacggggccacacagagccctgatcggggcccactcacctcgagaaatcaccttaatggccacctggacccggtctttccagagcccctcgaagacctccccaaagtagccggaccccagcttcctgcagagcgtgaactcctccctcggcctctcccagtcatcccaatggggcaggggctcaggctcgtgctggaggaagagtcggggacacagggcaggggctcatccttcaggaagtgccagtctgaagccagcacagggagcctggatttagcctcagatttagggccacgatcagcctgggttgggggtttctgagtgtctgacacaagggtggactctcctgggggctgcccccagcccagcatgaaacacccagacagaccggagccaggaccctgcagagtgccgctggcctctccgagagtggccaggcccggggatggtctcctggccccacccccaactcaggcaaacacctgtgctctgcagaaccatgggcttccctccagtgggccccaggtcagtgagtcaggacccctcccatgctgcccggccaacctctcccagtaggaaatgccagcctgtgaccccccagcctgaccccgcgtgaccaagtcagggcggagcggctaccttccggcagggcgcggccagccgcaggccgtgggacaggctctgggccctgtggtagttcacaagctcgggcaggctgaggaaggacaccgcctcgttcaggtgcagccggcccccggcacgccgccagatcttgtagtgccgcacagcctgcgtgtcccgcactgggagggagagcgtgagctgtgtggccaccccaactccgacgcctccctgcgtccccagccctgctggccacacctgcgcagagtttctgggtccccacagttgctgttggtgcttcctcagtaccacccctgcctcccctccctcagaacggctccctcctgccctgcacgctctggccaagctctctggcccctcctgcccccgtgccaggcagccagtggcctccgcctggatggcagctgcctaaaatcccagccatgctgagatcctcaggggcagggatggggtttctctgcgccccgcacaccccaggctcaggtctcatgctgggcgaggttcccatgggtgctgaggacctcccacgagtgcctcgggcagggctggctggagaagcccctgccctcccagggaggggccctgccccacgactaccctagcagccagtgacccaggccccagggaggagcgggccaggtgggcggaggggatgggagctccctggagaggagcccatgtcccccgtctcagccagagcgagccgggttcaccacgtggctgggagggcttagagccaggagcccccgcaggcaagcacaggctcggaggccggggccgcacccgacaggacgtagtcggcactcggcttctcgctgaccctgatcaggaaggcgcccgtggcgttgccctcggcctgcagccgacgcacagcttccgagcgggagatgcagccaaagaaccacctgcaggggaggagtctgagaacacgcggacctgggcccaccccacgtggaccccacgctggccccagcctgcccgcctggaaccccagccgcccttgcctgccacctcaagctcccagccctgaccacagctgctctcaggagctgtcgctgacccagacgccctgaatgtcccgaaaggccaggacaggcccctgaggacccggcgggggcaggggcaggcgctaccacaccctgccctgagtggcccgagtctaggggtcagagcctagggtggagctggggagggcagctgagcaggatggctgcccagagctgcctgcacacacccatgtgtgacgcacgctcacacacacacagtcacaaacccccacacatgcgcacagttcacccgcacacctgaacacacacgcgcatgtgtgctcacttgcccacacgctcacacgcacgcacacacagccactcgcgcgcactaactcccggctgcggggtgtgggccagccctggactgtggacttccaggtggagcttgcagaagctccaggtgacctgcgccctttgtgtgtctgactccctcaggtcactggaacacaaaccccacacagaagaccacggcccagcatggagcccctggggtccaccccctccacttccgcacacctggaagcactgccccacctgcccctccaaccacctggcctcccgccccccccctcacctggcctcccgccccctcctcacctggcctcccgccccctcctcacctggcctcccgccccccccctcacctggcctcccgccccctcctcacctggcctcccgccccctcctcacctggcctcccgcccccccctcacctggcctcccaccccgtcctcacctggcctcccgcacccccctcacctggcctcccgcccccccctcacctggcctcccgccccctcctcacctggcctcccgccccctcctctcctggcctcccgccccctcctctcctggcctcccgtcccctcctctcctggtctcccgccccccccacctggcctcccgccccccctcacctggcctccagccccccccacctagcctcccgctcccccccccacctggcctcccaccccctcctcacctggcctcctccccacttctcacctgggcgagttctcaggactcagggtctttgcacctgggagctgaccagcctccggccagaccccacccctgcacccctgctcactaacgaggtcgtgggtctgcgcgtgaccctgctaacgaggtcgtgggtctgcacgtaatagaggggtctccaccatgggcccctgcccgacggcctctttacagcctcccctgcttgttgcttgggtcccccgggagctaaccctacacagcctgtgactcacgcacacacacagtgggtgcccaatcactgatgagaaacgcgggatctcaggagcgtgaccctcctcagcctgagctccgggcagctgtggaagccagggccaggccacaccagctgctgtctggttccccgcagggcacagcaggcaggaagtttgcccggcagccggcccgctcccctaactaggtcgtgtgtctggttccggcactttggaaactgggcaagcttcaagcttcgtttcccccaaaggccctggaacgctccgacagaccttgtcactggccaccgggccccagaagtccaccctggaccctctgtcctccctgggtcccggcaatgcagcgtccacccccgagctgtgacaaggatgagcccaaggcaggggccgtgccctctgacccccgtgctccaactcccgcagggacagtcctgggcactcctgggcgccagcgcatggggcctgcagggaggatcaagcgggatgcccagcctggactttggggtgcaggaagatggaaccggggtccccaccttcttgggcctccctgagcagcccagagccctgtccctcccctgtgcctagagggtggcctgtgccaaagctcccagcagcctaggacacgcacggttccgactccaccgtctccctctcggccaggtagttgtggggcacatagccctgggccacggccccacccgcctcgtccagcagcgtggcccaccaccactgctcctccttcctggccacgtggaagacgtcccccgcgcggaagctcagctcctcgtccgtccgggacttgaagtcccagaggcccacatacttggggcccaggtgagcctggtcccgggacaccatggcgggcgggcgcagcggcaggaccaggctgtggcccagctggagcacccagagctgggcgtggcaggcgggccgtcccacttcctcatgacaggccgggaagcagccacacccagcacccacaggcgctccagagcaccccggctcctcctgagggcccagccggccccacaagtcctcaggcccactggggcccatctgagcacttagcgcccgcactatgggaacccactgggcaagcaccgccagggccggcctgagcgcaggagagggggaggaggacctcccggttggggcttcttgggggtccaacttatggacactcaggcactcagggaagccaacggccctctgggaacaagcctcgcagcctgagggcaggaaggtgagggctgcaggcgctgccttcccaaccctcagagctgcgggggcacaggtgggggccgcctctctccccgcttccggcagcttcccctccacccgtcggtgccctcacccagccccagactccacccctgagcacagggcccaatgtcaggagctgctgtgggcaggcgtcctgagagcggcctcatgggcaggcccgccctcgggtaagggccaagcagggaagagggagtggaatcagggcagcgacagctgtgtgggtcggcccggaggacttcccggaagaggagggcccgagggttttgggggatccccggggaggcagagccaggggcacccacggctgaagaaacgggcactgccttcctccacacggacgccagggggcaggcaaggaccgtgagtgcggcctggaagcgcccatggcgctggggcccaaggccacaggtccctcccaggcagcccctcccgcctccagcctctgcctcctcctgtccagcccgcaggacccctgcccccttccagctggcctcccttctcccgactcatgcctgagtgagccctgccgtgacccccacctgcacccgacggccgcctgccccccagcccctgagactcgggacaccccctccctggaggcccctccccgccccaccctcccactgaccctactgtgtccacccgggagctccaacccagggacctggactggcagccacaagggggcaggaaggggcgggaagggaaattcaaagtctgcaaggggtggtaaggaaagtccctaaactgcgtatttcaacttttatttttattgcaaagagaaataatggcaccttccactcattgttttgagattaagaacaataatctggattatttaacaggctcatagatttctgggcagcccagctcagcgctgaccaaggtggggaggggcagcggggtgccggcctgggcagtgtccctcaggccctcccagctctgtctggggtcggttggggaggatgcagggggaggggtggggggtggggaatgcggaaggagggtgccggggcacctggccgggcagcgtccctcagagcccggccagactctgggcccgtgagtctatgtccaggaagcctcgagtatccctgagttcggacgtgcaggactttcagtctaagccacaccaggaggcaggaacgtccccagcccctcccagatacccaggagcaccaaacctgttcagctggtggctggcgagatgcctaggagggcacaggtgccacagacacacctggtccccttaatcccagtggcggctgcagagagcacagagggcgaggccttctgtgccagaggagcccccaggctgctgtgctggggacctgccagaactggaagctcagctcaaggcctcagtgggcccaggtaccagaaccagcccctcccctaggttctcccatgcagatggagctgggcaggtggccagggtcccaaaggctcagataaagcctcttgcctccaccatctgcaggggtcctggttcctgctgcttccctccgcttggccttgttcctccgatgcacgggccccaggaagcccccgcgctgcctccgttctcggagcctccgagtggcctcttccttccccggggccacctgtctctgcacacgggagtctcatctcttagctccctcctgagccaggctttggccggggcctgtggacggcagccatcagcacttcggctcagcaggtacagagctgaccccaactctaggggacaaggactcagtcaggcctgaacttgtctccaaactttctgtccccgaaagccttctgggcacagctgccaacctgggctcccaggagggtggggggcagggtctccgggggccacaaacagaccccaccggcccccttgcttcttgacgtgtttcacgaagacctgagcagaagcttccctgagccagacgtggggagacgagggcggaccctgcacatccctgccccctcctgccttggtgacccccgaggactcacacccagaggcttcctgagccacttgctgcccagcataccatggcatctacctccgagcccccaaccgaccctgcctgaccctgcacaggcagaagactccaaatcccccacggcccaccctgaggcccctggaaatagcctccaagggcagctcccaggtcaccaagcctcccggcccacccttcctgtgccacctggaacccacccagggagatggaatcggcagctcctgccaatgcccttggggctcacgctctctgggcaccatgatgtcctgggctgggggtccgggcggcatgggggccgctccaacctgcattttctagccacgtggacccgtacgctccagctcctgggtctgggtttggggggctgagcctgtgtgtgatgtgcgcctgtgtgcgtgtctgagtgggtcagtcccggcttactgagtgctgtgtgcgtgagtgggtttgtgcacaggccgccagtgtgtctgtgaggggcaggtgacggtgccaccccgtgcctacataccacacatccagtggggtcaacaccacggtctgcctgggagtcagcactggtcatttccacaaacccaagctgggactagggagagaactgggcctttggctcttcaccctgggagggagtccaggggacccaggcaggagacacacagggctcagggttcctcacccagagcctccgaggcttctacccaccctcctgtgccgttgtctctcttgagaggccagggacacgtgtcacactgcacggggaacgtcagccccagccctccgtctgcacgagtcacactgcacggggaacgtcagccccagcccttcgtctgcacgagtcacactgcatgggggacgtcagccccagccctccgtctgcacgagtcacactgcacgggggacgtcagccccagccctccgtctgcacgtctgcctggtgcacgaacatgtgtgcacgccagggcctgaggcccacagccagaggctcctcggtccggcagaccggcatcccttcgagttggcgctctgcagggaggaggggctggcctggctggagcccagagcgttgggtcacgtgaggactcaggggtggcatctgtggatggcgtgcagcttctcccgcagcgtggcgaaggagggccgttcctcggggctgctcctccagcactccagcatgagcacgtagacctccgccgggcaggcagccgggcgcggcagccggtaccctcgcatgatctgctgcagcgtctcgtggttggtcatccctgggaggcgcggggcaagagctgcctcgattctgcctgggggtccctatggaggaggcctcctgtagccccccatgtcatctgcctgcccttggccagaccctccaaccccttgccgacagcgtccaggcccggggccagtgactcctgggcagagcctgcatcctccctctggctgcctggggacccaccttcatagggacactggccataggtgaaaacctcgtgcagcaggacgccgaaggaccagacgtctgacttctgggagaagacacgataattggccgcctcaggcgctgtccacttgaccgggatcttggagctgctgctcggggagtagatgtcgtcctgggggcgagggaaggcccctggtagggcaggtggaccggggtcccctcacccaccccctctgggtcaggggcccagagcctccgctgaccttgagcagccgggccaggccgaagtcagccaccttgcaggccaggccgtcgtccacgagcacgttccgggcggccaagtcccggtgcacaacgcgctgctcctccaggtagctcatgccctcagccacctggcaggcaaagcccaggagtggcggcagacgcagggcccggccctcgggggctgcaggagacagcgcggggtcttttagggcacggggccaacggccggtgaggccagcgtccacccacgtcaccttcccccatgcctcagcctcctcatctctaagacgtggcgaggatggcatggccggctaaggccacgggaagccccaagtgagacagggcgagggtcctgtactcaccacagtgacccggcagccggcccaggcccccgacaaagaccagggcagagaagagccagaggctgggctgggtctatgtcacattagaccaaggctggtgacccagatgggaccgcgccccccaccgcccccgaacaccagctccagccccggagccacaaggctctggcctggcccagacctgacgccagccccctgttggctggagaccagacagggatgggatctgcagccggggccacctgctcccggtagagaggcccggttcacctcggaaaccccgcaggttcagctctgcgccaggagggaaggggcggtcgcaggcgcgtcagggccacgtggcagcagggaggggactcactgcccaggaaggcctgcaggttccccttgcgcatgagttccgtgacgatgtacacaggctccccgcccgagcacactgcgtgcagccggatgagccgctcgtgccgcaggcccttcagtgtctggatctccttggcgaggtcagtgagcttcatgttggctgcgagagagggtgtggctccaggaccggcccacgccacgaacatcactgccctggggcttgagggttggacagcaggtgcggggcccggccgtggcgcaggatctcggggcctcacctgacttgatgaccttgatcgccacgggcagggagcccagccacaggccttcccacacctccccaaagtagccttcacccagcttcctcccaagggcgaattcggagtgtggccgctcccacacgtcctgcctcggggccttctgcagggagggtgggcagggaggctggtcagcgtgggcccctgtgctctgtcccaggcacagccccccacaccaggcctctggcgggcacccctgtccccagcacacactcaccccaccctggctgggacaaaggggagtgggtgccaggcttggaggcccggcccagccccgtgggagctcattgctctgggggcctaagtggcacctttgccccagccggatatccgtctacacatgctcattactgcccctggccgcgctgtcattatgagaccagagaaaccagactgctgccctggccctcggcagggtggctcacatcggggacagtccccgggatccagtgtctccagcccaggtgcagcatcttgtgatctgcctctcctcccacaccttccgcccttggggcctggggcagccttgagtgccttccccaaactggccccaccctcctggctgctcccctgcagagctgggcactgctacaggtctcctttccccactcccagccccctaggaccccaggaatcccaacaaccctcagaggcacccgcagagagcagaatgtgctggaaccgctgggatgctccgatgctcccaggcctgggcagggccctggagctgcgcctctgacagccccaggggttttgtgacggggtggggaggagcacctagaacagggccatgcctcgggcccagcatggggcagcttggcaggcacaggcccacctggggcatgcagggctgcagcagggggttctggatcagcttccagttggccttgtagtaggtgagcagctcctccaggccgggaaagagccgtcccttctgcaggtagaggctgccatcagctgccatggagacccggtagtggcagaccttggcctgggcccggactaggaagggttcagagatggagacccctgccttggctgccagctgccccgaccctcccaccccagaggatgctggccacaacccactaaggggtctggctcagacctagctggggaccctgagatggtcagagctgtgtggaggagggagtgtgggcagccacaggctggggcggggcagcgagagcggcccaggttggagcttttctgctgacggtgtgcacagagtaggcacttaataaatacttgtagaatgaatgagtccatgagtcagtgaatgaatgaaggaataaggaaggaaagaaggaaaagtgaatgaatgaatgaacgaataagcaaatgagtgaaagaataagctagtgaacaaatcagtgaataaatgagtgaattagtgagtgacgaatgaacgagtgaatgagtggatgaatggatgaatgaatgagtgaattagtgagtgaggaatgaacgagtgaatgagatgaatggatgaatgaatgaatgagtgaattagtgaggaatgaatgaacaagtgaatgagtgactgaatgaatgagtgggtgaatgactgaatgaatgaataaatgggtgagttagcaagtgcaggaggtgaccagcatatctgctgttgggccctcagtggcgccgggtgtgaatcaggagccagcactgcctagagaccaaccaccccaaggtcaagggccactgacctggtgggggacagaggcaggaggggccgccccaggtacctgacagtgagtagcccccgaggctgctctcgctgggccggatgaggaaggcccctggttcgttgggtggggagaggagcagctgctgtgcctgggtccgactgaccccgctaaagtaccagctgcaaacagcaggtgcggcagtcaccttgcaggcccctcagccagtggccccacatgctctcctccgtgttgccggcagggctgagcccggctgtcccaccgcctcagggagaaggtccaccccgtggactttgagtcccagctcaaggtctgcactgcctcagcccccagtgccggcctcatcctcctgctcagccctgagcatcctcacgttggccgtgggctctccgttagccctgctgggcgtgacctccagttccctgttcatagtgaccgccagccccagccacaggttaacagtcagccctggccatgggccataggcctccaaactcggcttcgctgagcccctgcacagacatggagctgacggcctggtgagctgcccggaagcactgctgggctgtcgtggctgtacagggccatgggcatcacctggctgggcacggcccacctgcctcaggcagttggttagtggagggggcccatgcaagctgtgtcctgaggaggcagcctaagccaggctgtgcaggaggtcaggaggggcagccagtgggcggctgcaggggggttgctgtgcgaacgttcaaagcatcctgcatcccatgctggagagttgtgcccagtacaggacggccctaagcccactggcgtctgttcgcacagacaccccctcggaaaagccaggtgcaggtgagacctctctgaacacggtggcagggtggcagggagctcccaggtgcccactcctcagatgcccacacacgaggagcccacaccgggtgtcgggagaggggccggctgggtctcccctgtccaggtgggccgcccaccaggtcacatctactcattcctgggagccggaggcatccttggaaggaagacagaaatgctcccagccccaccccgtctgcataactctgctgctgaagtccaaggcggggactccacacctgactcagcttcccaccctggagcctcccacttcctggagcttcctgggacccggagagggatgcctgccactcccctgccccagggcacaccccgtaagcaccaggaggaagaagcagagtgagccggtgtcagggtggggctgaaaccacctgggaagcgggactaggagaggacccgaggtgggcctcagagtcaacacaagattcggggctggggcacggccatgccatcctggcagactgggactgggcaagacggaggacacagtctggcacccctgccccggtgacctagggggcaatgggggcagcaggaatagaaactgacatgaccagggccgtggggctgggcttaagttgaagggaatgaagatggagacaggaagaggtgtgggaccagggacagagaggcagcggcctgaggcactgactccatggacgctctgtccatggagctcctcctgcagccagggcccctgccttctggggtctgctggcagggagacgcaaccctctcacgtgtaaagggactcaggtccctcccagcaccgtggggtgtggggatgagacacaggtgtttccccaaaacatcgccagcctcctctgaagcccacatcagggcttgggggtcagaggtgagcccctgtgggatcctgagatgcagaggatgtgtctgaggtctctccctggggcgtggggccaggtgtctggagctaatgacacctgagtgtggttagtcttttaatctccagcctaggcaaatagtcattagctttgcctatggaccgccctgctccaccacgagccctgccctccaggaactgctgaaggggtctgtcctccacacctggggtgactgtgagccccttcccatcacaaaggctgcttgccccccaaccactgctcaggacaagcggggcaggtgtggggtgagggcctggggcccctcagaaggccccttcctgtgactccggcttcacccgcccatgcaacccccaggacgatgtgtgagtgccaaagggcccccaggaggctggaagtggccctgagcaaggctgaccccgaaggtctccagggctcaggccttgcccagctggatgccagaccaaggcagccgctcagagcagccgcactgggcatctggactaggcgcctctgcaacccctgctcacctgccctcacccagagctcctggagcgtgggcccctgtctcagcccccagtcccagcccctgctcacctgccttcacccagagctcctggagcgtgggcccgtctcagcccccagcccctgctcacctgccctcacccagagttcctggagcatgggcccctgtctcagcccccagcccccagcccctgctcacctgccgtcacccagagctcctggagctcctgtcatctggtgcctcccagcccccagcccctgccctccaagcagtgaccgatccatgaacactggactccctgtgtgagggcgggagggcctggccagccaggcagggtcctggaggaaccgcctgctgggtgtccagctggtgcagctgatgctcccccccacaggacctgaccacgcctgccggagcctcctctccctctcggcagcccacagcggacactgctgttttcctaccacacctgccggcccggggcccatcagctgtccctgaatgaatgcgtggatgaacgaatgaatgaacagatagccacggacatgcgatttccaactcaaaatcctgccgttgttctggactccccagctgggggcgaggcaggctctgactccgaggccgaggtactcacggttggtctgagagcgtctcaggagaagccttggccacgtgggtgatgggcacgagcccggcgctgggctggcccgaaagcctgcgtgcgaagatgtagccgcccccctcttcgagggcacagagcctgtccccgcggcggacactcagctccccgccacaccgcgccgtgaagtcatagagcgcaaggaagagctgagggaaggggctgcaaggctcggcggggagcgtgggcactgggtcagtgttggggtccagggacccgggggtgccatggtccggctcgccgcccgccggccagatcttgtcccagaagaaggacaggaaggccagccgcctcctgaggaacggctccatcccccggggtcaccacgctgggcccgagggccatgggagcccgcgagcccggaagaggaactggcagggccggtgggacccggtgtccagcgctccctgccctggccgtggggtgacaggggaccccggccctgcggtcactcagaggtcccctggatccaggaggcacacggttcccaccggcgtccgggctggcgttggggctgggtggggcgcagggcggaccccctgcctcaggcacaccgacagcacctcctgtcctcgacctccttggcgtctggagtgcaccgtcccctccccaacccgacggcagagggcagcttgggctggggcgggggcgggctccaggaggggcccgaggagggcggggtgggcagggccagcctctctcccgccctctgcaaggcccaggcaggcggaatggctctgcccagtcaggcctggcccatgcccaagggcaccacagtccaacagccgcccgtgcccacggagaagtgggggttccacggagaagcgctgctgttcagcacctgcagtggttgccaagcctgagctgcactcaggtgaaaaattgcctgcttatttaagtgttggccagatattttaacatcattaaccctgcaccaggtgccgagcctccggcctctgcagtaaattctgaggacaggcgagtgagggggctctcagcaccccggctttcatgcagtaaaacgagatgctgattgcagggagctcggccgcaggccaggcacccagatgccccatgctgcccgatgaccggcttctgagtcagtcaatgcccaggccatacccaaaggccactgcggggaagtggaggctgcggacgcctggccccagttcagggggatgagcacacggagaaggggcggcgggtgagtccctggctggggacctcccaccctctccctggacagcgccaagcccccgcatgctgaagcaaactctgcccgctcaggtaggtccccagatcggggcaggactgggggagcaaatcccagcaaaacccagcagcacggtacagggtcctgaggcaggaggatggggtggtggccatctgcagtctctctctcctcccacatcccctccgggtcctgagtggggtggggtgggggccatctgcagtctctcactcctcccacctcccctctgggtcctgaggcacgggggtggggtgaggccatctgcagtctctcactcctcctgccggcctcccccagcagccccttccgcacctgggtggccttcagggagcctcacgcccctttcccacatctcacacgcatccatgcccccacttcatgcgtgtggctgaatgcatccctccaataggcgtgaccagtgtccagccaatgacaagcccctcgcacctgcctgccctggagtcacagatgggcttctcagaaacctcacgtctggggactggtgtgtgcattgtggggtggcagtgacacccgtggcctggctctcagggcaccccagcagccaagctgtgtccgggctgatagcctggagccagcaggggccctgggagactggacatcgccaggctcagggcaggctctgcaccagagaggtgccctgctgggggtggtggggggtgttgagaaatgtggagaattgtaaatactacattgggggtggccttcgaggggccccagcgccttctcctcccgcgcttccccccgccgccctctcctcccgcccccgccgccctctcctccccccacccgctgcccgtctcctcccgcccccgacgccgtctcctccccacaacccacccccgccgtctcctcccctccactccccccgccgccgtctcctccccacacccaccgccgtctcctcacgtgcaggtgaggcttttgcccaccatttcttttctttactttttttttggaaacagggtctcactctgtcgcccaggctggagtgcagtggcagcctcgatctcctgggctcaagccgtcctcctgccggactacaggtgtgcgccaccatgcccagataaattttttattatttgtagagatgggctctcactatgttgcccaggccggttttgaactcttggcctcaagcgatcctcctgcctcccaaagtgctgggactacaggtgtggctaccagctctcccaaatcctccctaggacgtgactcttccccgctagaacgccaaggccgcagagccccagggaggcctcctcaggccatggaaagctcctgtgcccaccacaccagggtcagatgttcagggcactgaatgcagattcctcccagacactccctgccccttagagccacgggatcatggcacaggactcagcacattccatgcccagctggaaccagaggcaggcctggccatcagggttagggccccattgggcctctgccccggcgtgtctcacccccaccgccccacctgcccacagatcagctccccacgtctgccccatcttccccctccttgcacctgctgcccttgcaccgcacacatgccagggtgagtgtggtcggcaggcagccgaggccggctttatccagctcctccccggtggtcctcagaatccccggccccgcatgcccagctgccctgtcccgctgccctccaagttgtgcccgcccgtccaccccttcctcacctcacccaccaggcgcaacacagcccagcatagggcccctgccaggtgtcggtgtcagcagccccttccctgcctgctgtgccccccccacatgacctcacctcctccctcagccctaaccgggtgggtggcacagaggggagtgaggaaaggggcctgggtacaggatcagtctggacggggtcaggagtctggggcttggccgggtgaggcggctcactcctgtaataccagcatctggggaggccaagcaggaggatcgcttaagcccaagggttcaagaccagcctgggcaacatagtgagacccccatctctatttttttaaaaaaagaaaaggctaggcacggtggctgacaccagtaatcccagcactttgggaggccaaggcgggtgcatcacctgaggtcaggagttcaagaccagcctgggcaacatggtgaaaccccgtctccactaaaatacaaaagttagtcaggcatgatggcgggcacctgtaatcccagctactcgggaggctgagacgggagaatcacttgaatctgggagacagtggttgcagtgagctgagatcgtcgcgccaccgtactccagcctgggcggctgagcaagactccatctcaaaaaaataaaaatgaccagggctggaatcctgctgtcagactcactgtccacatgaccttgggcatacagtgctgaacctccctgtgcctcagtttccccatctgtaagagcactgagcttacaatggcagtgaggacacagaccagggggatggggtgcagggcccttcctggtgttcagatggaggcttgtggcaggagctctgccacatcaggccaccccccatccgggtttatgtgtctggagggcacagctctgagggtctcagtggtcagcgtgcattctctcccccaagactggccccactacccccaggcttcaccatcctcagggcccagggaagagagcttgtccccaccagggacaacagatccaaagtgttcactgcccgtgccctggtggccacaaacagggttgagcaagactgagcacaaactggcccctggtgcccagcagtgaacaggagtgactgttgaccctgcacagaggggactatgctgagcgcaagaagccagtcccaaggctgcatactgaaagcctgcactgataggacattcttgaaatgaccagacagagccggagagatgagtggttgcagggctagggagaggtgggagggagcagcgtggctgtaaagaacatgtcagggtcccgtgggggtggcactgccttgcgtctgtatcgacgtcaaggtcctggcgtgattctgcactgcagtcctgcaagatgctaccactggggatgctggatagagggtaacgggacctctgtgttacttcttacaactgcagatgaatctatacttatcttaaaagtaaaagtttaactttattattattattattattttcgagacaggcctctgtcttattgcacccaggctggagtgcagtggcacaatctcggctcactgcaacctccacctcctgggttcaagcgattctcctgcctcagcctcctgagtagctgggactacaggcgcccaccaccacgtccagctaattttttttttttttttgagacagagtctcgctctgtcgcccaggctggagtgcagtggcgtgatctcggctcactgcaagctccaccttccaggttcacgccattctcctgcctcagtctcccgagtagctgggactacaggcgcctgccaccactcccagctagtgttttgtatttttagtagagacggggtttcaccatggtctcgatcacgtccagctaatttttgtattgttagtagagactgggtcttactatgttggccaggctggtcttgaactcctgacctcaggtgatctgcttgcctcagcctcccgaagtgctgggattataggcgtgagccactgcgcccagccattattattctttttagagacacagggtctccctctgtcacccaggctggagtgcagtggcaccatcttggctcactgcagcctcatcctcccaggctcaggtgatcctccggcctcagctttccaagtagctgagaccacaggtgcacaccaccacacccagctaatttttcaaattatttgtagagacaggggtctccctgtgttgccgaggctggtctcaaacttctggcctcaagggatcctctcaccttggcctctcaaagtgctgaggttatgggcctgcgccaccgagcctggccaaaagtttaactttaaaaaattagattagaaatcagaaattgaaagaaagggggtagggtggagcccaggagaggggagacatccaggacctgcctggccccaaaagagaaggggaggctgctctgcccccaccccgcttctccgtcagtgggctgcagggccgggggtaaggggtctaactcctactgcttcccaaccctccgcgtcagacagcacccccttctccaaacaaccccggctttgtcccctggagccctaaataacaataacaatagctggcatttattgagttccagcccaggcagggagggcagggcagaaacagcacccaacaggactgggtgcaaggctcacacctgtaatccggaaggatcagaaagacccaggtgggaggatcacttgagccccgggggtgaagactgccgcatgggtgacagagcaagacgctatctcaaaaaaaaaaccacccacatccacccacttcctgccaggcctaacccctggggcctccatgcaccaagggaaagctcttccagggtggggtcaccgggaggaggggggaggctcaagttacagaacagcctggtaggggctcaaagacgcccatcctggaagaggccccagcactgacctccgtgggggtggagatgaggaggatggaaagggtgtcttcctccagcatcttcctgaaggtgaaggaggggcaccttggggtgtctaagattgtgaccccaggagacccccagctagctggggtgtgctgtgggggaacggggggatcccagaggccctgagcccaactgaacagatacagacgggaccagatggcctcagagctcccctgcggggctccctggagctatggagaccccatttatccagagtcaggtcggtgcctgagcttgggcagccccaggtggaaggagcccatggtgggaggagcctgtagtgggaggagcctgtagtgggaggagcctatgatgggaggggccgtggtggggggagcccgcggtgggaggagcctgcgctgggaggagcctgtggtgggaagaccctgtggtgggaggggccgtagtaggggagcccgcggtgggaggagcctgctctgggaggagcctgtggtgggaggggccgtggtggggggagcccgcggtgggaggagcctatgatgggaggggccgttgcgggggaggggggagcccatggtgggaggagcctgtggttgaggagcctgcggtggggggagcctgcggtgggaggagcctgtaatgggtggcatctgtaatgggcggggccttgctgggcagagcccgcggcgggggaagccgcccctctcctctgtccaggcgctgggtggtccatccgcctggtcaccggccactgcctctctcccaaattcctccgagggattcccgaggagtgcgctcggactggggggttgagcaggaactccctcccagtcacccgaggctcctgcgccccgcccgaagccgggggtgcgtggggagtggtgcgcccgcggaagggctccgggacgggaaccccccttggagcctggctcttggaccagccacccgccgtggcccctcagtcggggacgcgggcccccagaagtctggggctctccaggaagcgaagcggatggaagattactcggctcggggtcccgggtccccacccccgccccgcccccgggccgcagcgtcacaaaggccgctggtccccagggcaacccgcggagtgcggagggaggctgggctctgggaagtccgcgcgcggctccgcttcagaggcagggcaagtgggcgcggtcctggggcggcggcgggggccgggagaggagggctgggggtctcgagaaggtaaggggcaggcagagcggccggggaggtgggcccgggccaggggagccaaggggagtgtggtggagggggtagagtgcgggcacctggtggtctcagggaagcgggcctgggaccggggcgtgtaggaagcagcgaggggctcagaaccacctttccgggttcacgaccagcctctctgggtgttccacctgggcagctgctggagactagaaaacatccctcacacgtcacagaggcacggtttccctccagcggtgaaatccgccccagcctccagcaagagcagggcttaggcctggggtcctggggtcctgctctcagctggcacctcaccccagacacactccctgctgcccccaggggcctgttctcgagggattcccgaggagtgcgctcgtgaagtcatatctgcctcacgcccaaaagggcaacccttcccgggcagatatgacttcaccacgtacctgtgtggccctggggaactcagcaactgcttagctctcatttgtgggtcgtccaaggcccaagtggctgtgacaacctgagatctccagggttgctgggagccggggcagcaaccaggggtgcggcttgctctccagggagctgcggcagagcctggggccacagctgcactcagccggtgcacccacggacagagggtcagactcggctcagcactgggctcaagccctggatgagaacaagaaccaagcttcttagcctcaggctccatctgggaaatggagtgtcacttgtggagtccatgagctcaccagggacaggatcccgggtccacagcgagggcccacagcgtgggaggagggctgctcctccgggcccaggcctgggcgccctcctcccatgctgaccagccagctggcctcgtctttggtgaggcctgtctctgtgccctacaactgcggtgaggcgtggagcgtccccagggagaaccggagcgggaggatggcccgcgaatgtccccgagggggatcctgtgctgcttaggaccacgccgtcccctctccacggccccgaggggtgccagcaacccctttcagcagcagggttaggaactggggcccttgcaaggccacaggtcaggcggttctggccagaagtccgcagtcctagttcttccctgtcctgtcccacaggccactggttgtcagtagaggtttttgcccctcagtataaactgtgtccagatctgtaggctgcccatccagccctccaggcagcctcttcccatcgagttgtgcccccgaagaaggacagaggtccagcatggggtcagtgggctgaatccatcccccgaacatgccacagcccaggggaggccagcctgcctggcagctgacacccagccctccccccagctcccggataatgagcacccatgtggcaggcctgggcctggacaagatgaagctgggcaatccccagtccttcctggaccaggaggaggcagatgaccagcagctgctggaaccagaggcgtggaagacctacaccgagcgccgcaatgccctgcgtgagttcctgacctcggacctgagtccgcacctgctcaagcgccaccacgcccgcatgcagctgctgcgtaagtgctcctactacatcgaggtcctgcccaagcacctggccctgggcgaccagaacccgctggtgctgcctagcgccttgttccagctcatcgacccctggaagttccagcgcatgaagaaggtgggcacagctcagaccaagatccagctcctgctgctcggggacctgttggaacagctcgaccatggccgtgctgagctggatgccctgctccggtcgccagacccacggcccttcctggccgactgggcgctggtggagcggcggctggcggacgtgtcggccgtcatggacagcttcctgaccatgatggtgccggggcggctacacgtcaagcaccgcctggtgtctgatgtcagtgccaccaagatcccgcacatctggctcatgctgagcaccaagatgcctgtcgtgtttgaccgaaaggcgtcggcggctcaccaggactgggcccggctgcgctggttcgtcaccatccagccagccacatcggagcagtatgagttgcgcttcaggctgctggacccgcggacacagcaggagtgcgcccagtgtggcgtcatccccgtggctgcctgcaccttcgacgtccgaaacctgctgcccaaccgatcctataagttcaccatcaagagggccgagacctccacgctggtgtacgagccctggagggacagcctcaccctgcacaccaagccggagcccctggaggggcccgccctcagccactctgtctgagagatgattttctaatatttatccactaataaagaagagtgtaaatgcacatatggaattaaagaagcaaacctatttatgttttaaaggcagcagccaccagtgtttttcctggctcaaaacatgccaagccccaggccttctgctcctgctctttcccagggggagccacaggccggacctcccaagacagctgagcctggagcaagaagtaccagcccctgacacctacgggtccaacgacgacgacaaaagctgctccacggggcctctgcggtcctagcccccgcccctcctcaccacccccatcaccgtgaccgggctccggccttccttacccacctccctggcttgtggggctccctcagggaatgacactcctaggccgtgatgcctcccaccatcccctgcccagcctcgagtgctcatcagcacgcccgcccgaggaggcagcagcaccaccggggatccctggctgtgagcagctcagccgtgcccctccatgccccgccccaccttttgttcctcaagggccttcccggccctgagctccctctctcctccaggatcagctgcttttgctaggcgtccagcccctgcgtccccccaccgctcaccttcagggccgcagctgccccttcctcccagaagccttccctggctgcaggctggtgaggtccccaagtcccccttcctagaggcgccttctcatcctctctgcaggcacttctcaagctattgcagaactactcttatttcatgacggtccaagaatagacatggtcttcaaggcagggcccgtccagcacaccaacggggccacagtcctggagactccatgctccacccctccctccacagatgcccagaacctcttttcccacagtgaccatagcccccgcgaccatctgacccccgagctggctctgggaggccacaggagcccctgtggacgcagccacaaatgggccaggtgcggagggaccccagtccacagcggccagggggtcctggggagcagctttaaaagtgggaccagcaggacagtcaaggctggtggcctcagggactttggacttggccagcctggtgacaccggagcagctctggagctgtggcttgtccccaccacaccaggcacggccctcccctccccacacaggcagccggagacaccggccctgcagggggggtcgctgccctccccacgctcctgcgcccagcgctctgcagtgggccctcgacggcctccacggccgcgtcccaaaaccgccctccccacgcccctgcgcccagcgctctgcagtgggccctcgacggcctccacggccgcgtcccaaaaccgccctccccacgcccctgcgcccagcgctctgcagtaggccctcgacagcctccacaactgcgtaccaagcacagtgaccatccacttttgccccccagccagacctcaaacacccagaagtgagaagagctttcagagtggttttatcattaaattaatatctaatcacataattcaaagatataaaaattggaatgtagaaggtggggcaagcccctccctcaggactggaggcggcagcagggacagagccgcactgaagcgggtgagcgtgcgagaaacatacagccgagcaggctgccccgaacactcagtccagggtggaagcatcgccccggcaccccccaacccccgagcccactgcgcagcccacaggaagagtgcaggcttttcacatttcagagggtggggtggggtggggtggggcggggtgggcccctggctttgggctgccctccagcagcccctgaaggacacaggcggtgatggtgggagaaaggccccctctcccagggaggcctccttgtcctgagcttgggctgaggtctctgttccagtaacagatgctggttttgttttgtttttttttttaagacagggtctcgctctgtcacccaggctggagtgcagtggtaccatcagagctcactgcagcctgcgcctcctggagtcaagcgattctcctgcctcagcctcccaagtagctgggattacaggcgcccgccaccacgcccagctaattttgtatttttagtggagacggggtttcaccatgttggccaggatggtctcgaactcctgacctcaggtgatctgcccgcctcggcttcccaaagtgctggattatgggcgtgagccaccacgcccggcaggatgctggcttttagttcatttaaatagaaaataaacctgaactccacagacaccatccagagtgattacaggtggcgtccaaaggtcaaagggcagcctccacagggtttccttcctggttctgagacttcccagggacagcagaacttccttgcactggtcccaaggaagcccctcttggccaccctgagaggtgttcctgtccccagatgcccaggaggagcaagagtgtggggaccggcccttgccgttcctcctccaagtccacccacttcctgccccagggagatcctgaggccaggaggcaggctggcccaggcaggctgatggcggagggtggtggggagggtgggggggccctggactttccctcccagtcctggcaccttgcaggtggagagggctcttcaggaaggcatagttggcctcctgcagacgcgcacctggccggcaggcacgagggtctgctgagcctcgcagaagtccaggaggctacgccagagggggcagcagcgcagaaggaggtggtctcctgtgagggtgggagtcagatgggagtcagtcagggtcaggtgggaggagtcagggtcaggtgggaggagtcagggtcaggtgggagtcagtcagggtcaggtgggaggagtcagggtcaggtgggaggagtcagggtcagatgggagtcagtcagagtcaggtgggaggagtcagggtcaggtgggaggagtcagggtcaggtgggaggagtcagggtcaggtgggaggagtcagggtcagatgggagtcagtcagagtcaggtgggaggagtcagggtcaggtgggaggagtcagggtcaggtcggagtcagggtcaggtgggaggagtcagggtcaggtgggagtcagtcagggtcaggtgggaggagtcagggtcaggtgggaggagtcagggtcagatgggagtcagtcagagtcaggtgggaggagtcagggtcaggtgggaggagtcagggtcaggtcggagtcagggtcaggcaggagtcggcagctccctagcccagccctggcctcacctgtgttcccaccctggaagagcccagccccgccctcaccgatcaggcagagcccctcctgggcccgcgtgacagccacattcacttggttggggtccacaacgaagcccagaaacttcttgagccagctcttggtgggccgctggtccaggtcgctcttggcacaggtgcggacggtgctcaccagcacatagcgccactcgctccctgcgggatgggaggtgaggccctgctgccgctgcgcccaccctcccggccccacccacgagcccccagcctcaccctggctcttggtgatggaggacacggccaccccggcgatgccctctcgccgaagggccttgctgatctcagaggcctgcgcgttgtagggcgtgaggacggcgatgtcctggggctctacggtcctccccagggtcagctgcttggtgatacggacctgaggagccgagggggcaggtggagcggaccctggtgtctctcctgccctcctccaggaagccctccctgactcacaagcaccagacactcaccacctcagccacctcctccagaaagccctccctgactcacaggcaccagacactcaccacctcagccacctcctccaggttggccttggagttctcattcccttcgtccgtggacaccagcaggctccgctcgtggccctgcacgtggccaaagatgacagggcagctctccttgccagcgtggcccaggacactgggcggcctcctcaggccctgccacgtcttcagcttgctcttgtagaacgccacagaggggaaggcacagatgccctcatgctgcaggcaaggatgtgcgctggtcagaggctgccacgcggggttgtggccccccaggggctgcaggtgggctgggggctgagtggggcgggctcaccatgcggtactgagtgtccagcatatgtgcgtcctcgtggtaccgctcgaacagagaccggtccagacccaggttttgcagccgctcattcttgaccacaggccgcagctgcttgtggtctccgagaagaaccacctggaggaataggcaggcctggccctgacacccctagacccagagggaccccagccccacacgacacccgcgtctgcacacacagggcaccccaggtgggagactgtgccagggacgcctgctcatgctgcccacaccccccgccgaccaaccttctcggcctgtgggaactgcaccagggggatgagggtttcaggttccgtggccatgcctgcctcgtcaacaaggatctgcctcacgtccaggattttgaggctggcagaggctgcacaggagcaggtgcagaggatgacctcatgccggtccagctcgaacttccgagcctcccacaagaccttcttgtacctgccggggacactgcttgtcaccccagggcccccatgctgcaggcagctccaccccctggcccctgccacttaccagaccaggtcctccctggagaagagctcccctctctgcagccgggtgtcaaaggccttgatttccgacgagtaagggttgggggcctgccggatccggtggtgcagggtgatgctcctgggggacaggacacagtgagccctgtccacgcagggccatcacgggggcagagctcagtgagacccacctacacaggactgtctggacagctcggccccactccgcccaagccccaaagacagcaggcacacctgaggctctggttcggcctcccctcccgggggctcttcctgagcagcttcctgctgcccacacgcggcactgggaactcgctggcctcagcctgctcactgtacacacggaggggcttcagctccatccttctcaggagcagtcctgagggtagttgggggacgtgagtcctgccccgcgtgccagctccccaaaggcccccaccgccgaccccggcgcacctgccaggacatccaccgacttgttggaggggccgcagtacaagatgcagggaccccccagccgcttctccccacggggggggcctccgggctgcacctgctcctggtttgatttatgaaaccagaatacgatgtggaggcccacgatcgtcttccctgtacctgcagccagagaataggagattgtagcccaccctgtgggtccctgtggcccaaggcagcctgcggctcccccggcatgggccctacctggtgggccctgaatgaccgtgaaaggcttctccagagcctccctgaccgccacgttctggctggggttcagcttgtggcggcctccggggatgttgtaggtctgccgctccaggaacctgctggggatcactgagagggggcagcctccctgagcactcatgcagggtggggctgggggccagaggggaagctggaggggtggggcagacctacctctgcagaggggctgcgggacaggccggcccagtgcgatgctggtgaccagcggggacgcctcctctagtccacgcacggcttcctccttgcggctgggggtgaaggcagacactggaaaaccaacaggactcccaggaaaggggctgctgccccacgagctcccccctcctgcaagtgaggggcccggggcggtcccccagcccagcctctgctggtggaagccactcacagatcaggaagctgcttgggcagcagctcaacggtgaacagggtgcccggcctcagcacctcttccggaaccttctccatgcccatgtggtggacgaagaggtgcacccgtctgggagcctcctgccggtctgcccggcgctcctggtcccagtcctgcgtctgcccgtgggccacccaggtatacgtgccggggtcaacattcaggccagggccgaggctgctgggcccagggcgtgggctggccgtgggagccggcagcccctcgagccggatgcagaggtagcagcagctgaagttgatgtcggcacagttctcctcgaggaaggcggcctccaggcggaaggcgccctgcagctgcccctgcggcgtccgtgacgcctcccaggagacactcaggtgctgaagtgtgacggagtcattctcggcaaccgcgccggtggccgactccagggcgcagaatggttcccacacgcaggcgtactcatccacgtcgcggtaccggtccctcggggcccggtacacacggcctgagaagcagtctccgggccgctccacgtgctccaggcagaggctgaagcccggtgccaccgtccagagctgagggctcggtaccaggaagccgtgctgcaggctggtgccgagctgcacctgcagggtgtccccactgcccagctcccgggccacctccaggaaatggccacagtggctccgctgcacctgcaccagctcccgccgctgggacgcctcgcccttctcctggatgagagcagccgcctccggccagcgctgcagctccaccagctccagcagctgcttccacagggccgtctccacggccagggtgtgtgggtccggcacagtgccaggcagtggcaggggcgggctggatccctgcgctgagtagacacggcgccgccacaggagccgcaggcccggccggcctgccagggcgtgggggtgctcggccagctgcagggagccgtaggggacggggcaggggtcaggcagcgtctcccggttgctggggaagagcagccggaagcagcgggagcccgcctccacgtccaccacgaagcccagcttgtccagaggctgggccttgagctgcacggccaggtgcaggctgcgcgcccgccgctgatagctctgggcaagtgcgtgctggaggctgaaggcctggcagagcccatcgatgtccctggcagagtaggcagagcccccatggcccagcgccagcaggatctgccgctgcaacaccacgtccaggtacctgcggatgggcgaggtggcccacgtgtaccagtccacctgcagcgagtagtggccgccctgctgctggtggccccgggcgcagcggccgaacgccgagcgctccagggccttgcggaggtcgcggcctgcaggagccaggaatgggtgcatgtcgtccgtggtgaccaagtccaccatctgttcgtagtcctgggtgcgggcagcaaactggacctgcttccagagggaggccaggaggtgcagccgcgtgtcggggggactgcccccgccgccgtgcaggtggtggccgaggtgcagtgacaggggcacccggtccccatgcttctcacacagggccttgagctgctggctgcggggtgctggctgccaccgcagaggcgtgaccgtccgcgtgcactcgctgcccaccaggaactcagccacgagcctattaaactgaatcatgtactccttcaccatgatgtgggccgcgcggaagcccagggtgccgtcctcgtccggctgctcatagaagcagtcggaccgcaggcggtgccggcgcagcagccgagagaagtagcacgcggccacgacgcaggcgtccacggagtccaggcgggccggcagctcacggccggcacccgggtgctgcctgatcacctcctccgcctcctcgtaggacagctggcggtcagactggaccacggagggtgcaaagcgcaggctcttcagctggccactggccttctccatggtgaggaacagggagatggccaggcggtcccggccaggcaggaggctgaggacgtcctggcagaggctggccggcagcatgggcactggctccctgccgggggcatagaacgcagcgccctgccttcgcgcctccacgtccagcaccccgtccctgggcacgaagctggccacatcagtgatgtgcacagccacctcgcacctgggacccaggtctcggacactgagggcatcatcgaggttgcaggcgccctgggggtccacagtgaaggtcaagaaggcgcggcagtcctctcggcggccggcaacccggccaagctccgtgtggtatttctgcagcaccttggtgatggtggcctggtccgacgggggcaccctcaagctgtactccaggccgaggatgcggaggccctgctcccaggtgctggcctcaggcagcacctcccggacgatgcccagcgggtagtagaagccttgccgccacaggacaatttggacccagaagagccggctgtgccgggcctcggcggtgagcctctcaagccccacacgctgcagccggcccttccggaggctgtagatggggacctgcgatgggtccttcagctcggccacgaagatcttggtcacggagccattgatggggaccatgatgcgcgggtcccacgtgtccatgcggcacacaaacgccagctcgtgcctcttcctcttcagcacgcccagcacgcggccccgaagccgcccctcgggcgccttgtctcccgaaaggagctgcaccagcacctcatccccggcgaaggccatcccacagtccaggcggcccctgacctggatggggcccgaggaggcatcgtccagcgggatggctgacgcccgctcgaaggtctctggcacgaaagagcagtggcggtaccgctcgggctccgcgtgcagcagcttccgtagcgcagccgggggcaggttctcgtacagccgggcctgctgcagggactcgggcctggcgacagtgtccagcagcccgtcctccccgacggtcaccatcaccttctggctctcgtccagaagctcccgtaggatggcgtcgtcagcgttgagctccccgtcccacggccagaagtcagcctctgcatcctcagcctccgtggactccacgcccgctgcagcagccgctcctgccgcacaggccccgggcaccacgtcttccttcactgcgtctcctgctggtgctgccgcagcctccgtctgcgctgtggttgccgtgatgtcacgggatgctgggctcagagcctcatctcccggctctgccttcaccatggccgtcaccacagccgcctgctcctcggccaggtcccctactggctctggggcagcctcccagttccccgctgccccagcctgtgtgcctcggggaggccagcgccgtctctgcgccacaccctgctcgacctgctccatggacaggccctcggggcagacactgtgccgctccacgcactcacggatgaagctctcccagagcttgccgcaggccccgaaggagcagagggccacggcgtcccccactaccaccagctgggactgggcgcgggtcaggacggtgttgagcacgcgggcgtcggtgaagaactcaggggccagtgccccagggctgagcaggctctggcaggtgtgcacagtgctgagcaccacgacccggaactgccgccctgcagggggcacgcagtcaggtcaggctgggtgcgcaagacggtgggaccagccccacccctgccgatgccaggctgaggagtgggccgagccacccggggtatcctggggcagctggcagcacctggccccgctggtcacccacctggcaggatctcaaaactgccgacagacacctggcctaggtcccgcctcctcagctcctgcctcagtgcactgacctgaagacgcagcagggccggggatgagtgctggacgcagtgaggactcggccacccccgacaaggagagggcacccccaccaagctcggggatgagcgcaggacgcagtgaggactgggccacccccgacaaggagagggcacccccaccaagctcggggatgagcgcaggacgcagtgaggactgggccacccccgacaaggagacggcacccccaccaagctccagacacctcaggggccgagccccacctcagccctgggaggcaaatactgcagccccctcttacagatggggaaactgaggcgggggctcgtccatcagccggagagctccccctcccccagcaggggtgcggtcgggggctgtcccgggctggccgggctcacctgggcaccgtgggaaacgacacagatgcacctctgctcgcggccgccccagcagctgggccaggtgttgtaggcctcctgcaccttctcgacgacctgcgcaatctcagccagattcagccaggacgccatggacatgtcccggtctgggctgcccgccacgtggcagaacatgagcgggtagtgccgggggtggggcggaaccttgcccctggcgtggatggggttgcccttggccacgtagaagtgccgcgagatgaagctgacaatggcgtccgtgcagcggtagttctcgtggaagaccaggcggctctgccgcgccacctcgtgagtctcctgctggtagcacaggaagaggcggtgcagcagcgtgtgctcggccgcccgggccctggccacactgaacagccggggtgtgacctgcatgtggtcgcccgccagcacgaggcgggtgccgtgcgaggcataggccagcggggtgagggcctcgcactccagcatctgggccgcctcatcgatgagaatgtgggagaagaagccgaccggcaccctgagctcacgggcctgggaggtggtggtgaccaccacgcggtgccgcgccagctctgcccgtgtgggcgggcggaaagcctggcggtcgtcggtcaggcaacagtactgcagcgtgactgggtccgtctggctcagcggccggtccgtgtacatcacacggagaggagtggcctcggggtggccgccgctgacgtggctgtggaaatactcccggatgtagatgtcggcggcactgcgggagggggaggagctcatgggcttcttgctgggggcctcagtgctgtccgctaaagcacctactgtgtgcccagccgagctgcccctgagcacagcccttgtctggctgtcagaggtgagcagcaaacactggtgtccctcctgtcaggagtccaaggggcaagaggccacggagggcttcaggcaacacctgggcgagcccagcggctcctctgacactgcagacacctgcacctccctggtccccagaacccccaatccagaaatcagcccgggacgtatggccactgtcccaggctcttcctcccactccccactgggcagggatgggaaggccccggcctggggaggtggtggtggcaggaaccagaggaaaccacataaaccaaaggggaaccttgtggttaggacaaagatctgtgtttctataaaaacgaaaaacaagactcatccccagaagtcctgggtgggccatgctgcagccttccccgtgacactctccttgggccagggccccggcagaggcacccagctcctcacctgacagcagacccggccaccctcggtgccctgagctgggcctgataaagccaaagcccaaagctggtcggctacagggagtgcagaatcagaggactggagcacatccagggggtgaccgcctgcccggtgtagacttgggccgggcgtcaggtgaggtgggggcaggccaggctcgggcttacctgttggtgtgtgtgcagatgagcaccttggtttcaggcctccggatgacctccagggaggccatggccagcgtgtaggtcttgccggtgccaaaggggccatagatgagtagcggggggacacgcctcccatccccagggccccagcccgcgatgagcgccacggccagctcctgcttgcggttgccacgccgcaagggtgggacagaccaaggtctgggcagggcgcaggtgggcaagtcgggcaccaccagctgctcctcaggcagtgtgtccactgcctggtgccagaggcggaaggtcatcgggtcaatctggaactgcacctccaggaccaggcgggcctcaggctgcagccccagggccaagcagcagcgggccggaagcagcagccacagcgcctgctctgagctggcccgcctctccagccgcacctcgaacaccgtattgtcgggtgcaggtacaggggccaccagggctgtgctgaccgcccggcccagcaggaagccctggtctgtgtctggcatcagggaggaggggacggggacctctgcgtacagtgctcccggaggcgcgaagagcatgttcagcgctggcgtctgcaatgccgtcttcaggaacacctggccccgcagggtcagcctggcaggatggcctgggtcagctcatggggccacagctgccagccccgctgccaagtccacgcccccatccgctcccgttgccccagccgctcccattgccccagctgctcctgctaccccagctgctcctgttgcccccagctcacttggccaccagctgctgctgagccgcctcctcctcatagagaaactggtgcatcctctgccgatagttggttggtgagatggggcccgaggccacgctgctgcggttgaactccagggccagggcagggcccttgtacttggccatcagggccgtctgctcggccgtccgctccacgccaggcaccacgtggcggttgccagtgtgccagcgctccatctcctcagggtggccgagcgccagattcctgcagggtcctgggcgacgcccctggcccagctgcagccccagcttttgtagcagcaccggccggcggccaaagtcgaagaccacccattgctcaaaggtgccgaacgaggcagcctgcacacgcactcccacctggaagtcggcagtggagctgggcacacggaagcgctcaccccgtgcgtagagccggcctggcgggaggccgggagccaccagagagaagtcggctcctggctcctgcttcagcagggccacgtgtagcaggggctcctggagaggaggccagacggtgaggggggcccagggctccccccaaccctcccgagaggcagcctggccagcgtagcccaagtgcagggttcaggtcctggccctgccacttcctggatagaacgcaagcaggccacccggcctctgccatcctcagtttcttcctgtgctacatgggggtggctgaaccctcctggggcccctgtggatgtcccgtggggcagtgtgggcagcttgaggcctcaccacccactctccaggtgccagaccctggtgaatccttgtttttgttttggtttttgagacggagtttcactcttgtcgccaggctggagtgcaatggcgcgatctcaactcactacaacctccgcctcctgggttcaagtgattttcctgcctcagcctcccgagtagatgggatcacaggcacccaccaccatgcctggctaatttttttttttttttttttttttcagtagagacggagtttcaccctattggccaggctgatctcgaactcccgacctcaggtgatccacctgcctcggtctcccaaagtgctgggattacaggcgtgaaccaccgcacctggccaaatccttgttttaacccatatactccatagaataaccctgccaaggtgggactgtcctggccccctgtctctaggtgaggagactgaggcagagaggctaagggacctgctgcaggtcacgcaggtgctgagcggcagtgcctcggtattagctccatgacccaggctgttgacgtctgcccgggctgaagtcaccacttccccagggctccctccgcccagtcggagctgttctccgctcacctcagagtggacggcaaacgtccagctgtactgggtcttcctctcctgggcctggtacatcaggggctggttgcaggtgacacgcactccatcaagggtctctgccagctgcgtggaagtctagccttcagcaagaggcctggaccccaccccaccccacccactcccagggcccacttaccacaaggacctcactgctgctgcgctggtactcggccagcagccgctcctggtagggcaccagcccgtcctgccaggccgcctgcccccgcagctccacagcctgcgtgcgccggacccactcctgcagctcctgtgctgagtgtgccttggtgcaggcgtccccatactcacagaggtcaggcctgggggacagggaggtcagcagggctacacagaggcacagccgccgtgctgagttcaaaggccgggacccctcagcccaatactggcctctgtagggagcaggggctttattcgtcccacccactcctgtgctcccgggacaaggcctggctcaagcagttcccaaacatgaacctcccttatccgggtcctcagaggccacatggctttagccctcagcaggtggcagggaggcccccgtccactgaacctgggagcctctggctctgcctacggtgggctcctgccccgctccaagctcctgggaacctctggctctgcctacggtgggctcctgccccgctccaagctcctgggagcctctggctctgcctgtggtgggctcctgccccgctccaagctcctgggaacctctggctctgcctgtggtgggctcctgccccgctccaagctcctgggagcctctggctctgcctgtggtgggctcctgccccgctccaagctcctgggaacctctggctctgcctacggtgggctcctgccccgctccaagctcctgggaacctctggctctgcctacggtgggctcctgccctgctccaagctcctgggagcctctggctctgcctgtggtgggctcctgccctgctccaagctcctgggaacctctggctctgcctacggtgggctcctgccctgctccaagctcctgggagcctctggctctgcctgtggtgggctcctgccccgctccaagctcctgggagtctctggctctgcctacagtgggctcctgccccgctccaagctcctgggaacctctggctctgcctacggtgggctcctgccccgctccaagctcctgggagcctctggctctgcctgtggtgggctcctgccccgctccaagctcctgggagcctctggctctgcctacggtgggctcctgccccactccaagctcctgggaacctctggctctgcctacggtgggctcctgccctgctccaagctcctgggagcctctggctctgcctgtggtgggctcctgcgctactccaagctcctgggagcctctggctctgcctacggtgggctcctgccctactccaagctcctgggagcctctggctctgcctgtggtgggctcctgccccactccaagctcctgggaacctctggttctgcctatggtgggctcctgccctactccaagctcctgcctcgagtatccttactttgggcagagctcgaacttggagagtcccgggggtggggaacggtgctcccagggcagggcctggtcgaaggccaccatctgtgcgtgctccgaggatgcgcagtggttctcgaaggcctcctgagagtggcaggtgaccaagcaggccgggcagtacagctgggccccagggggctggccaaggggggccgtgcgcccgtcgccatcaggggcagggggtgtgagcaggtccccccgctggaggccacccagctgctcggcctcccacacagccatctccacggcgctgtgtgcaaactggcagcgggactccccacgccagcacggctgcccacgccccacaaacctgcagtaggcaggaggctggccggcccggggccgcggcctcaccaccacaaactgttgcttgcggcggccctcggcgctcacgtgggccaggagggaggggcaggctccgtgctcagggcactgcccctgggggtccacgcgacagatgcatgggggacagcgcctgaagcagagggagcaaagcagctcgaagcggccgccaaactccgtaaggatggcgtcggccgcccggcctgcccctccctgggccccgctgccctgcacctccgccttcagccataggcgctggaggttgtgctgacgctcgaaggtccagaccagggcctcctcgcgactgcgggcaaaggtgcaccggtttcggtggcgccggcagccgagcccagggctgtagtagtggcagacttggtagcacaggggccttgggaaggtgggccggcagcccaccacgcgccagaccttgctcttggtggcctgcttaaagcgggccagcaggatctcgcgggagcagtcatgctccaccctacggaggacgtaggtgctttcattgagccgctgggtgcagcgggagcagcccagacacaggtccaccagggcacacagccgggccagggacggccctctggtggccgcggggctgttgggcagcagggtggaccctggaggcgccacctcgaacaccagcttggctctccagggaggcgtctgaggctcctgagctcacgggtccacgcagtccactggaactgttggccacggttcgaagcctgcgacagaaggagcaggtgagactgaggccagaggacatctggtccaggcccagctcagaagcacggcctctccaccaggcaaggagctggggatctgcctatcctgatgcccaagcagaggcctctccaccaagcaaggagttgggactctccccaccctgacgcccaagtggaggccttggcagtagctgtgtcctgtcagggagtacagggctcactgacccggacacagccagaccctccctcctgaagggtctcaggccccacctagaaggagccaaggtgactgcttgtggagccctggagggggcagagcccttggcacagtgccgcccccaggaggccgcacccctctgccccagccaggggtcctgtgcaccccagggcctcaggctcctgactcttctaaggacacagcacctccttttctattgaatgaccactggcccccaggaaaagaggactccacatctgcacctggggaggggcctcacggagaggagggtacagtgcccaccagagctcagggtgccaggaagagatgggtccccgggtccccaccgcagctgggatgctacaagaagagtaagtttaaaagcaacagactggaggcagacttcagtatgagaacccggcactccccgcggacccctctgagaaaacatccgagtctgccatccagaaaggacgggagccgagaccccaaaatcctgcgctccagtgggtgcagagaccacagcgctgggtcttgctgcggagggtgctggtcctggacgggctgcactgccccgggctgggtctgtggctcccgggactccgcgcccccggctgcactcaccctcccggacccccccctccgcccccggccccgccaccctgggacccccgcgctcaccctcctggagccgcccctggacccccgcgcccccgcccctccgccctgggacccccgcgctcaccctcctggagctgcctgccctgccgagcctgcccaggagctctcagtttcgattctggcccgggcactgacgctgatcgcggaaattacctcaccgccccccgccccgccccgccctgccccgcctccagcgacagctcggcccccgctgcgagggaacctcgggaagcgccagcgagcagaggacgcccctccctgaagggccagcgccgtcgaaggcggaggcggctgggggtgggggtcctttcccgcacccctccagggccccacgccccgtccagcccttcacacaccagagacgccccgatgatgtgccaggcggaaggggtgagaccctgcccggccctggacggcaggatggtctggtgactccaccatcagcccctggagaaatccaggcacagctgacctggaagcctgggtcccctgacaggcaggacctgcccgtggccctggtgctgctgggaccccaagtcccttctgtcaccaaccaggatatggcaggaatggctaagtggccgccgggtcccagagtcagcacgcctggctcttggctctctggactggctctgggccctcagcagccctgtggggaggccccatagaggagctgaggcctccagcccacttgcagctcgagtcccagccccagccttactgccatctcagggagaccccaggcctaaccctcccacctagaccacgcccagctgttagatgtctatgtttaaaataaacgtcccattagccaggggtgggggcgggcgcctgtagtcccagttactcgggaggctgaggcagaagcattgcttgaaccaaggaagtggaggttgcagtgcgccaagattgcgccactgcactccagcctgggcaacagagcaagactccatctcaaaacaaataaataaataaaataaacatctgtgttgttttaagcccctgagctttggggcgatctgttctgcagcagtagataacggacagtgatgctgcccctgaaacaaggaagcaaggctgccacccaaggccagcacctcgtggggagggccaggctgggggctcacagcgacctcgggaggtcggctgggtgggccgtcaaccaccagggagcctctccgcagaccaatcacgttggagctcctgggagagggcaggccctcgacaatagcagccccaggggccgggcgctgagcagggtccatgtgcgtggaacgctgggagaatttgtgtggaacgctgtgttcctggatggagaggctcaacaccacacaaagacgtgagttcctcctaaactaacctgcagtcgcatggtggacacactgactttcaagtccatttggaaaagcatcacatcaccaagaaaggctggacagggctttttttttttttgagactgagtctccttccattgccccggcgggagtgcagtgatgcaatcacagttcactgcagcctcgacctctggctcagacagtcttcccccctcagcctcctgagtcgctgggactacaggcacacaccaccacagtacaggtgcacaccaccacagttaactattttggagttttttctatgtttttcagagatggggtttctcaatgttgcccaggctgctcttgaactcctgggctcaagcaaaccccccacctcggcctccttgagtgccgggattagattacaggcttgaatcccaacacccagcccaggatgatgactaaaaaggattcccagcgggtgctggcatgacttactaaacacataacacactgcaaagccactgaacccggtgtggacacacagttccaaggcagaacagagagtccagaaatagagtcacactcaggagtctggggtgggatgaaagattggctctcggccaggcgcactggctcacgcctgtaatcccagcactttgggaggccaaggtgggcagatcacctgaggtcaggagttcgagaccagcctggccaacatagtgaaaccccatctcttctaaaaatacaaaaaaaaaaaaaaaaaatagctgggcgtggtggcaggtgcctgtagtcccagctactcaggaggctgaggcaggagaatcccttgaacctggggtcggggggggcgaggcggaggttgcagtaagctgagatcacaccattgcactccagcctgggagacggaacgagactctgtctcaaaaaaaaaaaaaaagaaagaaaagaaaagaaaagaaagcttggctctcacacctcagggaaaaacaattcattgatgcattccacaaattattagaacaactgattagcagcatctggaaacaaaaatgggagggacggtctctgcgtagcatcttacaccatatgaaataatcaaacactctcacggaaggaaaagccaaccacagaggcactaggagaaaccagggctgaaagtgtctgattctcaggactcttgggatgtgaaaggcctttctaggtgaaatccagccctgcgccactcgcccccagccaggctcaaggacagggctggtggcttcacacatgccgtgaggggcaagcatacaccccagaaatccacaaaacctgtctcctgaagcactgtttttttcttcttagagaacgaattaaacatctaccagcacaacagtgataaattcaatgacacaaaacaatttcacatggaaaaaaacaccaccatcaaaggagtcaaaaaccaaacatgaacagaaaacaaaattgcagcttatgtcacagtgaaaagtctgatcgctctgatatatatttttttttcttgagacggagtctcactcttgtcacccaggctggagtgcagtggcacaatctcggcaagctccacctcccgggttcacgccattctcctgcctcagtctcccaagtagctgggactacaggcgcccaccaccacgcctggctaattttttgcatttttagtagagacggggtttcaccgtgttagctaggatggtctcgatctcctgacctcgtgatccacccacctcggcctcccaaagtgctgagattacaggcgtgagccaccgcgcctggccctgatctctctaatattttaaagatcttataaattaagaaaaagatgtataatttaaaagaaaaataggcaaaggatgcaaatcaatacttcacaaaacgtggaaagtgaaattgctgtaaatggagtgaagtgttcaacctcggcgtaagggaaacgcaaaccagccccagacaacccgtccacccctctgacattgcaggcactcggccagagtctaaactggcagcaccgctctggaaaccagccaggcccgggagcacaggacacgcgccttccacgtggctccacagaggctcctgcacagagggacatctgtgcccaccaacagctcccggcagctccttctacacccaatggaccgggaatgcccagggcccctcgctcagggtctatgtaatgggcagtctccaccctgtgccatggaagactctaaggccattaaaaatgaggttggccaggcacggtggctcacacctgtgatcccagcaatttggtaggctgaggcgggaggatcacttgagcccaggagttcaagacctcagtaagctgtgatggtgccagtgcactccagcctgggagacagatcaggactgtgcggccaggacaggagggagatgtcctgtttccgcccacctttcacatctgtgcacgtcttcttaactcaaaacaaaaacaaaaagtgccacctcgagtccacagagcattgaaaacctgcaggttgccgtggacagctctctggctcccgtccagctgtgctcaggccacagtgacccctaacacgggctgagtgtgagaccacgggagagagttccacgtacacacagcacacggccaacacgctcacacgggctgagtgtgacaccacgggacagagttccacgtacacacagcacacggccaacaacacgctcacacgggctgagtgtgagaccacgggacagagttccacgtacacacagcacacggccaacaacacgctcacacgggctgagtgtgagaccacgggagagagttccacgtacacacagcacacggccaacaacacgctcacacgggctgagtattagtaatattattgtatccacgtcagcttcctgactttgtaacagacagcttccacgttctgaggaaacacaccttgaagtgatggggtaaagggtgaagggtgaagggtgaaggggtatcgtatctgaaaggtgaaggggtatcgtgtcttagtctcaattgcctggaactacaggcttctacagaaccggcaaatgggccagaacaaagcgactggtgagtccgcatagagcacagggagtcctttgttctatttttgcaacatttgtgtacgtttgtttaaattattatatcaaaatacaaagtaagaaatgtctgcccaacaccctcagcttgtctcatcccggtccctaggtcctcctcacccagcgtccctgccagtgggttccatggccccccagtgccagcctgccgtctgctgccctctgccgtctgccatcacctgaaccctgcaggaaaacgtacacactgtccccagcgtcacgaagcaggtggaggtccccagggcttagggccaggcctcagtttacctgtgactgtgggccatgtgctctcgggcaggaactgacggcctctgggtataactcgcttaagcaggtctttaacacccggttcccatctttccagagaccctcccgggcgccctcccaccagccaaaagctcacacccctagtggaggaggtgatagggtctgcagtgggagggagtggagccgatttcagatctcctcctcttggccttgtgggagccgtgcagccgggaggcctccttcgagatgagcccctggggagaaagtcagggggaccacaccttctccttgcaggggtgccagaaggatctgatgggggtttagtcccaggatgggtctacgccccccggggcctcccagctgctctgtcctctctccctgcctggcctctgcacacacagccatgtgcgtgtgacattgtgaaatatacattaacatatttggtctcgtcccgtttcctggcaaaaacccctaaaatccctggagtagccaaagtggcaagtgcctttttgtgctgatattgaccgaaggctggcagcctggaggcagcctcaggatggggctggtcctcagaaaggcctcagcaggagtagagggtggtacttgcagccttgccccaacctccaggcaggggaggggagaggcggctgaaggcggtcctcaccagtggccagtgacgtaatcaatcatgcctgggtaatgaagcctccatgaagtcgcaaaaggacagggctcagagagccgtggaggttcctggacggggtgcccttgtggggtgaaagctctgcgcccctccccttacgcatctcttcatctgcgtcctttgtaacgtcctttataataaatgggtaaacatgtttccctgagttctgtgagctgctctaggaaattaatctgacccaaatatgggggttaggaacctcaatttatagccaattggtctgaagcacccggggcttgagattggcatggggagtgggcagcagccttgtgtggacatctccaggtagatgaggatgtctaaggacagatggcgtctccagctagatggtgtctccaggtagacaacaacgtctatgaattgacggtgtctccaggttaacaacaatgtctccaggttaacaacaatgtctccaggtagacaacaatgtctatgaattgatggtgtctccaggttgacaacaatgtctatgaattgatggtgtctccaggttgacaacagtgtctccaggtagacaacaatgtctccaggttaacaacaatgtctatgaaaagacggtgtctccaggtagacaacaatgtctatgaattgatggtgtctccaggttgacaacaatgtttccaggttaacaacaatgtctatgaatagacggtgtctccaggttgacaacaatgcctatgaatagatggtgtctccaggttaacaataatgtctccaggtagacaacaacgtctatgaattgatggtgtctccaggttgacaacaatgtctccaggttaacaacaatgtctataaattgatggtgtctccaggttgacaacaatgtctatgaattgatggtgtctccaggttaacaataatgtctccaggttgacaacaatgtctatgaattgatggtgtctccaggttgacaacaatgtctccaggtagatgatggtgtctatgggtggacaatgtctccaggttgatctggaatccctcccactgcagaccctatcacctcctccactcaaggtgtgagcttttggctggtgggagggcgcccgggagggtctctggaaagatgggaactgggtgttaaagacctgcttaagtgagttatacccagaggccgtcagttcctgcccgagagcacatggcccacagtcacaggtaaactgaggcctggccctaagccctggggacctccacctgcactgtgatgctggggagggtgtgtgggttttcccgcagggttcgggtgatagcggacggcacagggcagcagacaatggctccaagtagacgtctctaggtagatggtgtcttcaggtagatggtatcggaattaaactggagcacgcccagccggcgtcggctgcaaaactgactaatctgttgttggaacagaacccccacctggtgtcagcagtgagctgtgctgtgagagtgcaggagaaacagcctagttttctgacatcattagaggtgatgagccaccttctcagcccctgctcacctctcccccacactgaagcctgctggagccctcaggccaggccctgagcaggaggcatggggtaggtgttgcaggatctaaaaggcctcccaggggcaacagagagcctggccaggggctgtgcctttctctgcttgcccccacagcacccccaaagcttgaggcttgatcagatatccctgaggtctcctggcagggaccttcctagtcctcactggcccccagtgtccctctgccatgtggccgcctctccgggatgacagggggaggggccacactcctgctggggctggagatgttggggtctggagtgggtgtgggcctgccctggggctgctctgggcatctggttgacacagagccaggtgcctgtgcgccccgtggggcagctgtgcccagcctggctgccctggaggagggagccaaaacctgggcctttccacccagccttccggtctcccctcttctccctggacatacaggaatgtggcttgctcctgacgcccagaagttcaagtccagaacgttactgcagatgtcgggagagacaagacaggacagaagggagcctgggtcagacccaggtctgcggtctgttggtccccgaagggcctgaggcggggaaaggacagtcttcaacaagtggcagctggaacacggagtaaagtttcgggaaaaacgaagctcagccccacctcgcattgcacacaaaatttaattcaagatggaacatctaagcatcaaagctaaactgtaacgcttctagaagaaaacaggagaaatcttcacaaccttgggataggcatatatttttttcttttcttttcttttttttttttttgagacagtcttgctctgtcgcccaggctggagtgcagtggcgtgattttggctcactgcaagctctgcctcccgggttgatgccattctcctgcctcagcctcccgagtagctgggactacaggcgcccaccaccacgcccagctgattttttgtatttttagtagagacggggtttcaccatgttagccaggatggtcttggtctcctgaccctgacctcgtgatccacccgcctaggcctcccaaagtgctgggactacaggcgtgagctaccgcacccagccggcatatatttctttaaaaagacataaaaggtagaaatataagagaaaaaaattgataaacaaggttatataagtaaaaaatgtctgtaccagtgagaaaaatgaaaagtcaagctattagttgagacaaaaatattcaaaatacacatatctgatgaactatatgcaaactgaaaatgtttttatctttgttattattattatgctttgagacggtcttgctctattgcccaggctggagcgcagaggtgtgatcacagctcactgcagccttgaactccgggctcagacaatcctccgacctcagcgtcccaagtagctgggactccaggcatgcaccaacaccctcagctaattttaaaattttttgtagagatggggtctcactatgttgcccaggctgatcttgaactcctggcctcaagtgatcctcctgcctcggcctcccaaagtgttgggactacaggggtgagccaccactcctagaaggcagattttttttaatctcaaaactcaaaagtccagtttttaaaaacaaacaaaatatttgaacagacactccacacaagaacatatacaaatgaccaaaagcacgtgagaaggtgcttaccatccagtcactgggacacgcaaatgggacccagcgagaaaccacctcacacgggcagaccgactgcgtccagagtgaggacggctcgtgccgcggagggtgcggagcagccaccgctcccgttggtgctggtggggatacaagacggcacagccaccttggaaaacagctcggtcatttccgatacagttaaatgaacatctgtctcaggatccagcagttcgactcctgcaaatctacccaagagaaatgaaaaaaggatcttcattcttcacaacgcctgggccagggagcccctcctgctggggccagcgtgctgacgcccacacagagacacccgccggttcacagcagccccattcccagcagccccagactgaaaacagctccaatgcgtatcaccaggcggctgaataaacaaaccgtggaacgtctgtacgacacaacactactcagacaaaaccaaaaccgaacacgtccgacccacacagaagcatggaggaatctcagaaacagttcagtgaaagaggccaaacacagacgagtattaaatgtgcggttccgtttctatgaagctcaggaacagacgaattctaaaaaccaggtcagtgactgtgaggacaggcccgactagagaagggaacaaggggagtgtcctctgcctggtgcaggcagcaggtacatgtgtctgtattgcttaaaactcatccaaggctgggcgcagtggcctgtcatcccagcactttgagaggctgaggtgggcggatcacttgagggcaggagttcaagaccagcctggccaacatggtgaaaccccatctctactaaaaatacaaaaattagccagacatggtggtgcgtgcctgtagtcccagctactctactcgggaggttgaggcaggagaattgcttgaacccaggaggcagaggttgcagtgagctgagatcgcgccactgcactccagcctggatgacagagcaagactccgtctcaaaaataaataaataaaataggccgggcacggtggctcatgcctgtaatcccagcactttgggaggccaaggcaggcagattgcctgagctcaggagttcaaggccagcctgggcaacatggcaaaaccccatctctactaaaaatacaaaaacttagccaggcatggtggctcaagcctttaatcccagctactcgggggactgaggaaggagaatcgcttgaacctgggaaacaagaggttgcactgagcagaggtcgcaccactgtactccagcctgggtgacaagagcaagactgtctcaaaaacagaaacaaacatgtctaataagggatcattatccaaaatatgaaaagaactcttaaaactcaacaataatgaacaacccgattttttaaacagacaaaagatctgaagagtcacctcaccagagacagagagaaggcaaagcagcagcttgtgaaagggtgcttcccatcacacatcattaggaaatctgcaaacccaaacagtgagttaccatcatacacctgtgagaatgtgccagggccaggcgcagtggctcacgcctgtaatcccaatgctttgggaggccgaggctggaggattgcgttgagtccaggagttcgagaccagcctgggcaacagagtgagaccctgtctccacgaattttttttttttttttagaaggagtctcgctctgtcgcccaggctggagtgcggtggcgtaatctcggctcactgcaatctctgcctccccggtttcacaccattctcctgcctcagcctcctgagcagctgggaccacaggcgcctgcaaccacgcctggctaattttttgtatttttagtagagatggggtttcaccgtgttagccaggatggtctcgatctgacctcgtgatccgcccgcctcagcctcctaaagtgctgggattacaggcgtgagccaccacaaccggcctccatgaacactttttaaaaaaattagccgggcgaggcgtggtggctcacatctgtaatcccagcactttgggaggccgaggcaggtggaccacctgtggtcagaagttcaagaccagcctggccacatggcgaaatccagtctctactaaaaatacaaaaattagccatgcgtggtggcatgcgaccgtaatcccagctacttgggaggatgaggcaggagaatcacttgaacccggggactggaagttgcagtgagcggagatggtgccactgcactctagcctgggcggcagagtgagactcaatcttgaaaaaaataaaaataaaaataaagaatgtcccaaacccaaaacgctgacaacgccaaatgctggtgaggacgtggaacaggaacctcagtcattgcaggtgaggacgtggagcaggaacctcagtcattgcaggtgaggacgtggagcaggaacctcagtcattgcaggtgaggacgtggagcaggaacctcagtcattgcaggtgaggacgtggagcaggaacctcagtcattgcaggtgaggacgtagaggaacaggaacctcagtcattgcaggtgaggacgtagaggaacaggaacctcagtcattgcaggtgaggacgtggagcaacaggaatctcagtcattgcaggtgaggacgtggagcaacaggaatctcagtcattgcgggtgggaatgcgagatggtgctgccactggcggaagacacttcagtagtttcttacaaaatgaaatacattcttaccacacaatctagcagtttcaccccttggtatttacccagatgagttgaaagcttaggtccacacaaaaacttgcacgagggtttttaacagcagctttactcataattgccaaaccttggaagaaaccaagatgtccctcagtcgctgaatggtatactgtggcccatccaaacagtggcatgtcacaaagcactccaccctctgtggggactctgccttctggagtgccctgggctggacaggccacagcccactccccactcctgtgtcctcagctgaggagtggccagtgctgcaccggctcctggggacactcagtgggtacaagacatgaccccttgtaggtttgtatcttgtggcctctgaaaccccatgaagtatcaggaggaggagatatcatggtgggatactgaggggtgcagccccctccaggggcagagggaatgatgggggtgctcaggacgtgtcagcaaatgggaagggtcacagccggaagggtagcaggagggtaggaagggccagaggtgggaaccgggtagttacatcgacctgagagagatggagggggcctggcctcacaagaaggggatgcatcgtggatgtgaggttgcaggaaggtgggctgagcctgtgggcaggtgttggtgctcccctccccgacggggcacgatggggacagagcatgggagggaatatgaagcaggagctctgtcttgtacacatggaatctgaggagctgacagatgacctgtggggagggtggtcccgtgccaatgtgtgctggaaggacatgcctgtgcgtttatcagctctgggctgcagcagggcacaagcgtggaagagcagccatggcagaagggcaggtttcagagtggactcttggaaccagcgccctgtgcccctccagccaccgtcccggagggcacccagtgacccggctttcgatgccattctgccttgagggacgtgtccaactttcctaagtggaaccacgcggcatggactttttttttttttgagacagaatttcactctggtcgcccaggctgaagtgcagtggtgcaatctcggctcactgcaacctctgcctcccaggttcaagcgattctcctgcctcagtctcccgagtagctgggattacaggcacctgccaccacgcccagctaattttgtatttttagtagagatggggtttcaccatgttggccaggctggtctcaagctcctgacctcaggtgatccacccgcctcagcctcccaaagtgctaggatgacaggcgggagccaccacacccagtgaccacacagcgtggacttctatgtctgcctcttgctgggccgtgagtctgggaggctggcctgtggctggtgtgcaggctcctatggccttgggtggaccatggcagcagggaggggaacagcgttggtgacgagaaggctctgggactgaacctgggagaggggaggaaggggcccccctgggcgtgagtctgttgagctcctgactggcgggcgcaggcccctgtgccactgagaggtctccttacctgtgagcggcggtgcctccgacgccagcctcgggtcaaggtggggcccaggctgttcttactattgtcctccagcgatttgcaggacaccttcaaaaccctcacgagttaccgaatcggctgattcaaaaccctcaccaggcaccaaatcggctgatgctcttgatctccgacttgccagcgtgcagaactgcataaatgaacctctgttgcttgcaagccccccagcctgcggtattttgttacagtagcactaacgactaaaacggccatgatcctcccaccaggcctcttgaaaactccgatgcgtgctggggagagaaggacaagggcacagggcacctgctgtgatgaaaacagctttgacctcgggacaccctggaagggtcctgaagcccccaggccacacttggaagaacgaagcatgtgggtgtgagtggtccggggcgggggtggcagccagcgctgtttgcgttgggcgtgtttatagacttgatttctctccacacttcattccaagagatagacactcaaactatgaaaattgtttttattttaaatcaaagtaccaggcagatacttgcaaaacaacatacaaagcaaaactcaaacatggcccttccctagggcgcctctgagcaggcacagagaagttctcaccctctgcaaaatccaatccaatcctatcttctcagaaaaccaaaccaaaggcagccatgaaaacccgtgttctgtacgtggttgagaaggtcctcctctctgagtactggctggccccaaggcgcagaactgggaggtccagggaaccctgcccccgaggagccagcaggacctggaggagccgggggcggtgctgacaacaaccttccccacccactgcagtgtggttcccatgaggatgagggcttctccagggcccttccccacgctggggcttggagcccctgccagaagcagctgggttggcggtagatgtccccgagggccttgggaagcactgggaatgggctcccagccctggtggaatgggggattgggaattaattctgaagctggttgtggcttatttttgtatggctctgaaattaacttcctctccctatgcctcagtagctaaggggcaggggcagaaaaggtcccaaccctgttcttaaaaagaaaggaaatgaacccacaacccactggaagttctgttgacgagggctgtcaaggcagacgcactcgtgactttgacaaagggaagcagctggaaggttgcgggtcccagggtcacaggcagctgtattagtgacaggttctgagctggtgggtgggggccgcagggctctcctgacccccgtagggtcataccgctgcatgctgcagaactcaactagagtggaaatgagtttaaaacggagtatgtacatcaaaagatcaacatcacgccgaaaccagctgactgtgacaacagcaaacaaaaatgtaacagagaaaacaaacaagacacagcctcagtagcttgacatgggtgagggcagccaggacagggccctggtgacaatggcgcagaggtggggtctgggccgctcactggacggacagccagccagttcccttcggagcagtgaagtgggacacaggaccctcgcattgcggggcctcagacgggccttcaactgccgacagaatcagcaggagcgtccaggggaatctggcactcagggtcctcccgggacatgccctgttggagacggcaggaggcctgggctggctgctccctgagatgcctgccccaggaccctggcctggaggggcctcagcctggtcttccttgtgagtccaaggccaggtctcaggacagccacagacagcccttccagacaggctctgggctccaccttcggcagctgccctgagcagcccacccggggcagcctcctgaacacccaggggctctcccttggacagagaccaccaagggccagcccaggggctgcatgggggccgggggccagggagccaagggctgttccgtggccaagcagcccaagctgaagggcccacatgggaatcctcgacctccatagtgactggttctgtttatgcctctgccccaggactgaagccctagggacacacctcatggatctcagacccctgggaggggccggctcagggacaggctgcccaggacctccgcacccggtcaagtgcactcacaggggctcaggggccacccaaagagctaactcgggaagcctaggcactcaccattattttggttgaaaatgctataaatctgactcttcctagaagcctactaagcaattcacttaaaaacaccctcagtacatgtgcaacaatgcctggaccacgcctcgtctgtgcggcccctgggccacctgagcaccggctgggggcgggggaggcaggcacccatcaggatctgcaccccaagctccgggtgcatgttcccaactggaggagaacggggcgccagccacactaaacctacagaaaactgtgggaagaaaccaaatccataggatccagaggtttcacacttgggcttagctcccaagtcatgagttagtaacgtccccagggacctggctgggtgcagacatgggggcctcgtgacctgctgcaccgcgtccagcacctgcagggtcgcgctcggcacctggctctgcttcctctgtctctgctgcacccaggctccccctagcccccgcccacctggctcctgatcaaggcccaatgtgtaaacagtattaataagcaacagatggaaaaatatatttcccaagaaaaaagggggaggaaacgtgggacctgaagaccgattttccaggttgctctcgctgttctgtccccttctctcttctcgtgatttgttttggcgattcctctctttggttctgcagaccacgtgacccacctgcccgagccagccctgcggcctctgcccgctccctgctgccgcggctgagagacagccagccctgtccgtcccaggggcctcgccctcctgtcggctacttccgctcgtggtcctctgccatggcagccacctcaatggtggccgtgtgctcctcaggcccgggggcagcccctgcgggcactgtcacaattgtgctggagccaggcgaggcctgggccacgttctgcagggtggggcccaggccaggcaacgtgagcagctgtagcgggctgaccaccttgaacaccgtgctaccgtcctgcacggcggccgtgctcaggaccgtgaggctggacgcgtccgggtggatctccactgtgctggggtaggtggagccggaagaggccaagactgtgtatcccccgagcagcggggaggccggggagctggcggggggcgcctgaagggaacccttgcccaggacggtggacggcagggtggacaccactttaccaaggggcacgctggtcagctgggggacgggcacgcccgggccaagcgccagctgggcagactgggtgagcacctgcgaggccatggcggccggtcctgatgtggcacgtgcaagccggggccgcttcacaggcggtggcagggagaccggcgtcagcgtcatgagcacgttgctgaggtgctgggacttgtgcttcagctccttggctcggcgacgatgctcatcacactgctgctccagggctgcagggaggtacagatggcatcacacaggggacgggggcatggatggcggcatgcaggggatgggggcagacacgccacaccatctgggtggcccctgggtcagtggcaacccaggtctgctcacctgatgccacaaacccagatgaccacatggccgccaaaggtgaggtctgtgggagacggggcccaagatggccctcggggtagacaccagcctgtgctgacccagggtctgcactgacccggggcctgtgtgcaagcgtggcaatcccgtctcagaccctcctgcactgacccagggcctgcgtgcaagcgtggaaatgccgtctcagatccccgcatgagctttcacacacccagcgtggaaagttgctcttgtgacatattaagagagagaggaggaaaagcagcacatgtggcacatgtgtttaaacataaacatgcacacacacatgcagagtgcacacacacaatgaacacaaacagtgaacacacaaagtgaagagtgaacacacagtgcacacacactgaatacacacacactgaacacagtgaacacacacactgaatacacacacattgaacacacagtgaacacgcagtgaacacacacacactgaacacacacacagtgaacacacagtaagcacagaccccaagaggagcatggaggaaacgcaccaatatcaggggcttgagctctgagcggggtcaggaccagcccttcccattctctgtcattgtttttttttgagacagggtctcgctctgtcacccagactggagtgcagtggtgtgatctcagctccctgcaacttccacctcctgggctcaagcaattgcctgccagcctcccgagtagctgggattacaggcacacaccaccatgcccagttttgttttgtttttttcagcagagatggggtttcaccacgttggccaggctggtctcaaactcctagcctgaagtgatccgcccgcctcggcctcccaaagcgctgggataacaggcgtgagccaccgcgcctggcctctgtcattttctcttaaataactacttggttcatcacagaaatgccggtaaatgtaagcttagtgcaatggagaggtctgactacctcacttaagcttcaggttgttttcctcgcacaacagcagtgcggagaagctcgccgtggtggcggtgactccaggaagtgcaggtggatgcacagccgtggggtgagcccgtgggctccaggtcctcagcctaccgcccaggggacgggacgggggtggtctcagcatacctgccaggtcccgggcgtactgctcccgcgagcggtccatctggcacttgtggctggccagcaccttcttcaccaggtccagcatgccgaagttctgcacgatgttgttgagaagtacagcatcttaaagggtaacgcggacactcagtgagagcccaagcccttcctagagagccacgcggacgctcggtgagagcccgggaccttcctagagagtcacgtggacgctcggtgagagcctgggctcttcctagagagtgagaacaccaccactgaggctgctcctcaggaacccagccagccaggagctcagttcagagggagaagactgagatacatcaaggcgatcctcccaccaagttcagcctcagcacagcaggagtcccaagcctagattcagcctccaacccagcagcacagaagggcctaggggcaggagggccagtggcctcacctcctgcagagactcctgggctgagtagccagcaagagggaagatgcagcttctcacctcgaagctgcaggggagggtcctggacccgctgctgcaggcctctcatggtctccaccagctcctggtggaactcctggatgacctcgtccagcaggccggcgtccttcagcccccgccagaaggtaaatgtgtcatctgtgagggaaggagtgggttcagtgggcagggaaagtgctgctacacggggcagccaccacagccacaaggacatcaccatagccacgaggacaccatgccagagccggcagcgcctggcactgtgctgggcttgcactgcccagacacatccacagtgccaaaatctagcaggtcagcctcagagcgcccacgacaatgctgctggaaccaggcctttctccacaaagaccctgccggccccacctggactcctggagcccctgtgtggcccgaggtgggcagagactccaccaccccgccagggcttgtgagaagcccacaaggaggaacctcgtacctccaatggccgcggtccagtcgccagggtcttcacaggtctctatggtgatggtcgcaggagacccattcactgcagccgaaagggaacctcgggtgagtgctgtttggaccacagtcccacaccccacataccctgtccaccctcctcacaccaccttctgaacctttccatctgtcttcacaaaactgacaaacacaggatacgcactagtacagccaaagtgtacctgccttatattttatggctatttttaatcacagacgttgtcaaacatacaaaggagaaacaacgcagaaacaaatcccttgaacccgtcacccaatttcagcaaatcctcaacactttcctcctcttgtccatttacgattgtactcaacaagcactttcgactggaccgtcaggagcgagacaaggtgatccttctgcttgacttgttttcccaccgagagctctgcggctgcgtctgtcgcccgtggggctcgccctcacctcgcctcttcaagtgatgcttcattgaagtcatcataaatctcagtatctatcatgtttccatttttctacaccagaacaagtggggctttgagagacagaaaccgtcctggctcttcctgtgggtccctctctcgcgcctgcagaacacaactgggcgtgtcgttcatatgtggccattttgggcgttgctgatagagactttatacacagatctggcttaaaaaacaaacccggggccggatgtggtggctcacgcctgtaatccaggcactttgggagactgaggcgggtggatcacctaaggtcaggagttcgagaacagcctgggcaacacggcaaaaccccgtctctactaaaatacaaagtcaaccgggtgtggcggcgtgcgcctgtaatcccagctactcgggaggctgaggcaggagaatcgctagaacccggaaggcagaggttgcagtgagccgagatcaggcccctgcactccagcctgggcgacagagcaggactccttctccaacaccaccaccaacgacctggaagcagttgaatgttttgggaatactggccttttccacattcatcaaagacatggcagtggtgagtatgactcatattacacatctggaattatttggggcgtgaatgagtcgtttttccgagttggggctggcacagcatcttttactaactgcacagtagccaagtcaatggttctcagagattgcaggttaaagaacccaaatcatcttcagaagagctgagcctcagcctagctgtgaggcactgactacagggcgtggaaggcccagttccttccctggcaggcggtcaggcagggccaacactaacgcggtggagccgctggggaggccctggggaggacagacaggaggctgggctctacccagcccctctgaccacagcagcccaagtgtcctgggcttctcaggactcagcactgaacctgccaggctgccccagcaggacgtggaagggggcccaggagaagggtgaggcctccctagtgccctggcctcactctcctacccagcgggacaggacaggactcaactgggtcccacctgggccaacaacaaggacgtccctgggcacacaggaacacaatctggccagcaatgcggagtggcagcttagggacaatgcatgtggcattgctggaaacacatcaccaaagaccacccagagatgtgaccagggagcccaggacctaacttcactttaacttcagtttttttgttttgagatggaatctcacactgtcgcccaggctggagggcagtggagcgatctcagctcactgcaacctccgcctcctgggttcaagcgattctcctgcctcagcctcctgagtagctgggactacaggcatgcaccaccacacccggctaacttctgtacttttaatagagacagggtttcatcctgttggccaggctggcctcaagtgatccacccgcctcggcttcccaaagtgctggggttacaggtgtgagccaccacacccagcctaactgtagttttaagaaaaatttctctattcataaagctggaaagaattctagggaacaacctctccacagtttagagctacagacaccaacgtggaacagtatctaaagcgtcacccaaaaacccaagtggcaggaatacctgcagcaaggcacccagcacggaaggcgggagcacaggcgcgcagttccgtaaaccgccaggtcaggagggaagcgggtccagatttggggctgggccgtgggggtgggagggagggggccgggtgggcgcccaggcactctctgttactcgctatacccttccccacacgtgagttattatattacaaccaaaatggcttaaaaagaaaagtgcttcaatcttccttgtcaatgaaagcagcaattctgccagatctcctctgtgaggcaggaggaggctgatcccagacaactcagggtcccaggcaggagaccggcagtcctggcgtgagcaaacgcctggggccaaggaggccacccaggggcatgtcaccctctgtggccatggccagggtggggctgggtcaggacgagcagccctgtgcacctaccgtcggctgcggcgggcgtgaggggaatgtactcggccgacgtggggctgctcagggacacacgggctcctgagaggtcaatctttgtgctgcggcaggtgttggagcagaccttgtcatgctggtagaagtccagttccccggagtccatgatcttcctgtgacagacagtggcatggagcgtccaggtcggccccagagccgaaggcacctggcccgcccaccctgacctgggccatccacctgcgtggggcaggcctagcagaggcgctggcagctccacagggcagggtgggctctacttccctcttagcgcgagctcggcgtgcaggaccctgctgctgaagaagcagccggcccaggcccacgctacggcactgtccccaggaagggggcaagcgctggccagtgggtgtcctggaggtgcccgtcagagtctgtggggctgggcctttctgggatgtcccactaccccagccccaagggagtgacccacagctaacaaaggtgggcccagtccacctgcatcatgcgtgactcattctgaagcagaggaaggtgggaaatcacttccaggagaaccttcctccttctaaaggcacagagacagccaagaagagtgatgagggcgcaggacagcaccaacggccatggctgccgctcatcctcatctttaccaggaaggcttcgtacggcccaaactgctgagagccgccctcccagggccctctcttctgcctctccggaggtccagggtctcagtcctgtgtgtctcaacgagcctgcctcgacccatgaaacgagggtcagaggctccagcctcattcaatctttgggcagcactgacctcaggcacacacaggctaatgcttctgtggtcagctcaggacttgcctacctggccggtggtccccacagctgtgccaccagccacgttccagaaaatcagaggccagttcagctggacagggaaaggacctgagccatgggaaaggacccagggctagtcactcgtgaggtctcaaactctgactccagcacaaagcaggggccctccttgggaagcaaggtagaggccaggcccacaaagactgagactgaggcttatgattcacagataagtgaaggccgggcacggtggctcatgcctggaatcccagcactttgggaggctgaggcaggtcaatcacctgaggtcaagtgttcgagaccagcctggacaatatggcaaaatcccgtctctactaaaaatacaaaaattagccgggtgtgctggcgagcacctgtaaacccagctactggggagggtgaggaagagaatcgcttgaacccaggaggcagagttcgcagtgagccaagatcatgccactgcactccagcctgggcaacagagcaagactccctctcaaaaaaaaagtgaaagaaaggacagaaataaggagtaacataaaaggccaaaatctgatgcacaaataccagattatacctttcttttattttttattttcagaatgcataattggaacagacccttttcttttcctttttattcttgtttttttttttttttgagacagagtctcactctgtaacccaagctgtattgcagtggcacaatcacagctcactgcagccttgacttccaggctccagtgatccttccaccttagcctctcgagcagctgggaccacaggcatatgtcaccaaatccagataattttttttttatttttagtagagatgaggtctcattattgtgcccaggctggtctcaaactcttggcgtcaagtgatcctcctgcctcagcctcctaaagtgttgggattgcaggtgtgagccatgtgcccagccaaccctttattttacaacgctgaaacagtcacaagtgccttcaggtaaagaattggtggaaattaaaatgactgacaaaacaattctaaaaatctgatagtgtccctgttggcaggagtgtgggagacgggtttacagttttgggtgtgagcaggtgcagcagccacccgggaggttgtcagcactcaccacatctaaaatacgcctcatcttcaaaatcccaaaaccccacaagaaagcaagagctgccagggccccttccagcagggaggctgaccctgcgccagcgcccacctgagcatgatgccgttcatgcggatggctctcttccagtccttcagggtggacttcccggccaggtgcacaaattcctttgggctgattacatgctcgtcgtactgtgggggacacagtcatgtgggtcaagcttggccgggacaccacatagggtgcccccatctcccatccgaccctgagtcaggcgcgcaaggcaggaaaagcgccacggcacggctctgaccggtgcaggcctcctacagagcattcaggtaaaacaaggacatgacccacaggcacggtggctgcagtggggagtggtgtctcctccagccctgagggggcagagctgctgtgtgcctggggctagacagggctgggctgaccacaccaggtagaaggtgtgtggccttctcttcctccaggcagactaagcaaactgcttctgtgcaatgtattttataaatacacgttattgcatacgttacatcgcagatggcaacagatgccagcacatgggtggagctgtgaacgccaccttcctcaggtccctcctgacaccaccttgccccgtgcagcaaacaccggcacctgctctcactctgacacacacacacacacacacacacacacactcatctgtttctaagccaggggaaccctcctgcttgctaatttcacccatgtgggagctcagagaaactgagaaggtaaaatatcctgttcaatcttgttacacaagcaattattgaaaccaaaaactggaataaaactgcatttacttagaaaacaagcaggctggggatggaggagtcacgaggtctctgcagctggacccaggaggcccgagtacgggggccgcctccacccccgggccgtgcccaagtctagcttgctgaaggaagtgatgttcccaatccctgagcccaccctctcatgacccctgtgccacagacgggaacactaagcccagccagtctctggctctccctcatgcggctgatcagggagatcccatagaagtccagaaggtggaatccagaagattctctggccactgtcggagcctggcaggaaggctgcactggctgtgactgaggctgcttccggccatcacttctacccaacgtggctcacacctaggaaactcaactgcacccaaagggcctgatcctacctagggctctgggctcagccagcctcacctccctgcccctcctaggcctgcctctttcctttcttgctttcacctttgttactcttctcaccccaggttttcctctcccagctaggaagctacatgctgtactctcatgagtggctccaggagcttcagcatgtcacgcttaccagagctgccagagcccagagctaacgcggccactcctgaccccccagagctaacgcagccgctcctgaccctccagcgctaacgcggcccgctcctgaccccccggagctaacgtggccgctcctgaccccccggagctaactcggcccgctcctgaccctccagaccacagccacgtggccctgctctcatctctgaggccctccagggcgtctctctcgatgctgaatagacaggactggtcgggtgacccacgtttccccgactcttcacacctcctcacagcacagcgcttccatctggaggcctcctatctccgcctgcaatgcatatttagaacatccttccatcatgatctgctggtggcaaactcgtgtctttttctggaaacgtctttcttccagcataatttcaaagacgacctcacggtgtcgtcactcgccacacagtgaggctctggcgctgccacctctgctcctgcgctgctttcgggagctcacggccggcgggattcttgctactgagcgatccgtctctcctcctggctagactgaggatcttctctgtccccgtccttctggaatttcattatgatgtcacctatggtacatttctttcgtgtttccaacttctaattctaatacaatttcaaactcacagggtaattgccaggatagtccagggagctctcacacgtgcgttccggactcactgcctgctcccgtctgcccccttgcccccgcctagacctgtgcacgtgcagctactgagagtgaagcagagacgtcgggcccctgggccctcaacacttgtgtatatttcctaagaacaagcttctcttacgcagccacagaacaactcgcatcaggaaattatcattcatacattattctctaatccattgtccatagtcaaattcatgaattgttccaatgatagcctttattgcaaaaaaaaaatttttttttttgagatggagtctcactctgtcgtccaggctggagtgcactggtgcaatcttgggctcactgcaacctccgcctcccgggttcaagagattctcttgcctcagcctcccgagtagctgggagtacaggcacatgccaccatgcctggccaatttttttgtatttgtcgcagagatggggtttcaccatgttggctgcgctggtctcgaactcctgacctcaggtgattcacccgcctcggcctcccaaagtgctgggattacaggcgtgagtcaccatgcccagcctacatttttttctgatgcaggatccagcccaagactgtggagcatgcagctgccttgctcttcggcttttgtccccattaagactgcagcaggccgggcgcggtggctcacgcctgtaatcccagcactttgggaggccaaggcgggcaggtcacctgaggtcaggagttcgggctcagcctggccaacatggcaaaaccccatctctactaaaaatacaaaaatcagccaggcatggtggtgggtgcccgtagtcccagctactcaggaggctgaggcaagagaatcacttgaacccaggaagcggaggttgcggtgagccaagatcgcgccattgcactccagtctgggcaacagaggaagactccatctcaaaaaaaaaaaaaaaaaaaaaagacggagcagcttctcagcctgtctgtgtttttcttcaccttgacgtttttggagcttgtgggtcaggtattaacgtaggctgtctctccatgagtgtctgctgttttctcatgagtagagtcaggctatgaactgttggaagaacaccacagacctgctcactgcatcaggaggctcaaaggggaggtctgtcccgagcctgatgatgtgaagatggatcgctgggttaaggaggcacctgccagctttcccaccacagctacgacttacgtctgcaatggctgcatggtttacagggatgctctgaaactagtctgagcacccgctcatgactctgaccccatcattcctcccatgctttacttctctctatgcatttatttaacataaataaataacatgaaatatatggagataggtatatagactcatagattttattttactcgagtgatgacccatgactatcactatttatttggatgctaaaagccaccctacatgcaggcagtggggtcttcatccaggctggggtcagtcagggcccttgcactgtggaccactctttctcagttatgaaagttctcagactctctctcctccttccagaactcaaatagatgtgtttgactctcgtgcttcctgaataaattgctttatttctatttacaagtcctacttctctcttcagctatggctaatctgctgaagacctatccactaagtgttgaacttcaatcctatctctagtcgtgtttctgcagaatctacttatgctttactcatgctctcttttcttttttttttttttaagaagaaactggggtctcagtatgttacccaggctgctcttgaactcctgggctcaagcaatcctcctgcctcggcctcccaaagtgtcaggattgcaggtgttaagccatggcacccggcctcttttatttcttaaaataaattattaaatataacgattttatcttctaagccttaaaaccccaacagccgaggctgctgcagggccgactctgcagcctgtggcttctgtggggcctgtggcttctgtggggcctgtggcttctgtgctgcctgtggcttccgtggggcctgtggcttccgtggggcctgtggcttccgtgctgcctgtggcttccgtggggcctgtggcttccgtggggcctgtggcttctgtgctgcctgtggcttctgtggggcctgtggcttctgtgctgcctgtggcttctgtggggcctgtggcttctgtgcagcttgtggcttctgtggggcctgtggcttctgtgcagcctgtggcttctgtggcttctgctccaggagcactacttcttgtgtgtccagggttctgtggaaattacttgaaacctgagataaaggtgaattcttccaaaaagtactttttgtttgtttctgtcagattcctgggggaactgccagctgggagccactgataacgacactctcagcttgaggctttcagaccatccagaccacctatgaatcctcaagggggtgtctccttccctctgccagggacaagaggtatgggagtacgtggtggattcacccttggaggtgccagctttggaagggacagtcaccacccagcacgcacacctcaaggaagccctgggctttgtcttctgatctccagccctgcaaggctgggaaaaccaagctcaggccaaggctctcagggcaaaagctgggcttggcaccccatctgcctctcaattctgtcaccattaggtccccaggcctcagcacttcctctttcttagcccgtgtgaggcagcatctgtaagatgctttatggaaatgtcttcactggcattttcggctgttccaccacaggtgagcctgggcacctgacctatcagtattgtcagaaagagaagacctttcccactcatcctaatccttaccaaagaggcagcctttttggagcagctctcactggatctgctgggtaaagctccttgtccaggaggggcagcctcctccacacagcgggagggcctcccagcctccctgccacagtgcactgtggccacagcgaattcctcttcctgaaggttcttcccgcacctccttcactctccccagccctggagaccctgcctcaggatgcactcagcacagctgcacccccaaagcagtcacagacaccatgaggcctctctcctgggccctgaatgcagcctgtgctcacctgaacacatttcacattgatgccgggacacacaaacttcctccagatgaggttggctctgctgtctccacaggtgatggggtacacaatctcagcttccaggttctccccctcttcagccatcttcacttctcacaggcacattgacagggaagggtaaaagcagaacatcagttacaacctcttcaaagcatttcctgaaaatgcagaaaatagctaccaacatggaaaccaaaaattaaaatccaggaaggcctgagatagagccaaggtgggcagggcatgcccatcagtgccattagagtttcagggttaaacccactaaacagatttaaatatcgttacattaacagaattccattaaactatggttcaactgaagacccacttaggaaaataaaatcaaactttaattgaaacaattctagggaaacctaaggttttaaaggttctagggcctttaatctcaggcaaaagaaaaatattaagagtgttataaagaatttttgtaatcccagcactttgggaggccgaggcaggcggatcacgaagtcaagagatcaagaccatcctggccaacatggtgaaaccccgtctctactaaaaatacaaaaattagccaggcatggtggcgggcacctgtagtcccagctactgggaaggctgaggcaggaggctgaggcaggagaatggcatgaacccgggaggtggaggttgcagtgagtcgagatcgcgccaccgcactccagcctgggtgacagagcaagactccctctcaaaaaaagaaaaaaaaagaatttttactgggccaggcgaggtggctcacacctgtaatcccagcactttgggaggcccaggtgggtggatcacctgaggtcaggagtttgacaccagcctggcccaacatggcaaaaccccatctctactaaaaatacaaaaattagctgggcatggtggcatgtgcttgtaatctcagctacttgggaggctgaggcaggagaagtgcttgaacctgcagggcagaagttgcagtgagctgagatcatgccatcacactctagcctgggcgacagagtgagactccgtctcaaaaaaaaaaaaaaaaacagaatttttactggccaggctcagtggctcacacctgtaatcccaacactttgggaggctgaggctggaggatcacatgaggccaggagttcgagaccagcctgggcaacagtgggaccctatttcttgaaaaaaaaaaaaaaaaaaagttttttaattagctgggtatggtggcacatgcctgtagtcccagctactcaggaggctgaggtaggaggatcatctgagcctgggaggttaaggctatggtgaacggtgatcgtgccactgcactctagcctgggcaacagaacaagaccctgtctcaaaaaacaaaaccttcttttactaccattcactgatcgttataataaacagacacaggcaaaacaagagtactgaaacagtgagaagaaaacaaaatccaaaagaggagagagctgcaaacttggggccaggtgactttgctctcctattagtcatgggcagagaaagggctgtcattacagacacatggcaggttccacctgggggacctggggcctggcctctcactcctaagggcacacagcttgggaatcagcccgaacaaagaccttgtatatctctggctgttcctcattttgagtgcaggactgtcctgtccctgctgcggcaagaaggcagacttcccacctaggacggcttcctacctaacacggcttccttgagctgggaggaggctgtgaaggccgcggcagctgctgccgctgcattttctgtctccatgttatcttccgtcaggtcgcccctggtgaagtgaagggaggagagaatagaatcaggatcccggagggcacaacctgcagggcactattttcctgacagcgctttgctgacctgttacactcttctaactgaattcagaaatggcagaggggccgggtgcggtggctcaagcctgtaatcccagcactttgggaggctgaggtgggagggtcacttgaggtcaggagttcgagaccagcctggccaacacggtgaaaccccatctctatttaaaaaaatacaaaaattacctggacatggtggtacatgcctgtagaagttggggtaggagaaccgcttgaacctgggaggcagagattgcagtgagccaagatcacaccactgcactccagcctgggtgagagagcgagactctgtctcaaaaaacaaaaaggccaggtgcggtggctcatgcctataatcccagcagtttgggaggccgaggcaggtgaatcacctgaggtcagaagtttgagatcagcctggccaacatggtaaaacctcgtctttactaaaaatacaaaaattagctgggtgtggtggctcgagcccgtaatcccagctactcaggaggctgagaccacagaatcacttgaacccgagaggtgtgagtggggattgtgtcaccgcactccagcctgggcgacagagcaagatgccgtcaaaattaaaaaaaaaaaaaaaaaagaaatggcagaggctgcgcaggtctgagcactgatggggacaagctggtctcgagatcacacattttctgtttggttcatggtggcgagcacccagaacggcacccagcaggtaaagccagcaggtgaggctgggtgcagtggctcacgcctgtaatcccagtactttgggaggctgaggcgggcagatcacttgaggtcaggagttcgagaccagcctggccaacatggtgaaacctcatctctaaccaaaataaaaaaattagccaggcgtggtggtacacacctgtaatcccagctacttgggaggccaagacaggagaatcgcctgaaccccggaaacagaggttgcagtgagccgagattgtaccactgcattccagcctgggcaacagagcaagactctgtctcaggggaaaaaaaaaacccagcaggtgaaaccagcaggattcatggaggcagcgagtgccccagcaaggattctatgcttccatttctgtctttaataaagtgttttatttccacaataattacttcatatggctatagaaactatcagaaaatacaaaattttagaagaaaagtcactatggcccaacctcataaaaaactaaattgtagacaaaagggtaaaagatgaaaccataaaagtattagaaggaaaaaaataagttttttttacttgtttcaaagtgacaaagggttttctcatacaatacaaaaccaagaaataaaaaaagataactttgccttaaaaaataaaaataaaaactttcaatgccaggaaaaaaaacaccacaaacaatttttttttttttttttgagacggagtctcgctctgtcgctcaggctggagtgcagtggcgcaatccccgcccactgcaagctctgccttccgggttcacaccattctcctgcctcagcctcccgagtagctgggactacaggcgcccgccaccatgcctggctaattttttgtatttttgttagagacagggtttcactgtgttaaccaggatggtctcgatctcctgacctcgtgatcctcccacctcggcctaccaaagtgctgggattacaggcatgagccactgcgcccagccaccacaaacaattttttaagaaaagaaagaacttggtggcaaaatgcttaaaacataaggacaacaaaccacttatttcctgatatgacataaagaggtcccaccattgcactccagaccaatgtcacaacacaacagggaaacgcaaaggccccaagcaggggctctggagaaaccctggaaagacactcatgacaaatgcaaacagaaaccagtacatgaggccactttcccctagagagcccacaggaaggaaccagcgttaccacgcgtacgggagagtcttgggatggtggtgccggcccaggacgcaggactccaatggagtcgttggtgagagctatgaggagggcactccgcctgcagcctagaaacatgcccctctgacccacctccatttctagaaacatgcccctctgacccacctccatttctagaaacatgcccctctaacccacctccatttctagaaacatgcacatatgacccacaagtccatttctagaaacatgcccctttgacccacctccatttccagaaacatgcccctctgacccacctccatttctagaaacatgcccctctgacccacctccatttctagaaacatgcccctctgaccccacatccatttctagaaacatgcccctctgacccacacctccatttctagaaacatgcccctctgacctcacctccatttctagaaacatgtccctctgacccacctccatttctagaaacatgcccctgtgaccccacatccatttctagaaacatgcccctgaccccacctccatttctagaaacatgcccctgtgacctcacctccatttctagaaacatgcccctctgacccacacatccatttctagaaacatgcccctctgaccccacctccatttctagaaacatgcccctctgaccccacctccatttctagaaacatgcccctctgacccacacatccatttctagaaacatgcccctctgaccccacatccatttctagaaacatgcccctctgacccacacctccatttctagaaacatgcccctgtgaccccacctccatttctagaaacatgcccctctgaccccacatccatttctagaaacatgcccctctgaccccacatccatttctagaaacatgcccctctgacccacacctccatttctagaaacatgcccctctgaccccacctccatttctagaaacatgcccctgtgacctcacctccatttctagaaacatgcccctctgacctcacctccatttctagaaacatgcccctctgacccacacctccatttctagaaacatgcccctgtgacctcacctccatttctagaaacatgcccctctgaccccacatccatttctagaaacatgcccctctgaccccacatccatttctagaaacatgcccctctgacctcacctccatttctagaaacatgcccgtgaccccacatccatttctagaaacatgcccctctgaccccacatccatttctagaaacatgcccctgtgacctcacctccatttctagaaacatgcccctctgacctcacctccatttctagaaacatgcccctctgacccacacctccatttctagaaacatgcccctgtgacctcacctccatttctagaaacatgcccctctgaccccacatccatttctagaaacatgcccctctgaccccacatccatttctagaaacatgcccctctgacctcacctccatttctagaaacatgcccgtgaccccacatccatttctagaaacatgtccctctgaccccacatccatttctagaaacatgcccctctgaccccacctccatttctagaaacatgtccctctgaccccacatccatttctagaaacatgcccctctgaccccacctccatttctagaaacatgtccctctgaccccacatccatttctagaaacatgcccctctgacctcacctccatttctagaaacatgcccctgtgaccccacctccatttctagaaacatgtccctctgaccccacatccatttctagaaacatgcccctctgaccccacctccatttctagaaacatgtccctctgaccccacatccatttctagaaacatgcccctctgaccccacctccatttctagaaacatgcccctctgacccacacctccatttctagaaacatgcccctctgaccccacatccatttctagaaacatgcccctctgacctcacctccatttctagaaacatgcccctgtgaccccacctccatttctagaaacatgcccctctgactcacctccatttctagaaacatgcccctctgacccacacctccatttctagaaacatgtccctctgacccacacctccatttctagaaacatgcccctgaccccacacctccatttctagaaacatgcccctctgacccacctccatttccagaaacatgcccctctgaccccacacatccatttctagaaacatgtccctctgactcacctccatttctagaaacatgccactctgaccccacacatccatttctagaaacatgcccctctgacccacctccatttccagaaacatgcccctctgaccccacacatccatttctagaaacatgtccctctgactcacctccatttctagaaacatgccactctgaccccacacatccatttctagaaacatgcccctctgacctcacctccatttctagaaacatgcccctctgaccccacctccatttctagaaacatgcccctctcaccccacatccatttctagaaacatgtccctctgaccccacatccatttctagaaacatgcccctctgaccccacctccatttctagaaacatgcccctctgacctcacctccatttctagaaacatgcccctctgacccacctccatttctagaaacatgcccctctcaccccacatccatttctagaaacatgcccctctgacccacctccatttctagaaacatgcccctctgacccacctccatttctagaaacatgcccctctgacccacacctccatttctagaaacatgtccctctgaccccacctccatttctagaaacatgcccctctgaccccacctccatttctagaaacatgcccctctgacccacacctccatttctagaaacatgcccctctgacctcacctccatttctagaaacatgcccctctgacccacacatccatttctagaaacatgcccctctgaccccacctccatttctagaaacatgcccctctgaccccacctccatttctagaaacatgcccctctgactccacctccatttctagaaattaatcctgcagacatggtgttcccacactggcatgagggttgtctgaaacagggaacaagtctccagtttctggaacccgtgcgggcagctgcctctggggagatgatgtggagaagctgggagaggtctgggtggggttcccagctgtgcacctcataacagccaactgtatgatgtgtgcacttctaaacttccagaagtttgcttaaaaacacacgcacaccagccgggcacggtggctcacacctgtaatcccagcactttgggaggccgaggcaggcggatcacaaggtcaggagatcgagaccatcctggctaacacggtgaaaccccgtctctactaaaaatacaaaaaattagccgggcgtggtggcgggcgcctgtaggcccagctactcaggaggctgaggcaagagaatggcgtgaacccgggaggtggaggttacagtgagccgagatcgcgccattgcactccagtctgggcgacagagtgagaatctgtctcaaaaaaagaaaacaaaacaaaaaaaacatgtagcaagaggaagtctcaatttccagatggtagaagaacagatttaattccccacaaaaaagaagaggatctttaagtccttcaagacagccctgcctcagctgccacgtggggttctcttctcagagaagaaggcgcatgcagactctccactgctccataagccactgtcccgcgagggcagagccttggcgtcctggcaaagcaactgcagactgaaaaatgccctctggtccttcatggctccctccatcaagacagggggctatttcccaccccctccacttgactttgggccaagctttgaagagctttgaccaagaggctgtgacgaggccctacgaggactctggctctcctcctgctaagcacacccaggcaggtgtcctggcagatgaggaccacatgcagagcctcggccagcccaccaatgcccggatatgcaagtgagcccagcctggaccccccggcgaggcccagcagcaccagcccaggcccgaaaaccttaagaaatgaccagtgtctgctgctttaagccaccaagctctgcggtggtttgttaggctgcaagcatggctaattcagaaactgccagaaacaagcactgctgtccccagcctgggacacacagcaccgcctctgcgtggggagagggcacaggctaagggcacaaatgccatcccagacccggctcttgtgtgtggaaggggccactgtgccatgaggcagaggaaaccttggcaggaccttatgccacagcaatttaaaagagaagaaacaggctgggcgtggtggctcatgcctataatcccagcactttgggaggccaaggtggtggatcacttgaggtcaggagttcaagaccagcctggccaatatggtgaaaccctgtctctacgaaaaatacaaaatttaggcaggcgtggtggcgggtgcctgtaatccctgctattcaggaggctgaggcaagagatttacttgaacccgggaggtggaggctgctgcagtgagctgagatcatgccactgcactccagcctgtgtgacggagtgagacttggtctcaaaaaaaaaaaaggaaacacatctgactagtgtgatctcgcaaggaacattccagacacagtggagctagaaggttcttctccaaacaaggaatccccaggggatcaaattgttttgcatcggccagacatggtggctcaagcctgtaaccccagtgcttcgggaggctgaggtgggaggactgcttgagtccaggagttcaagactagcttgggcaacacagtgagagcccattagccaggcgtggtggcacatgcctgcagtcccagcactgtactaaaaatctacacggggccgggcatggtggcacatgcctgtagagtcccagctactcaggaggctgaggcaggacgattccttgaacccaggaggtcacggctgccatgagccgtgactgtgccactgcactccagtctgtgcaacagaacgagactctgtttcgaaaaacaaaaaatcatttcatgtctccagtttctccactggcaaaagactctgtcaaggtaaaaaatggttctgacccacagaaatctaagaaaggaaaaaatataaaaaatagaaaatttaaaaaagagatggtctcagaataaagaccaacctgggctatggttgtcactcttccctcacaccttagaaagctttctggccgcatctggccaaagggccaccctgccccatcttggatcagtgaggtgccttcgaacaagccacctgccctggagcccgtcctgtcttgtctgccaccgcacgctcagtaggggaggggaagtcgctaggttttagttcaccagtctctggatcaagacgtgccataaccaagaagccccagccacacccagacccgacgtggccacaaggggtgagctgggaaggcccaggaaaaggcgggaggcggacgaatggaaatgtcattctgtggccacagaaatgatctcaacgttttgtaacttcctaccaagaggcagtcttagctctgcccttgaaccagcacttggtgatgtcgcttgcgtcaatcaaggcaacagaagtgagcaggaggcccactttcctctgcaactgtgggcttacggggcaaagaagtccaggcctccaggtggaggatcacagaccgggcaaagcagaggagagccacccagccgagcctacctgtgcctcagactgcctccctccagagacccctgtggccaaggccacccagaccagcaggtccttgccaagctgtcagctgacgacaggggttggtgaggccggcccagaccagcagaaccacgaaccaaccaacagaattaaaaataataacaactatgtcttgtcttaagccactaagttttggatggtttctttctttctttttctttttttttttcggagacgcagtctcactctgttgcccaggctggagtgcagtggcgcaatcttggctcactgcaagctctgccccccggattcacgccattcccctgcctcagcctcctgagtaactgggactacaggtgcctgccattgggtgttttcttaaacagcaaaagaaaactgacacaatcataaacagagcaagcaagagaacttggcaattatttcctctctacttctcactgttcttcaaagagttaactcaagcataagatgtgagcaaattcttttaacatcctagaaaaaaagctcctactcagtgttcataaagcaaagctaacctacaggagccaccttccacagtgaccacaggaaaccaagacagcaagtgggacaccagcctccagggcactgcgccagccgtgcgcctgtgtctgccactgccctggtccgtcactgccaccagccggcaagacacccacagaggagagctctaagccacaactgtgtacgaagacaactgtgcaggattttattactacaacatttttgttttcttttttttttttttttgagactgagtctcgctctgtcacccaggctggagtgcagtggcacaatctcggctcactgtaacctccatctccctggttcaagcaattctcctgctgcagcctcccaactggattacaggcgcccgccaccacgcctggctaatttttgtacttttagtagagacggggtttcaccatgttggccagactggtctcaaattcctgacaagtgatccacccaccctggcctcccaaagtgctgggattacaggtgtgagccactgcgcctggcccatttttgtttatcaataaaaatgtacttaatgttgaactctccacatttcaaatgggtaactccagtgtccttgatgctcctgcgacatgttcgtgagacttctcttgggtgtgagagtctagcatgtgggtggtctggacaggagggggagggaagagtgcagagcagggcagggtaaagagaccccctaggatgtgaaggccgccctgcatttgtcagactgggcaacacccactccatcagatggaccctggtatgggcggcaagccacctaggtgccgaggcaagagaccgagggcacgagctgttccggtgtaataaaatgcataaaataagaatagttatactagatatagatcataaatatgattatatatgaatatcattcatcattagtttgtagcaattactctttattccaatattataataatccttgcctaagcataacctaggaaaaactaggaaatcataacctaggaaaaactaggccatacagagataggagctgaggggacatagtgagaactgaccagaagacaagagtgcgagccttctgttatgcctggacagggccaccagagggctccttggtctagcggtaacgccagcatctgggaagacgcccgttgccaagtggaccgtggtctagcggtagcctcagtgtcaaggaaaaacacccgctacttagcaaaccaggaaagagagtctccctttccccgggggagtttagagaagactctactcctccacctcttgcggagggcctgacatcagtcaggcccgcccgcagttatccggaggcctaaccgtctccctgtgatgctgtgcttcagtggtcacgctcctagtccgccttcatgttccatcctgtgcacctggctctgccttctagatagcagcagcaaattagtgaaagtactgaaagtctctgataagcagaaataatggcgtaagcggtctctctctctctctcctctctctctgcctcagctgccaggaagggaagggccccctggccagtgggcacgtgacccacatgaccttacctatcactggacatggttcacactccttaccctgccgctttgtcttgtatccaataaatagcgcaacctggcattcggggccgctaccagtctccgcgtcttggtggtagtggtcccccaggcccagctgtctttttcttttatctttgtcttgtgtctttatttctacactctctcatctccgcatacgaggagaaaacccaccaaccctgtggggctggtccctacaccctggctttgtagactggagcctaggcacgactcagctgctgtagtgaattgcgatcctccaaacccagcaaggcacctgcaggacatctggcccagtctcctcgttgagccagttcacgaaaaagagacttttctgagtgacatgctaatgggcaatatgaggactaaatgggatggtctccaacttggacaaaccaacagtaaaagccactttgcggggaaagaaacttttccttttttcttttttttgagacaggatctcaccctgtcacccaggctgcagtgcagtggcatgaccttggctcactgcagcctcaacctctctcaggctcaagcaatcctcccgcctcaacctcccatgcagctgggaccataggtgcatgccaccacacccaaataatttttatattttttgtagagacgaggtttcactatgttgctcgggctggtctcaactcctgggctcaagcaaccctcccacctcagcctcccaaagtgctcagattacaggcaggagccaccaggcctggccaacataggaagaaatttaaatttgaattgaatattagaagagatgaaaattcatcaacatggaaagacaaagatcattaactaaagccaaaccagaatggaagctgtgtgtacagtggggtctcatgctgggaacgcgaggggcacgtgcagggctccacggtgtggcgacgccccatgctccctttgtgggggttcatccagcggaacatgaggacctggggtgcttttcaacatgtacgtgagtttaataataaaaaggtttaaggaaagaaaaattcatatgtttcgatataaacagaacatctggaaagatctattctaaggtgttgacagtaggaatctctaggtagtagtaatatggcctttttgaatttttgcttatcagtattttctaattttctttttctttctaaataattctagctatgaaataattttctaccatatatattttgtaataaaaatggttatatttaattttttaaaggctgtacaaacttcctgataaaatggcaaattagacacacacatgtgggccgggtacagtggctcgcgcctgtaattccagcactttgggaggctgaggcaggcagatcacctaaggtcaggagtttgagaccagcctggccaacatggtgaaaccccgtctctactaaatatacaaaaatgagctggatgtggtggcacacacctatagtgccagctacttgggaagctgaggcaggaaaattgcttcaacccgggaggcagaggttgtagtgagccgagatcatgccactgcactccagcctaggcaacaagagcgagactccaactcaaaaaaaaataaaaataacacacacgtgaataggctcctcatggaagtcatcacaacaatgcagagggaagagcttccaaagtgtaaacccagaagcgaggagcaggagggtgcgcgcagacgcagagagcagcaaggtgcagactgagaggcggaggctggccgtggggagatgactgatgctcagtttataccccaaatccgtaaatctagaggcgtggcacatcaactacctctgccagcaggaatgagggaaaggagggcaaccaaaagatgtcccaccctcacccatccagctacctgccatcctcagccccactggcagaagaccctgagaggtggaggcaggcccctgcctacaggaccctgagagctaggggaaggcgttatcctgaactgtgtcccccgtaaaattcatatgttgaaggcctcatccccagtgtgactgtatttaaagatggggtcttcaggagataatttaaatgaggtcatataagttggccctcatccagtaagactttgaccttctggtggtttttttttttttggagactgggtctcactctatcactcaggttggagtacagtggcacgatcacggctcactgctgtctccaactcctgggctcaggtgatcctcctgcttcagcctcctgagtagctgggactacaggtgcttaccaccgcacccagctggtggtgcattgtgttttttgtagagatggggttttgccatgtcgcccaggctggtcctgaactgggctcaagtgatctgtctccctcggcctcctgcagtgctggaattacaggtatgagccaccgcgcctggccgaccgtgaccttctaagaagtgaaagagaaagatctttctctctccctccctctccatcatgaggacacagcaagaagtcggccatctgcaaggtagaaagcgagtcctcccaacagctgaacctggcagaccctgatcttggacttcagccttcagagctgtaagaaaataactctctgctgttcaggccacgcggtctacggcagcccgagcagactaagacacacgccatctggggagtcagaccagatcaggaagaaaggcctagagctcaggatactgaaggtcccaacccggtgctggaccagaccaccccggcagccgcggccacggagtcacggctcgggtgaggtgacctggacaccatcccggcagccgcggccacggagtcacggctcgggtgaggtgacctggacaccatcccggcagccgcggccacggtgtcacggctcggatgagatgactcggacaccaccccggcagccgcggccacggtgtcagggctcaggtgaggagagttggatatgggactgggcctaccccgaggctgcttccacccagacgcctgggtgggtgacacgaaagctgggctcagttgggatcagagcagcctctccccaggtcagaaatgaccctgggctcctcacagtagccctagggcaccatgagaaagctacgtggacttctctgaccaagggtcactgctgccacactactcattgcaggccatgtcagggctcagctgaggagacgtggacaccaccccagcagccgcggccacggcgtcccaagggagggacttgggcactgcctctctgggcaagagtggggaggtgtggggtgggagatgtctggaaacatcatggacacatgccgggaaaacacggaagctgtgcaccaaggtgctgacaaaggaaaaaggagaatggaggtgtgaacatccagctagcaggtcccactcagaaactcctgcatttccagacatggccaccagctctgtggatgagacaggggaggacagggtacctcacaccaggaacccacacaggtccatgtcttgctctgtgatcacacaacagcctccaccaccctgacatgcaggagggaggtcaaagcctcgggtccaacaacaggctccacagcaagggaagaaaggcaggaaggaactcagggccaggtcctcccaggcagcagctgcctgcacgctgtccaccaagggaggtctgacctacaccgcacaggggttggcagtctagagtcgtcctctgtcaaacggtgagaaagtcaaaagctcatgctcagtgatatgctaggtcagcatgaagatgccacacatgagacacagcaaggatgagaccaacgggaagactgccccagaccagagccccagagccctctggggaggaagaataaggatggcagcctgggactgcccggggctgactctgcctttatttcaccccagcagaggcaggagtgacaccggctcacagcaggagcagctctgccacctcctagcagttccacctacgggcagcaaaacaaagctggcagtttgggcaaatgttagcgtttttgccaactaacatttgaatcggacatctggtacagagatgaggaagaaaacactcacagtttcatgaagactgtcaagaaaatcactgactcttcacttcatttatgaaaggccagctctctgacatccctaccactccctctcacatgagaaatcacggcctttcaggacgtggagccacgtggccatgcaggtacgggaggcctccccgcagctgcagctgggtcttctggtccccgtgccatttctgcttttcttcgctctctacttacacacacatttgagtccagtctcagaagaactggaactagaaaaatcctgacacttgtcccttactacgttaatgccagctgtgccaaggacagcccaacccaagcccccatcagccccaatggcaccgaggcccgagcttacccgtgaggggccaagttggtcgtcaccaacacggtcttcaccccctccacaccactgccgtccactgcagtgtccggagttgtcacaaccaccacctcctccatgtgcacactcacgtcgggagtcgccatggctcagcggaaggggacgcccaggccagcagcgtcagtcctccagggtcccaagtcctggaggaagcaaggcagggcacagggatggagtcatctccacatccacacaacatagcactcacaaaggcatctctaatcagctccaaagacccacccttgagtcccagactgctacctcctgacaaaaacgagcggcaacagaagggctactccaggctctggttccgagggcggtgtaagcgcactccacccgtttttcccactggataagccgaaacccttgggtagaaagcacagagccactccctccacgtggggctcagagcaggaggacaggaggggcctggaattccaagcaacttccctggacgcaggctcccggcttgccagttcttccgtctctcctggcctgaactcaaagccagccccaatccctgaactgagtttcaggtgcagaaagcactccaagaagtcctcgctggtctgtggaacgggaagggaaacccattcaagacagaaagagaggagggaaacgccctgggtttttttgggtttttgggttttttttgagacggagtctcgctctgtcgcccaggctggaatgcagtggcacgacctcggctcactgcaagctccacctcctgggttcaagtgattctcctgcctcagcctctccaattgctgggattacaggtttcaccatgttgcccaggctggtctcaaactcctgacctcaggtgatccactcacctcggcctcccaaagtgctgggattgcaggtgtgaggcaccatgcctggcctgccccgggtttaaaaattattattattttgtctttcctggctttgccttcagcaagtccaacccctgctaaaacccagtgataatggctgtcctggcccaaaaagcttggagacaggggaatcttcctcctgactaaaggaatggtggcccaagagtgtgggggctccctgttgccctctcactctccatcccctacctagcacagggaacacaaaagcccctggtttccagccagagggcaacgagcctggagtcagagtgtgggggaggcgacaagaggagaggggagaagagaggatggcacacagctgtgtgtgagcgcctgggtcgtcccaagacagtctctacgtggtcctgaccctaaagggcaaagggaagaaaactgacctacaggataggccactgcccaggtctcagatgggccccagtggcgcatatgggacagatccacagtgcactggaaagtctctaaaataaactggcctaagaacacagacacaggaacggggtgcaaaatttgcagcctgaacctaaccaggtcgatttcttgctatgaaaaaaaaaagtctacattctctgtgaaacttaaaacaagacctagagtccatagcacagtagtcaaagcatccagaacacgatcaaacttcctggcaaagggtagtctggttgattctcaaaggaacaaatacacaagagaagctggctcttgaacgcagaatccagagactttcaggtgctatcggaccagctccaagaggaaagcaaacattgtcaaccaagtggaaagaaaatcttggtatagaaacaggagttataaccaaacagaaatgtgaaaattaaaaacgacaaccaaaagaaaatacacaaagctgggatagtctcagctactcggaaggcggggctggaggatcgtttgagcctaggagattgaggctgcaatgagctgtgatcacaccaccgcactccagtctgggcaacagagtgagaactctctcaaaaaacgaaaaagaaagaaagtagaacagaagtgaccaggggctgggggagggagtacagggagttgttctttaatgagtacagaatttctgtttgggatgatgaaaagctctggaaatggacggcggtgatggctgcacaatcactgtggctgttctgaatggtgctgaaccacacatttaaaaacagttaaaatgggctgggcgtggtggctcacgcctgtaatcccagcactttgggaggcggatcgcctgaggtcaggagttcgagaccatcctggccaacacagtgaaatcctgtcttgactaaaaatactaaaaattagccaggcatggtggcaggcacctgtagtcccagctacttgggaggctggggcaggagacctgcttgaacccaggaggcagaggttgcagtgagccgagatcgtgccactgcactccagcctgggcaacaagagcgaaactccatctcaaaaaaaaaaaaaaaaaaaaaaaaaaaaaagtttaaaatggttaaattttatgttatgtatattttaccgtaataaaaacactgtaatgctactataatagaatgactcattaggattagatatagactagaaagtacagaatataaaaactttttaaacaaagaaaaattttcatggccaggcatggtgtcacacctgtaatcccaggactttgggaggccaaggcaagaggaatgcttgagctcaggggtttgagaccagcctgggcaacacagcaacaccccatctctgctaaataaataataaaaaatagccaggcatggtggtgtgcacgcctgtagttgcagctactctggaggctgaggcaggaggatcacttaagcccaggaggtcaaggctgcagtgagccatggttgtgccactgcgctccagcctgggcaacagatcaagaccttgtcacaaaaaaaagaaagaaagaaaagaaaaaagaaagaaaataaaatcttccagaacttttaaaatcatcattgttaatataaaaataacatcacctgcccctaggactgtaacaaacaagtgtgtctaaggacaggagtgggtccaccccaacctggcacgcagtggtcccctgcggagagtctggccctgcactcactaaggggaggcactcatagcccagccaggcctctgcaattatgccttcaatgccagaactaactcacccaaactgaacaatcgatcacaaaatgtgccttcaggtctcaaggttcttgctaaatcttactcaaccgacattttccagcatgggaacatttttctgaatgtcttagggagaggaagtccgcaagagaacaaaaggtcctcaggccaccctagcttcttttcctccattccacaggctgtcttttgtctgggtatgcactggaccagggggctctacttcttcctacctgggcatgggtctccacacaactccaaggtaaagggccacaggcaagataaaggggagaaaagaaagctacgatttcctgggccaccaatcgcaaatggcagccagtctctgaagtaacccttgaccagagatccaaggaaccaagaaatgtaggtgatctgaacagaggggatggtggttaaacaccatgaaggaaagacccattctcaaagaaaaggaagcaaaaagaaaccgtggggagctgggtaccacccgcagcaaagaccccgcacgcgttactgacgccagcctggcctgggagagcagtgagtgtggcggacggtgagtggcggggagggctgtggtaggtttagggtaagaaggggcagcgcccagagcccagagaacaccagtgagggctccacaggaacactactcaaagtattcacggaacacatctaaacacaagcactaaggactaagtgcgagggacaagaaaatattccccgtttcctgtttcaggagggtatcgaaaatgagtgatggaaggaaaatgtattgtttaaatgaggaaaaaaaatttttacaaattaagaacatcctggaacatgatgagccgtttactgtcactcaatttaaatggtggccatctaggacagagcgcctaaggggaaagggggctcacaggtgaacccctccagctgctggtgggcaatttcccattagggcatcagggtctctgaagactgtcttcagatgctttttagccaggaaagttacaatgatgaattcgtttacactggcggaattacttcgtatttctcaaatataatgttttcactagcataactttgttgttgtagacttaggcttcaaaataaagaactttaaacaaacatgaataaaaagccactttaggccgggcgcggtggctcacacttgtaatcccagcactttgggaggccgcggcgggtggatcataaggtcagaagttcaaagaccagcctgatcaatacggtgaaaccccgtctctactaaaaatacaaaaattagccgggcgcggtggcaggtgcctgtaatctcagctacttgggaggctgaggcaggagaatcgcttgaacctgggcagcagaggttgcagtgagccaagatcatgccactgcactcaagcctgggtgacagagtgagactctctcttaaaaaaaaaaagccactttaaaattttactcaggccaggtgtggtggctcacgcccataatcctagcactttgggaggccgaggcgagcagatcacctgaggtcaggagttagaccagcctggccaacatggtaaaaccttgtctctactgaaaacacaaaaattagctgggcgtggtggtgtgcccatgtaatcccagctactcaggaggctgaagtgagagaactgcttgaacccgggaggcagaggctgcagtgtgccaagactgcaccactacacttcagcctgggcgacagagcaagaccctgtctcagaaaaaaaaaaaattcaaaaatttggccaggcgtggtggctcacgcctgtaatcccatcactttggaaggccgaggcgggtggatcacctgaggtcaggaattcaagaccagcctggccaccatgatgaaaccctgtctctactaaaaatacaaaaaaaaaaaaacaaattggccgggcatggtggcgggtgcctgtaatcccacctacttgggaggctgaggcaggagaatctctcgaactccggaggcagaggttgcagcgagccaagattgtgccactgcactccagcctagacaacagagcgagactctgtctcaaaaaaaaaaaaattaaaattaaaaaataaaaatttcatttaaaatactactgatctcccgtgctgacttctcggggtttaactctcactgaggagacgctgctttcataagggtaagctcagcaggggcaactaaagtcatttaagcagagagctgcaaagaggcaacagcctcactgcaggcaggggtcctcgtcacagcttcagggctttgcagaggattacgcaatgtacacgcacaaaactgaattccagcctctccattggcaactgcatacatacatatattctttttttgagacggagtctcgctctgtagcccaggttggactgcagtggcccgatctcggctcaatgcaagctctgcctcccgggttcaagcgattctcttgcctcagcctcctgagtagctgggattacaggcgcccaccaccacgcccggctaatttttgtatttttagtagagacggggtttcaccatgttggccaggacagtctcgatctcctgacctcgtgatccgcccgcctctgcctcccaaagtgctgggattacaggcgtgagccactgagcctggcctccaatggcaactatattaaaggttcaaagcaatatgcacaaaagttacctcacagaaaatagtgcaagtccttgatacaatgctctttagacacagaagaagcactatagaatagagcacctcgccctattgccttcccaagggcgagcaccccctcctctctccacagctccttctttgtttttttgagatggagtctcgctctgtcacccaggctggagtgcaatggcaaaatcttggctcactgcaacctccgcctcccgggttgaagtgattctcctgcctcagcctcccgagtagctgggactacaggcacccaacacgcctagctaatttttgcatttttggtagagacggggtttcatcatgttggccaggctggtctcgaactcctgacctccagtgatcctcccaccttgacctcccatagtgctgggattataggtgtgagccactacacctggcctctccacagccccttctgtgttgaagccaagacccacccagctttgatcccaaggcttgggttccccactagtgtgaagtgagtttccaaattattaggtaaatcagatatgagaaaatattttattttacttttttttttttgagacgcaatcttgctccgtcacccaggctggagtgcaatggcaccatctccactcactgcaacctctgccttctgggttcaagcaattctcctgcctcagcctcccaactagctgggattacaagtgcacaccaccacgcccggctaacttttgtatttttagtagagacagggtttcaccgtgttagccaggctgctctcaaactcctgacctcatgatccgcccacgtcgggctcccaaagtggtgggattacaggtgtgagccatcacacctggcccaagaaaatatttttaaactagtattcttgaccggcacggtcaacactgatgtaattgaaactgttgtatttgaagtgttagcaaagaaagagaattctggttcaacagaaaagtcagtcacgacttttcagtcacgcatgaattacacagtaaccaaatagataacatgccatgactgacgacgggcccacaacaaatcagctccgaccaacagggtccacaccaccatgggtctacacagatccaggtcccgcctgtgagcctacagtgacgcgggcccctgtggggtggtccctgcaggtcaggtccctgagagtgggtcccagtggggtgatccctgcgggtcgcgtccctgcgagttgggtgcctgccgggtggcccctgcgggtcgggtgcctgcggggtggtccctatgggtcgcgtccctgcgggtcgggtgcctgcggggtggcccctgggaatcgcgtccctgcgggtcgggtgcctgcggggtggcccctggggatcgcgtccctgcgggtcgggtgcctgcggggtggcccctggggatcgcgtccctgcgggtcgggtgcctgcggggtggtccttgtgggtcgcgtccctgtggggtggtccctgtgggtcgcgtccctgtggggtggcccctgcgggtcgcgtggtggcccctgcgggtcgggtgcctgcggggtggtccctgtgggtcgcgtccctgcgggtcgggtgcctgcggggtggtccctgcgggtcgcacccctgcggcgtggtccccccgggatgggtccaccgaggaggccgctggaggccgagcccgcgcccgcccgcggcgccaagatggaggcaggaagcgccgccgcccgcgcccgccaccgcccgcgccgcccgcctgacgccgccgttgcgcctgacgccgccgcccgcgcggccgcccctcccccggccctcccctccccccgccgtaacgtcctgacgctccgcagggacccctgactggacggcggcgcgtgagcggagcgagaggcctcgccgcgggggggccgcgggctcgccggcgccgcttacctggggccgcgccgggcctgcttaggcacccggcgggggcggcggcgtcgggagctgcggcggcggcgggcggcggcggcggccgcgggcttcgctccttgttggggattcggcggcggcggcggcgcgggcgcgcgcttcctagtgacgcaggcggcggggccgcgcacgcacggggctgggagggccggacacttatttggcgctcgcggaggaggaaggcggggccgtgaaataaggcccgacgggccccggggcgcgtgcgcggaccgacactgtcagctcctaacgccgcaggttcctcctggtccccgaggcccccggtcgggcgttgcctgccccgcgcgggcggccgggccgagggacgatggtcagtggacggacggcgccagggagcagtgcccacgcgcggcagggcggtaccttcaggcctccaggtacgggcgctcctcgcccggacgctgctgtgtgtgaatgggcgcgaggggactcccctgcggggcggacgcctgaacacgaggctgtggaggaggacgctgtagggtgcgcggactcacgcggaacatgccagaggctcagccagccacggcgctcccagcgtggagggcgaggggcatccgggagcggccgggagggctcggtcacccctcaagctgtcaccccagtcccacaaccagcaccccgatcctatcgcagtcccacagccgacaccccgatcccacccctgcccaacagccggcacccaccccaatcccatagctaacaccccggtcccaccgctgtcccacggccggcaccccgatcccaccccagtcccgcagctggcaccccgatcccaccccagcccaacagctggcacccaccccgatcccaccgctgtcccacagccggcaccccgatcccaccccagtcccgcagccggcaccccgatcccacagccggcactcaccccgatcgcatagcatagctgataccccgatcccaccccagtcccatagccagcaccccgatcccaccccagtcccatagccagcacctcgatcccatagatgacaccccgatcccgccccagtcctatagcccgcaccccgatcccacccgagtcccgcagccggcaccccatcccacccatgtcccacagtcggcaccccgatcccactcggatccggcagccagcttggatcctgtggccctcctccagcccccagggctcatttatatgttttattggcagaggctggggctggctctgttggcctctgtgctgggtttcttcctctgcaccgcaggactggctctcctgacctctccaggtgtcatcgaacacccttgtgcttgctgtcacccgctgcctgtctgcaggatcccggattccgtatcaggggaccgaaattagtcggaaaataggaagcaggtgctcgcttggatggaaccctgaccctgtgctcacacttgtaggaggagggctctgcaggccgcctcccggaacgggaggttcccaagccactgcacttcggaggggctgtaattagagttgcacattcattcagttcccagtaaagtagaacgtgctccagccagtgaggaaaaggtgtttttaaaaattagattggccgagtgcggtggctcatgccttttacctcaacactttgggagacaaaggtgggaggatcacctgtggccaggagttcaagaccagcctgggcaacagagcctgtctctggggaagaataaaaaaaaaaattgagcctttgtcagtgctactattttattatctggtaaatatgagagggttcacgcggtctatgtgtgtcatttatctgagtttgcctatcgtcacgttttggaaataaatgtcaataaagtcgaagaggagtgctgaggggggcctggggatgggagggtggctacatcatgcctgtgtgttgcgcaagcccaccgaggtcggcctggggtgagccctggggcctgttctgcctccttcactctggggctccaagagacaaactgggcaacaagagagaaactccatctaaaaaaaaagaaaaatcacctccaagataacttagctttcttctgctggcataacaaattatctcaaacttagtcgcttaaaaatgcaaatttaggctgagtgcggaggctcacgcccataatcctagcactttgggaggccaaggcaggattgcttgaggccaggagttcgagaccaacatggccagaactgtctctttttaaaaaatgcaaatgtgtccggcacggtggctcacgcctataatcccagcactttgtgaggccaaggcgggcagatcacgaggtcaggagatagagaccatcctggctaacactgtgaaaccccctctctactaaaaatacaaaaaattagcctggcgtggtggcaggcgcctgtagtcccagctactcgggaggctgaggcaggagaatggcgtgaacccaggaagcggagcttgcagtgagccgagatggcgccactgcactccagcctaggcaacagagcaagactccgtctcaaaaaataaataaataaaactgcaaatgtattctctaactgttctgtaggtcggaagtccagcccagcctcactccgccaaaatcagggtgtctgcagggccgattgcttttggagctccaggggagaagctgttctggcctttccagtttctggaagcacttgagccccttgtctcgtggcctatcccacacctgaaagccagccaaagccagttgagtcctcaccctgttggccccgacactgatctcctgcctccctcatctgctgtcaaggccccttgtgatgacatggggccaccagctggcccagggcacctcctgtcagagtccgccgaccagtgaccttcattccatctgtcgctgtaattcccctttgcttggaaccaacgttcacagatcccaggggttaggatgtgaatatcttgggcagggctgtgggggggctattcttccttctaaaatatttatcatttttgttttggggatttttttggtttggttttttttgagacagagtctcgctctgtcgcccaggttggagtgcaatggtgcaatctcagctcactgcaacctctgcctccgggcagacgtgagccactgcaccaggcctgtttttgtttttgtttgttttgttttgtttttgagatggagtctcggccgggcgcggtggctcacgcctgtaatcccagcactttgggaggccgaggcgggcggatcacgaggtcaggagatcgagaccatcctggctaacacggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaagagatggagtctcactttgtcacccaggctggagtgtagtggcgggattataggtacgcgccatcatgcccagttactttttgtatttttagtagagacagggttttaccatgttggtcagactggtctcaaactcctgatctcaggtaatccacccgcctcagcctcccaaagtgctgggattacagacgtgagccaccgtgtctggccatatttattaactacaaagggaaagatgataatttttttttttgagatggagtctcactctgtcacccaggctggagtacaatagcgtgatcttggctcactgaaacctctgcctcccaggttcaagcgattctcctgcctcagcctcccaactagctgggattacaggcgcacgctaccaagcccagctaatttttgtatttttagtagaaacggagtttcaccatgttggtgaggctggtctcgaactcctgaccttgtgatctgcccacctcggcctcccaaagtgctgggattataggcatgagccactgcaaccggctgaaagatggtaattttaaagtagagaaactgggttggctgggcatggtggcttatgcctgtaagctcagcactttggaagtccaaggcaagaggatcgcttgagtccaggagtttgagaccagcctggacaatatagcaagaccccatctccgcaaaagctaaaaagttagccaggtgtggcggcacatgcctgtagtcccagctactcaggaggctgacgtgggaggatcacttgagaccaggaggtcaaggctgaagtgagctgttattgtgccactgcactcagcctgggcaacagagcgagagtctgtctccaaaggtaaaaaaaggtccaggcacagtggctcacacctgtaatctcagcactttgggaggccgaggcgggcagattcgttgaggtcaggagttcaaaacgagcctggctaaatggtgaaaccccgtctctactaaaaatacaaaaaaattagccaggcatggtgacgggcgcctgtaatctcagctacttgggagactgaggcaggagaatcatgtaaacccaggaggctgaggttgcagcgagccaagatcatgccactgcacttcagcctgggcgacagagcaagactgtctcaaaacaaaacaaaagaatcttgagtcctgagttcctctaagggaaattccaggcacctcgccacccttgacaggcaaaggaacaatctgatgaggaagaagatagaaacagcttaaacaatagtctcccggccgggggcagtggctcacgcctgtaatctgagcactttgggaggccgaggcgggtggatcacaaggtcaagagatcaagaccatcctggctaacatggtgaaaccccgtctctactaaaaatacaaaaaattagccgggcgtggtggtgggtgcctgtagtcccagctactcgggaggctgaggcaggagaatggcgtgaacccaggaggcggagctttcagtgagctgatatcgcgcctctgcactccagcctgggcgacagagcctcgagactccatctcaaaaaaaaaaaaaaattagctgggtgtggtggctcacacctgtaatcccagctacgtggcaggctgaggcaggagaatcgcttgaacctgggaggcggaggttgtagggagctgagatcgcaccactgcactccagcctgggcaacagagcgagactctgtctcaaagaaaaaaaaaaaaaacaaaaaaacaatagtctcccaagtaagtcagagtcacaaggtgttttgattccctgtggaaactaaaatataacagcttaacatatgttcttgagttatttttcagaaacttggacatccaccaggtggaaaatgctgagctaggaacagtggctataatttcagccttttgagaggccaaggtggaaggatcacttgaggccaggagttagagaccagcctggccaacatggtgaaaccccgtctctagtaaaaatacaaatattagctgggcatggtggtgcaacctgaaatcccagctacttgggagacctagctgggaggatcgcttgaacctggtaggaggagtttgcagtgagctgaaattgtgccactgcactctagcctgggcaacagagtgagactctgtctcaaaaaataaataaataaaaagagaaaaaagtgttgcctgcaggccgggcacagtggctcacgcctgtaatcccaacactttgggaggccgagatgggcagatcacctgaggtcaggagtgcaagaacagcctggccaacatggtgaaaccccatctctactaaaaatacaaaagttagctgggtgtgtacatgtagtctcagctacttgggaagctgaggcaggagaatctcttcaaccggggaggtggaggttgcgatgagctgagatcacgccaccacactccatccagcctgggtgacagagtgagactccatctcaaagcaaaaaaagaaacataggtgggacccttggtgtgtccttagggcatgatggttgaggtatactgctggtcctgtcatgtaaaagaaaacgagccgactctgtgtctactggagaaagcactgcatatatcagccacagtcaatacctcgcttctgcagggacggtggctgccagagtgggaggctttggtagcacccatgtcgtggaatcacaatgttgtcgatagctctggggtcttgtacaaaatgccagatcctcccatttggtttccttatgggaaggatcgcagtactataatacatgggcttgtgcaagggatcattatacccttttctctttttttgcttttctttgagacagagtttcactctcgtcacccaggctggagtgcaatggcgcgatcttggctcactgcaacctccacctcctgggttcaagtgattttcctggctcagccttctgagtagctgggattacacatgcccgccaccaggcctgacttatttttgtatttttagtagagacagggtttcaccaagttggtcaggctggtcttgaactcctgacctcaggtgatccacccacctcggcctcccaaagtgttgggatttcaggcataagccaccaggcccagcctttctttctttttaaaattaatctttgtttaaaaatactctcattttttatttaattgtagcactcctagatcccgaaagcagatacactcttgttatgggtctgattcttttcattgcttcacgccttagaggatattgtccaatactggataaaagtttactcaggtctacttccactttaacggggatggctgaatatctcttccacttggctgttcgtttataatgaactgacaaacatacaaattttcttgagttctgtgagacattctagtaaatcatctaacctgaagagcaggttgtgagaacccctgatttagaaagcccagtggtcataaatataagtggctctggactggctcccggggtctgaagtgtgggcagtcggttaggattgagcccttgtaatttgtaggatctgacacaccctccaggaaggcagtgtcagaatttacctgtattatattggacacccagttagcggttggagaattggttgctggtatagaaaaataccaaatattttatgtcaggggagtgaaagaaaaaacaaaaacccggccgggcgcggtggctcacgcctgtcatcccagcactttgggaggccgagacgggcggatcacgaggtcaggagatcgagaccatcctggctaacacggtgaaaccccatctctactaaaaatacaaaaattagccgggcgtggtggcgcgcgcctgtagtcccagctactcgggaggctgaggcaggagaatggcgtgaacccgggaggcggagcttgcagtgagcccagatcgcgccaccgcactccagcctgggcgacagagcgagctccgtctcaaaaaaaaaaaaaaaaaaaaaacccatacactttaaggaaagcaactgacagcatttgttaccagtgataaaatttgagctttgaagtaagaataacaattttgccattgtgcccgggccaagaaaaaaaaaagaattttgccattgtgaaaggcttcccagtactttctgatgagcttgacggtgatattaacaaataactttttttttttttttttgagatggggtcttgctctgtcacccaggctggagtgcagtggttcaatctcagctcactgcaacctccgcctcccaggttcaagcgattctcctgcctcaacgtcccaagtcgctggactacaggtgtgcgccaccacgtccagataatttttgtatttttagtagagatggggtttcaccatgttgcccagactggtctcaaactcgtgacctcaggcgacccgcccacctcggcctcccaaaggtgggaggccttgctgggattagaggtatgagccgctgcacctggcctcttgtccttgtgttttgcagtgatgcaatgaccatgtcttacatttgcaaccagaaaaaaaggttagtgtaacaatgtttatcctgtttttcccagagtagacattatgaagattaaaaaaatttgaaagtgttttgaatataataaactatgctatacacacaacattttggtgactagaaatacaagtttattgtttgttgtttgttgagacagggccctgctctgtctcccaggctgggtggcacaatcatggctcactacagtcttgaactcctgggcttaagcgatcctcccacctcagcctccagagtagctgggactgcaaacgagcaccaccacgcctggctaatatttgtattttttgtagagatggggtttcaccatgttgcccagactggtctcaaactcctgggctcaagcaatgctcctgcctcggcctcccaaagtgctgggatcacaagtatgagccactgcacccggctgagtttctgttgttttaagccgcttcatttgtggtacttcttacagcagtcccaggaaactgagcaactgcagaacatcaaaattgtttttcttcagcaaaaggagaagcacttgtggttggcaccagcttttcctgtgctcacttctgcatggccgcacctttgcccgacacgagtgcacagcaggctgtgggggagcaactggttgagtcaggcctccacttgtgccgtatccccacctgctttgctggacacccctgtttggggggcacccactgctgccccagacaccaagcaagcaccagctgtgtccaaaacatacagtcactgtcttggcccgttttgtgctgctgtaacagaatgccacagactgggtaatttaatacagaacagaaatttatttcctcaaagttttggaggctgggaagtccaagagcaaggggccatcaggtcagggcctggtctctgcttccacgatggcaccttgaccaccgtgtcctcacgtggtcagagagagcccactcccaggagcccttttaatagagcagaacactgctgcgctgcggttaagtttccaacacgtgaacttcggaggtgacacattcagatcatagcagtcactctaggcagagtgtctgatgtggttttaaaatacgttcacagactggccgggcactgtagctcacgtctgtaatcccaacagtttgggaggccaaggtgggtggatcacctgaggtcaggagttcaagaccagcctcaccaacatggtgaaaccccatctctactaaaaatacaaaattagccaggtggtgcatgcctgtaatcccagctactcgggaggccgaggctggagaatcgcttgaatccaggaggtggaggttacagtgagtcgagatcatgccattgcactccagcctgggcaacaagagcgaaactctgtctcaaaaaataaaataaaataaaatacattcacaaggccgggcactgtggctcacgcctgtaatcccagctacttgggagactgaggcaggagaatcgcttataacctgggaggtggaggttgcagtgagctgagatcacaccgctacactctagcttgggcaacaagagtgaaactccgtctcaaaaaagtaaaataaggccaggcatggtggcccacacctgtaatcccagcactttaggaggccaaggcggtcggatcacgaggtcaggagttcgagaccagcctggccaacatgatgaaaccccgtctctactagcctagccaacatggggaaaccctgtctctactaaaaatacaaaaattagccaggcgtggtggtgcgtgcctgtaatcccagctactcaggaggctgaggcaggagaatcgcttgaacccaggaagcagagggtgcagtgagccaagattgcgccgctgctctctagcctgggcgacagagcgagactccatctctaaataaataaataaaataagaaaataaaatatgttcacaaatcctttgacattcctcacctcaaaagctggaacccaactccctcctaagcatgagtcttctcagtgactcacttctaacagcagatcttacatggttccccacacccagaggacattgggttcctcccaatatccccccacccagcgacccccacccaggtcgctggctttgggtcccccagagccatgtttcaaggacactcaggcagcccctggatgtccatgtggtaaggaatgaaggcctcctgcctgcagcctcgggagggagcattctcagaagaggatgccccacctcctgcccagccttcagatggccaggacctcgtccaacgtcctgactgcaacatcatgagagactccgagccagaaacccccaggttttgtactcctgacttatgggaactgacagataatgttcgttgttaattaaggggtgacttgtcacacacaataggtcactaaacagctctgtctggcctcccaggaggagcctgcctttccttttcttcatgggaaaagtgcgatcagtttgtgaaggaatgtccgcccccacttgatgccagaggctccacatggtgactgtcataaactccatctgccctcagtgccttgccagcacccggcctgcgatcagcttggtcttgcgggaggccaaggcccacgtgtgtttgtgtgtggtgtctgtgtctgcgtgcccatgcatgcccagggtacagggatgccatatacaaattctttcaatgttgtatgtggcatgtgtgtgtctgtatgcccaggatacagggatgctatatacaaactctgttttttcgtttttttttttttgagacagagtcttgctgtttcgcccaggccggactgcagtggcgctatctcggctcactgcaagctccacctcccgggttcacgccatcctcctgcctcagcctcctgagtagctggaactacaggcgcccgccaccacacccggctaattttttgtatttttagtagagacggggtttcaccatgttagccaggatggtcttgatctcctgacctcgtgatccacccgcctcagcctcccaaagtgctgggattacaggcatgagccaccgcgcctggcctacaaactctttcttttttttttttttttttttgagatggagtctcactgtcttccaggctggagtgcagtgatgcgatctcagctcactgcaagctccacctcccgggttcatgccattctcctgcctcagcctcccaagtagctgggactacaggcacacaccaccacgcccagctaattttttgtgtttttagcagagatggggtttcaccatgttagccaggatggtctcgatctcctgacctcgtgatccgcccgcctcggcctcccaaagtgctgggattacaggcgtgagccactgcgcccagcctgcaaactctttcaatgtctttcttttctctctcctgccatcttctcccttgcagatttcttttgtctctaggtcttccccagctgagtccgaggtcctgacttgcccacgctccctggactggaggagaggtgatagcaagagctccttcaagcccaggaatgccaccagggctgccctgggagaggaggaagctgggtctctcggggttgtggggaccagacacccttctaagacatggactcagcacagaaagtctagacatccactacaaacacatctccctcctaacagggggcccctgggcaccccaagtggctgtttggtgggacaggcatgtccatcagtcagaatatctttattttttattttttattttttatttttgagagagtttcactggagtgcaatggcacgacctcagctccctacaacctccgcctcccaggttcaagcgattctcctgcctcagcctgccacgtagctgggattacaggtgtgagccaccacacccagctaattttttttttttttttttgagatggagtctcgaggctctgtcgcccaggctggagtgcagaggcgcgatctcagctcactgaaagctccgcctcctgggttcacgccattctcctgcctcagcctcccgagtagctgggattacaggcatgagccaccgcgcccggccaattttgtatttttagtagagacagggtttcaccatgttggtcaggctggtcttgaactcctgacctcaggtgatccacctccctcggcctcccaaagtgctgggattacaggcctgagccaccacgcccagcccagaacgtcttcttactttttattactctgtcccccatcctgggtccagacctgtgaccgtgaacaaccggctgcccaggggtgaatggggtgagtggggtgagtccacagaacagtggggtgcagccccaggggtctcgtagcacctgcccccatgtcaggaagtcccacagcctagaggctccagcctcagatgcatacatatgtaggccctgccctttcctcctgagcggcgggccacagagtcctgaacaacaggaagcccctgaggagggctccgccctgagggagggcaggggagcccccgccagccccacccacagcagcgggccctgccaccccccaccctgacacctcaccccttggattccagagaggaaagtgggcttgtgtgtagtttacatgctcatatcttaaaatcactgttgtcaatagaacaattcataatcatgatgataaaataagatttataaccagcttcagtctggagatacacacagagcagatcttcactcccagacagggagcccgcagctgcccccgaccccacaggtgcaggacacacacagacagttcaaccatgtcttaaacacacaggtgtttatttaattgttcatttgattgaatttttaagttcactttactacgtggatgagatgggtgcatattacagtaggctttcgctatgagcgctgccaccatgaggaatatcccagccctcagttctgcttccctttctgagtcccacaaaagccagatgtggacagccttgggttcccatcccagctggctgctccttctggggctgtcttggtggggagagggagatggggcagtgggtccctgctgacccctgagccctgcaggggtcaggatcctcccgtggtccctgggtgtgactctggaagacactggcagtgcccggccaaggcctcccgcaggatggaagttgagggccctggctctgggtcctaagagaactcagccgcccccttcacactttacagcaaggggccaggcagcagctttgggatggggcttccgtggagaagtgggggatgctgcagtggtacaaagacagcctcccccaccgccatcctccagctgaccgtcctccaaggccagcactgggcgtccaagggaaagaaggaactcagcccagagggtgtgggcaggagaggcctggagtcaggcctccacccacagccccctctgggtgccaagtgggaagggtgttggggctggcttgggaaccttacccgctgcccttccaacacctggatctgtgggcagcggtcccacaaaatcccccttggggctccctgaggaggacttgtggctgccgcttccaccagggcagagggcacaggaggggccagcactccaaagggctctagggtgggtctttcaaggacatctgcaaagccctggtggggaggggcctgggccagaggctctttggaactcttgcacttctgagtgggggactgtccatgctgcccacaacctctagaccatgcagcctgctcatgggtccctggcagagaatgcccactccccagcagactcagggcaggcccccaactgcaggcttccaggaaggcccagggtgtccacctcacgccaggtggtctcagaggacccctgtgcaaccacattaaggaaagctgcagcccccacccacccgcctgccagttcaacaagcaccggctgcacacgcaggctcccaggcaccatcacccccctcccccgtcgcccctccctcatggggagccccttccccctggaaagacagcaggtactgtagcctcgcctgctggccaggggcgccggctcagaggacctgccctgacctgcacgtgctgaccagacagcccagcgtaaggacccgtgatcccacgccaccgccctgggtttaccacggtcaccgccacctctctcacagggcccccgggggacccagccgcgcccggcctggtgtctgcaccgagggaccgcgtctcacgcccggcggctcctgcaggggaagccgtggtcagcgactcaccacgaggacagggcagggcggctgagtgcggaagagaagcatgaagctgggggcgggggtgggggaggaggaacaaaagttgcatctagacagaggtgaacgaaacaaaaccaaaacccgaacgtgttctgtcgcaggatgggcgccgcccgtcccgggcccttagcccgacatctcttctcgctgctccttgttcctgcgcacctcggccgcgtgcagctcctgcaggacagggggcgggagggcctgagggcgggggtggcttggggcgactccgggaacccccaggcgcgcaggccgtggcgccctggcacccgcccggcctcatccgggctggccttcggcaggaccctgactgagttgagggggcgggagcaccggggaggcgcagagcaaggccagggaccaaggacgggtttcctgggagctggctgggccccgcttctagctcgtaccggagccgagcttccttcagggcactttcaatataatgaatttagccatctattactgcggctagttactgtcccgccaggaccagactctggacctgcctcgtgcgctgctggggacgcccagtaaacacgggaggagcccccgacccccaccccagctcagcgcctcggagtccccggccccgctctgcgcccctccgagctccgccctagccccgcccccgcccagtgccccgccccctgcctgctgctagccctgcccccgccccggcccctgcccgctccgagctccgccccggccccgccccggcccctgcccgctccgagctccgccctggccccgcccccgcccagtgccccgccccctgactgctgctagccctgcccccgccccggcccctgcccgctccgagcttcgccccggccccgccccggcccctgcccgctccgagctccgccccggccccgcccccgcaccttctcgcgcagccgctcgcgcagtgcggccaggtgtgcctcgcggatctccttgctgagctccatcttgtagttgagcttctcctccgcctggcggctgaagttgttattctcctccagcgccttgtgcagcacctcgcgctcgtgctcgcgccgctccgccagctgcttcagcacctgcgcctcctgcgtctgtgcggggccggcgggcgcgcgtgagcggcaaccccgggccctgcccggccggactcctccctgctctccgcctcccgcccagcgcccgctcgcctcacctggcgcctccacctgcccaggcctcggtgggcgccgggacccccgggcgctgccctgggaaccctcgcctgccatccggcctgtggtcggggcagggccagggggtcgcgatccgccgcccccgcccccgtccctgcctcgcgcgcgggtcccgcggtcctggctgcgcccagggcccccgccataccctgccgccactgcacaccctgccctgcgcgtctgcccctccaaggaccagcagcaagaaaccctaaacttgtgggcggtctctgagctttgtctcttcctcggacatccgcccactgagcagagtagctgcttgttacacaccgggttcccagctcccaattaggtgcccaggagcggagggtccccagggatgctgggggaggggccggctggtgacccctgggaggagagcggggcagcaggacccgcacccacatgccagtccctactagtcagccctgtgaaccctggtctctggcctcaccgggaagggaacggagccgcttcccctgcccaatgcgttggcctccagggtggcacccccaaaaggacatttttatctctgtttcagtctcagaggggctggtgggaggggaggctgcagggaggggacctggagcccacacccacctctcccagggcccctccgccctccagcaagcctcagggtcttcacacatgaggcccttcctccagcttccctgtctgggagagggatgccccacccgacgtccccagggcccatctggggaccaccccctagcatcctgctggccctgacaagggtgcctcccaccctcaccagaggctcctgctccttccaggtggccgcctcggaacccttcctcctctccatccctttctttttttgttcttgtttgttttttgaaatggagtctcaccctgtcgcccgggctgaggagtgcagtggcgcagtctcggctcactgcatcctccacttcttgggttcaagcaattcccctgcctcagactccctagtaggtgggattacaggtgtgcaccaccacacctggctaattttgtatttttagtacagatggggtttcaccatgttggccaggctgatcttgaacttccaacctcaagtgatctgcctgcctcagcttcccaaagttctgggattacaggcgtgagccaccacacccggcctctccccatcccattcttatctctcagaaagaggcccagggagccacagcccctcctgctccaggccaaggcactgaccaagcctgtccgggagcaccctgcttcttgcaggccctgtccccgtgggccgcctccgttgaaactcctggggggtgggggatggaggactccttgccttcctccgctcctcggctgcctccagccgcttttgcagctcctccagggaggtgtccttcttcttgggtggggaggagagcatagggctctctggggacaggtcagaaggggacttgaggatgacctcgaagctctggcctgaggcccgcttgtccagctgcttcacctccatgtctgcagggcaagaccagagtagagcttcagaggcccggccagggcatggcgtgggctgagcgggatgctcccagcacacatccaaccccagggctgggcgagagggggtggctgctcccgcaggaatcccaggcttcagcccccaggatgggccccttccccctagaacctccctctccagaggcagccaggacgggagttcagagagactgccggaggccgggggaaaaggtgaggtgggcaggcaccgcagggaagggcaggcggcagccaggcactcacccccgtactggtagacggtattggggtgcggctgtgtgtagaagcaggagcagatgagcgacagcaccgacagctccttcatcttctccttgtaggctgtgggcacaaggctgggctgagcaagcaccactggggcctgcccacctgggcccccgttttccctccccatggctgcctctatcatgtctctgtgagacacggagctgcccagcacgctctcttgtgtgtctccacaccgccggccccttcgtctctccagctctctcgcttccagacgtcggcactgtctccgtggtgtgtcccctgccttctgtctctctcgccctctgcctctccccgcttttcctctctctcggcattaatgtctgtctcatcttccacactgacttgtttctccatccttctcctgcctgctgtggtctgaatgtttccattacccaaaactcatgtgttgaaatcgtaaccccaaggtgccggtgtgcggaggtgaggcattcggagggaattaggccatgaggatagagccctcctaagtggccccagagtggggcttcagagaactccctcaccttccatcatgtgaggacacagccagaagacgccacccgtctatgtaccaggaggcgagacctctccaggcaccgactctgccggcaccttgatcctggactttctggcctccagagcgatgggaaataagttcctgtcgtctataaaccactcagtctcaggtacctgcccagactgacaaagtggctacccctgcctgtctgggtctctgtttaccttctgtgtgtctgactctgtcactgtcattgtatctttctgtgtctctgggggtagcccctgactctgtctttctccctgagtgcatctttctgtgattccttgtcactgtgtgtctttctgactcttacctccctctgtcccgctacttctctctcccctcctcctccttcccactcctcgccagctcaagcaggcaagatttactcatgacgggaccagcacagatgcaaaccctctgtgggcaggactttcttgggctgtaaacctggatgaagccctcagaccctcctttttccttcccaatgattgtgtggtcaccttgagatgaaaccaggccctctccaggcacatgctctctgtctatctagggctgggcttgggccactgatgccaccaaggagcaagggagggaagctgtccgttcagcaccacagccagccctcttgcccattcaggtcaatcaagtgcccaccagccagtgtccctgctgcccaacccaaaccagaagcaagccgggctcctgtggccctgtgccctgtcaggggaagaggaaggcgcctgctgtcacagtgaaaataatttagctcttttggtctattcagggcgaacctcattcctaagcagacacgctggcccggtttctcactagtgctcgataatccttttggctgggtgcagtggctcatttaactgtaatcccagcactttgggaggccaaggcaggtggaacacctgaggtcaggagtttgagaccagcctgaccaacatggtgaaacccgatctctactaaaaatataaaaattagccaggcgtggtggcaggcacctgtaatcctagctacttgggaggctgaggcaggagaatcgcttgaacctgggaggcggaggttgcagtgagccgaggtcgcgccatcgcactccagcctgggtgacagtgtgagactccgtctcaaaacagaaagaaaaagagagagaggaagaaaggaaggagggagggagggaggaaaagaagaaaggaaaggaaaggaagacagacaaggcagaagtaatcaagcctttcatggtgagctgggtcttctggtgacagtgcagagaatggtctgtcctgacttaaatttcctggtgacctacacttttctggacagagcagcacagagcccaagagggtgtaaggaggagcagaaaggaatcccagggtgggcaggcccgtgcgagagcctttgggggaaggaatgagactttgagccgggaagcgaggcaaagctacctgtcttggtcattgtcttcagggagggagatggagggggaccaggtgggggagcctcacaggggactttggtctgacttgtcaagttttctttttttctttttgagatggagtcttgcactgttgcccaggctgcagtgcagtggtgcgatctcggctcaccgcaagctccgcctcctgggttcacaccattctcctgcctcagcctcccgagtagctgggaccacaggcaccgccaccacacccagctaattttttgtatttttagtagagacggggtttcactatattagccaggatagtctcgatctcctgacctcgtgatccgcccgcctcgacctcccaaagtgctgggattacaggtgtgagccactgtgcctggcctactttattttttagaaacaggactgtgctctgttgcccatgctggagtgtagggtgcagctgtgcggttcactgcagccttgaacttctgggcttgacggatcctgccatcttagcagctgggactacaggtgcatgccagcacaccagttttctttttttttttatctctgctcactgcaattccgcctcctgggttctagcgattctcctgcctcagcctcccaagtagcagggattacacgcacatgccaccacacccggctaatttttgtatttttagtagagacagggtttcactatgttggtcaggctggtcttgagccaccgcgcccgcccggcctacacaccagcttaaaaaaaagaaaaaaatagctgggcgtggtggctcatgcctgtaatcccagcactttgggaggctgaggcaggcagatcacctgaggtcaggagttcaagaccaacctggccaacatggcgaaaccctgtctctactacaaatataaaaatcagccaggcgtggtggcgggctcctctaattccagctacttgggaggctgaggcaggagaatcacttgaacccgggaggtggaggttgaagtgagccaagatcgagctactgcactccagcctgggagcaagactcccgtctcaaaaaaaaaaaaaaaatttgtagtggtatggaggccgggcatggtggctcacgcctgtaatcccagaactttgaggggccaaggcgggcagatcatgaggtcaggagttcgagaccagcctgaccaacatgatgaaaccctgtctctactaaaaataacaaaaattagccaggcatggtggcgggcacgtgtagtcccagctactcgggagactgagacgggagaatcgcttgaacccaggaggcagaggttgcagtgagctgagatcacgccactgcactccagcctgggtgacagagtgagactctgtctcaaaaacaaacacaaacaaacatatatatatatacatgtatatatataatatatatatacgtatatatacacgtgtatatatataatatatatacacgtgtatatatattatatacatatatatacacgtgtatatatataatatatatacatatatacacgtgtatatatataatatatatacgtatatatacacgtgtatatataatatatatacgtatatatgtatatattaatatatatacgtatatatacacgtgtatatattaatatatatacgtatatatacacgtgtgtatatattaatatatatacgtatatatgtgtgtgtgtgtatatatatatgtatatatatatatatatatacatatatatatacagagagagagagagtagtgataggtcttgctgtcttgtccaggctgatcttgaactcccggcctcaagagaccctcccacctcagcctcccaaagcactaggattataggtgtaagccacagtacctagcctattaaaaattaatgttaaacaagaggatgtgatgagggagttagagggtgtgccagccatgtgttccacagcagcaggtcaggagacattggggacatttagaggagctgaagaggtggccaaccctgtgctcaggaggacgggggagggagagagcaagagggagtttgggctggggcagaacgtacctgggtcctgagaggataagaaggtagggacttggcccctccaggcctgactctgccagcaaccagctccctatcagcagactccaggcccctacccttcagctcatccttccttatcacacatccaaaactctgaatgtggccgggcgcagtggctcacgcctgtaatcccagaactttgggaggctgaggcaggaggatcgcttgagaacaagagtttgagaccagcctaggcaacatggtgaaaccccatctctactaaaaatataaaaattagctgggtgtggtggcacatgcctgttgccccagctactcaggaggctgaggcaggagaatcacttgagcctggaaggcggaagttgtagtgagcagagattgtgccactgcgttccagcctgggcaacacagcgagactctgtctcaaaaaacaaaaactggaatgtgtttaccataaaggccagaaaatgtgattaacagctgctcaaagcccctgtctgccctaagcctgaaattttcaccgaaaaaaagatctgtaggctcatacagaggaaggacaaacaccagggaggctctcttccagtttgcttcacctcagcaagcagacggctggcagcaatttgggggcaggtgtgagcacctgcatcatcaggaaagaaggggcacggtggggacgcaggtcagacctctcacaggtcttggctctgcccaggagacacgtgtccaactgagaggtgaggaactgggttctgcagctgcagacacaggtgcggctcagcatctgatggccacggagaccccctggcttggcttctcccagctggtggcccatgaggagcttctatcccaagagactgtccctcaaggagcaagtgggaccaggtacccacaggacggagcctgggagtgaggcctgccctgtggtctggctacagggaggaagggcagattggagggggcaggacagcaggtcaggaattggccaactctggagagagcaagcaaggggaagtctgcgcacagggcagggctggtcaggggcgaggcagggcattggaccagtattttcagagctggtgaggcttaaagagcatgtctactgcctcttattacagagagaggatgccgaggcccagacccatccaggccacctctccacagacacagctggtgccagggaagcccctcccagagcctcaaggcattgctccctctctctctctctttttgtttttttggagacggagtctcactctgtctcccaggctggagtgcagtggtacaatctcggctcacggcaagctccgcctcccggattcacgccattctcctgcctcagcctcccgaatagctgggactacaggcgcccgccaccacgcccagctaattttttgtatttttagtagagacggggtttcactgtgttagccaggatggtctcgatctcctgaccttgtgatccgcccgtctcagcctcccaaagtgctgggattacaggtgtgagccaccgcgcctggactttttttttttttttaagacggggtctcactctgtcacccaggctggagtgcagtggcgcgatgtcggctcactgcaacctctgcctccccagttcaagtgattctcctgcctcagcctcccaagtagctagaattacaggcacatgccaccatgcccagctaattttctgtatttttagtagagatgaggtttcaccatgttggccaggctggtcttgaactcctgacctccggtgatctgcccacctcagcctcccaaagtgctgggatgacaggcgtgagcccccgcgcctggccccccgcagtgctgggattacaggcgtgagcccccgcgcccggcccctccctctctttgactcccttctttctcaccgccccctccccaccatccttccccttcactgacttcagggagttaaaaacaattctcgcagtgagctgggcttgttttgtctccctgcttctctttgtactaaacattagataccgaggaaatgcggattggcctttggatgattcatgagcaggagtcagaaaaaggcaccaggttggcctcaagcagcagggtatagtagtgcccgctcccagggtcacacctcacgcccacccctcccgccgtccaggtggatggtgcccactcccagggtcacacctcacgcccacccctcccgccgtccaggtggatggtgcccactcccagggtcacacctcacgcccacccctcccgtcgcccaggtggatggtgcccactcccagggtcacacctcacgcccgcccctcccacccacccgggtggatggtgcccgctcccagggtcacacctgacgcccacccgggtggatggtgcccgctcccagggtcacacctcacgcccacccctcccgcccgcccgggtggatggtgcccgctcccagggtcacacctcacgcccacccctcccgccgtccaggtggatggtgcccactcccagggtcacacctcacgcccacccctcccgccgcccaggtggatggtgcccactcccagggtcacacctcacacccacccctcccgcccacccgggtggatgcccttatcagctctccttctccttctctttcgtcttcttcgtcttcctcctcttctttcttctttttttttttttttagaaagagtttctactcttgctgcccaggctggagtgcaatggcacaatctcagctcactgcaacctccctctccccgggtcaagcaattatcctgcctcagtctcccagattgctgggatcacaggagtgtgtcaccacacctggctaattttgtacttttagcagagaggggggatttcaccatgttggccaggctagtctcgaactcttgacctcagtttatccaccggcctcagcctctcaaagtgctgggattacaggcatgagccaccctatctgcctcacttctacagaggaggaatgaaggctcagagagggcaagcattccacccagcatcacacagagtgccgggtgagagcccagtcatgagcctgggcctgactgcaggctcctgttgggagctcgcggaggtgggggatctgtccagaactgagaggccaggggaccacagtggcctctgacccctggagggccctggaggctgctgccggctccccccgggggcagatggaggtcactgtcacccaggctgcttctcatggtgccaggagcacagcatggcaggagccaccagccgatttgcctttccctgggcaggaaactcagaaatgtggctaccacagtcaggctgcttgacgtgcggtgagcactcatctcttagcaggcaagcggccaagcacctttcctgaaatattgaggcctcagaacaagccccaggagaggtgccagcaccgtcatctctacccagataaggagacccaggtcctgagaggttaggcagctcggacaacaccacacagctggaggaggtcagactctgggttgcagaaggagaatgtgagcagaggccacaaaagagcgaggagccagtgcccagatgccgagatgccctcgccctcccagctcagccccaggaaccgagcccatggggagggaccgtcagggaaaggctgtcaggaagggcaggaggcggccctggagaggacggcgctgccctcaggggcaggaggggagtcccctccgctgagagcccccccacccccagtatccccgggggtgtccaggaggaggcggagggaggaagcgcagatggacaggactcccagatagggtggggaggtgtggccggtgacacacacggtcccctcctggcaggtgctgaagtcacctggagcctccaagcccgtggggcctgaggggcggggtcaggtcgggcacgcgtgggtgggcggagttctgcgccccgggccaaggcgcccgagttgaaccagtcagctcgggagagggaccgcggcgacctgtcccgggggcgtaagaaaaggtgggagggagtgcggctcgtgaacgggggcggcgatgggaaggaggtgcggcccttcgtcctgtcctcccaaacgtcgagtgaaaaacgaagcgggttctgcggcctcgcggcggagcagagcgtttcgggaagggcgggcccagcgtcctcgcgcccgaggtcgcccggcagctcccctgcgtccagaatccgccccccgcccgggcctgcgcccgcccctccgcctgagctccgcgcgggacgggccgggaggccggggtgggcgctaccttcgaaggcggtgggtccgccccgcgggaggtggaggggcgggaggggcggagccctctggtctccggagggtttggggatcgcagtcgcccctcccccatccagaccccgcggcgcaaagggcagtggcttttctggccagagcaggtggcgcgggcgtcgcaaagggtggtccccgaggccgcagcggtgtggggggagggcgcggtccccctcactccgggctccgccgtgtctggcccgcccccctccttcagcgccccctccagcccctgtgctgcactggcgcggggagcgccgggttcccggctggggctttggcagagggtcccaccctctccccgcctccccacgaaggctctggcggacccagatctcgggtcgccggacgccccagggaccccgcccgcacatcgcgagcgcgcccacccggtcgcgagcccacgcccgggtctgggagccaccctgcggcagtcgcgccctgcgtggcacgctgctcccccaggggcgaggcgcccccgcccgacgtcccggtcccgagcgctccccggcgcggcgcctcgcagcccagcgccccaccagccccgccggcgccgcagaccccagcctcgggcgggtcgggcccaggcttgcaacgcgcagggtaggagaagggaaattggcgtccgctgccggccgctgccccaggcgaggccagacgaggcctctgctcagatcccgccgccccacaaagcccgtggccccggagcctaccggaaatggtgctggccatggtgctggcggcggttgggcctgcggaggctggagaggcgcaagtggcggccggagctgcagacggctggtgctgcagtgccggggaggggaggggagaggagtggagggagcgagggcgggcgggaggcgggcgcggcgggagagagagagggagggagacagagggagagagagagagggttgggggaaggagcggggggaggagggagggagggttgggggaaggagagagagagagagagagactgcgggggcgggggaaggagggagggaggaagggagggaggaagagagagaggagcaagcgcctggctgcggaaggggccgcggctctcagggggagagggcggaggaggggggctacccgaactgcaacaagaccccccaccctccaaccgctcacagcgggacagctgcttctccaacttggctttgtgaggcctgagagtggggtgggggtggagatgagcccccattccccagggcaggcggggcaggggcaatgccggaggagcaggtcccacccatggggtggggccgcagagctcttcgccgccaaggccgctgtaggctgggctggcgccaacagggtccaggtctgtgcctgccatcggagaggatgccacagccacaggggtgggcgctggcctggaggcctccaaggggcatctcctgtgagcccaggggatgggcaggatctgagcggagaagagtgaaagtggaggagtgaggccagaacaaaggctttgccgtgaaagaggtggtttcccgcctgggctcagaccttcactcactgtgtggcccaggccaagggcaagcgtctgacctcgctgggcctttgtttctcaggggtaagatgaaacaatgatgcccccagacgatggagaggaggggtgccagggttgtgcgcacttagtgagtggggggcaacctatcctgcctccccctctcctcataactcccaaagggaaagcctggtaggcaaacggagcgtctttgccattgcagggatgaagccaccgaggcagggagaaaagtgctttgccctacaagcaactaagtcatagggccaggagcaaaaccctgaaaacctcaggagacttgcagagccatgaggctggctcagcaacacaaaagccaggggcaagcctcagctctagcagtgcggtgggagcacccaaggccagtcacatcctagggtggcctggagagtcctgacccctgacgtgcaagccggcatcatccccgggactgtgagtctggtgggggtgatgcccaggaatgtgacattgtgtggcccagaggtacccttaagactggaggatcaccaggcgggccctgacctcatcacaggagccctttaaaagcagtttcctttgcctggttgaagaaatcggagggatcaaaccaaagaaggttttctgttgttgagatgagggggccacgtggcaaggatctgagaactgctcccagccaacagccagcaagacaacaagaccttaactgcaaggaagtgagttctgccaacaagaagagaatgggcttggaggcaggtttgaccccagggcctccacacaagaactgagcccaactgcccacttggtttcagccttgggttactaagaattaggaggtaatgaatgagagttgttttaagctgttggttttgtggtgatttgctatgaagccatatcaaactaatatacacacagaggtgttggcccctgggccattcctaggaagccagctctgcgaaggaggaagaagggcagagaggcacacagagctgcccaccacagcagctgtgtcctccctgttggccaccacagtagcagttggggatggtcagcatccttcaggcagactccagccccgggtgctggagctcaggtgctagggatcaagagaagtagccctctctgggacctccagagtcttctcatgtgggtggggtaggacccacccagtcaggctcagagcaccgcaatgcctcacactcattgtgactctggccaggccctctctgagcctctgtgtcctcatctggagcacagggaccaggtgtgtggaagcccgtggcatagtgccaggaacacagtagatgtgcacagtgtgcactagcaggaacacacaacaggggtactgactgtcagcacctaggcaggcacacgcaatggggtactgactgtcagccatactgactgtcagcgtgctagcaggcatacacaacagctgtactgacagcacactagcaggcacatgccataggtgtactgactctcagtgcactggcaggcacacgcaataggagtaatgacagcatgctggcaggcacacaatagctgtactgactgtttgccccaatatagtgccaggtcttggagcagattttgacttctcaccaagatcaaatgcagaaagtgcacgagcatttcaaagatgtttttcacatgcacattagtgctagttaaaaaaatgttttgactgggtgcagtggctcacaactgtaatcccaacactttggggggccgaggtgggcagatcacctgaggtcaggagtttgagaccagcctggccaacatggtgaaaccccatctaccctaaaaatacaaaaattagccaggtgtggtggcaggtgcctgtaatctcagctactttggaggctgaagcaggagaatcacttgaatccaggaggcagaggttgcagtgagccgagatcccaccactgcactccagcctgggcaacaatatcaagactccacctcaaaaaaaaaaatgtttttcataaagtgtgacttttatcagacctctgcattcttgaaattaactctggcttggctgggcgtggtggcccacacctgtaatcttaacactttgggaggctgaggtgggcagatcacgaggtcaggagttcaagaccagcctgaccaacatgatgaaaccccatctctactaaaaatacaaaaattagccgggcgtggtggcatgcacctgtaatcccagctactcaggaggctgaggcaggagaatcgcttgaacccaggaggtggaggttgcagggagccgagatcgcaccactctattccagcctgggcgacagagcaagactctgtctcaaaaaaaaaaaagaaagaaagaaattaactctggctcctagaaggagccctatatctcagcaggacactcagtcattcaacagacatctgtcaagcacctgctgtatgctggagctgtgggtacgtcagcaattagaggaagagggcaggggtacaggagttcctgaccaccccaggccagcacgctcctatagcagctggcaaggagcagatgactcagacttcagctcagtccacaggacagccttttctggccactgctctcaggagatgagatgtgtggctgcaaaaggtaaactcctggctcctgagcaggctctgggcaatctgctcaacgctctgtgcctcactttctcacccagaaagtgtggacaatgagaggacttatctggctgggcgcggtggctcacgcctgtaatcccagcactttgggaggccgaggcgggtggatcacctgaggtcaggagttcaagacctgcctggccaacacggtcaaactccatctctactaaaaatataaaaaattagccgggcttagtggtgcacacctgtaatcccagctacttgagaggctgaggcaggagaatcacttgaacccaggaggtggaggttgcagtgagccaagattgtgccactgcactccagcctgggcaaaaagccaaaactctgtctcaaagaaaaaagaatcatggcagaaggtgaagtctatgttagtcccagttcccaggtcgtacatggcggcaggagaaagagagagagaaggggaaactgccacttttaaaccatcgggtctcctgagcactcactgtcagaacagcctggaggaaactgaccgcatgatccaaccacctccctccaggtccctccctccacacgtggggattacaattcgaggtgagacttgggtggagacacagagccgaaccatatcagcatgtatggggggcactgaaacttgtgcttggtgcccattcattcaacgagtgtgtgtggctggtctcctcatcttcaactccctgccgagtctcagataggcagcctgcagttccttcaccacaacaggcacatggggctgggtgccagtgagtgctggggcttctccgagcactatctcacacccaggagcgtgggcacgcatggcattcgcatgtgccgtcagtggacattaaacacagccatgaagaagccacgaagaagtgctgcctgccggccgtgcgcggtcacgcagcgccaactccctcctggggccttctggggccttctggggcatgggagctggggccgcctgagacaaacatccgtgacgctgggctgaccccacagaacggtgcgggcctcgctcttggagtcagccctgctgccagccagtgccgggtgctggggactcagggaggcccgccgggaccactgcgggacagtgagccgagcagaagctggaacgcaggagaggaaggagagggggcggtcagggctctcaggagccgggtcctgggcaaggcgcagccgttttcaaattttcaggaaagcggtcggctcacactcgagcagtaaaaagatgcctctggggaggaggcccgtgcagctctccgggcaatggtggtggctcggcctagagaggcggtagtggaacgcagaccctggtgggggaatgacatcaagggaggagacgggcgggaccccagatttctgcctgtgggcgatggaagtgaggttcactggccagcggagccggacacagaacgcgcaaaacgccgtgtaggcctggaggagccgaagagcaggcggaccccctccgcgggggaacagtttccgccgggagcacaaagcaacggaccggaagtggggggcggaagtgcagtgggctcagcgccgactgcgcgcctctgcccgcgaaaactctgagctggctgacagctggggacgggtggcggccctcgactggagtcggttgagttcctgagggaccccggttctggaaggttcgccgcggagacaagtgagcagtgagtcgcagtgaccctacaagtggttcttttacccgagcggctcgtaggcgcgttgcggtttttcgaaactacagctcccggcaggccccaagccgccctcggggccgcgggtcggcggattggccgcgctgcattttgggacctgtagtttcctgcgctcgtggcgctggcgccgcggcgttggctgagcccttgaccggggctggagggaagggccgacattcagtgtgtccgcgtctgttctgttagtcccagttcccgggcgggattgaggcttagagaagttgagtgatttgctgagggctgcacgggttggcatcccggcatgctctttcgctactttggctgcatctggttgcccacccgggcggatggggaatggactccagccagccaggagggcagagggctggagaggcagggccggaggttcagaccctccgctctgacgttgcgcctggtgaggccgggaggggtgccgcttgcctcttcagccctcacgctcttgtggaagtcgcggaattactgcaggcggaacttgcagcactgtgggcgtcttttccagagaaggacggagttgtggggcgggaggataaggcaaggcccagccacttcgcatcttcgccccgccagctcctcgagatgggatataccagggttgctctccaaccctctccgcaggagggactgatggaaacgcctgggaaagtagcccggtacccacaaaggctgtctacaaacagagtcttactgtctttcccaggtctgtgccatagggattctcgaagagaacagcgttgtgtcccagtgcacatgctcgcatcgcttaccaggagtgcccgagaccctaagatgttcggagtggttttttcgcacagacccgaatagcctgcccctcagccacgctctgtgcccttctgagaacaggctgatatgcccaagatagtcctgaatggtgtgaccgtagacttccctttccagccctacaaatgccaacaggagtacatgaccaaggtcctggaatgtctgcagcaggtagagcacaggccccgaggaaaggactgcgggtgggtggagcttcagccaggacggggtgtgcttccctctcccggcccattccagccaggcccctccgggccagaggcagcgtctgtcataaaaagggctggtgttccaggtggggtcagagagaggattgacaagtaaaaacgatcgtcctttgaagggggccggcccctccacacctgtgggtatttctcatcaggcgggacgagagactgagaaaatgaataagacacagagacaaagtatagagagaaaagtgggcccaggggaccggcgctcagcatacagaggacctgcaccggcaccagtctctgagtttcctcagtattcattaattactattttcactatctcagcaagaggaatgcggcaggacagcaaggtgatagtggggagaaggtcagcaagaaaacgtgagcaaaggaatctgggtcacaaataagttcaagggaaggtactatgcctggatgtgcacgtaggctagttttatgcttttctccacccaaacatctcggtggagtaaagagtaacagagcagcattgctgccaatatgtctcgcctcctgccacagggcggcttttctcctatctcagaattgaacaaatgtacaatcgggttttataccgaaacattcagttcccaggggcaggcaggagacagtggccttcctctatctcgactgcaagaggctttcctcttttactaatcctcagcacagacccttcacgggtgttgggctgggggactgtcaggtctttcccatcccacgaggccatatttcagactatcacatggagagaaaccttgggcaatacccggctttccagggcagaggtccctgcggctttccgcagtgcatcgtgcccctggtttatcgagactggagaatggcgatgacttttaccaagcatactgcctgtaaacatattgttaacaaggcacgttctgcacagctctagatcccttaaaccttgattccatacaacacatgtttctgtgagctcaaggctggggcaaagttacagattaacagcatcttagggcaaagcaattgttcagggtacaggtcaaaatggagtgtgttatgtcttccctttctacatagacacagtaacagtctgatctctcttttccctacagtccttgagggtgacagacttaggagtgccttgggggcctctctgaggagcagctgatattcacgggtcaggaggaagcatttccattagaggggcagccggtggccagcctcacttggaaggtctttgaacctcgggggtgcagggaggtggcagtggtgcaggttgccttctcctgggttccttgaggtgccctcttgtacccggctcacacccttcccctccccgagtttcctgctcaggttcccgtctgagagcttgtatgtaggacgtcagataggacagcataaatgtttggatccagaaacgcagaacagtttcctattttgagacttgacacctaattagtcatcttactatttaagctgaaaaatagtgtcgtgttttgggtaacgttctgcaaatcgtttgctaatggcggctgagttgcttcacgccctttagggcaagagtgggacttgcctgtggacttctccgcggtcccacagggctctcgccacctggcagtggcctctgcatctgcaaagagctgcccgctggctgccgaagcttgtctcagggcagcttgtgtggcctcgcctcttcctggcttccccgtaacccttgctccgaactccgttcagaaggtgaatggcatcctggagagccctacgggtacagggaagacgctgtgcctgctgtgcaccacgctggcctggcgagaacacctccgagacggcatctctgcccgcaagattgccgagagggcgcaaggagagcttttcccggatcgggccttgtcatcctggggcaacgctgctgctgctgctggagaccccataggtgaccctagttcccaggcctctcctggcctcctgtggggatggttggcaagggatggcgctgagggtggggtgggcccatggggactcctgccgtctctcaagcagaactcaaggagaattttttagctgctgtataatttctcgccatcgtgggtgtaaacctagggttgggcttttttgctgaattagggcacggcagatgcccacttcacccatttttgataaaccagtatctggggtgtcagattcttggctgtctgcagggccgagttagccgaatgccacctgcctttgatacgtgagaacgttgtctgagaaccgtgacttctgtgcttgcttgtgtctggtcagcttgctacacggacatcccaaagattatttacgcctccaggacccactcgcaactcacacaggtcatcaacgagcttcggaacacctcctaccggtgggtcagacgagtttacacctgtctcggggtcctcaagagaaccagcttggcatggtgctgagtccacagccccatgctgtgctgtggtggagggtggtggtctttctagacgctcccccgaagtgtgcagagcgctggtgcccaggggtggggtgcggcctgggctgcctccaatgcccattacttgtgaggaagcagctttgcatctgtgtgctgaccttgggcgggcgtcctgagctcctcgcaggtgctgttgtagcagctgtgcagtaggtcagggctggcccccagtgcagctttgcacatgaagtaggaggaggccctgctgcttgtcagagcccagcagagtcttggtgttctgtcgggttcctgtggccggaccagtggcagggtgctgtggaagctgtcgaatctcctccctctgtccagtacccccgctcgtcttctagctccctcctacgcccgggccacgtttcagttatgctcacttcctctgaccgccgaggctcctgcgtgtctccatacagctcacgctgcagggccacgctgtgggtgttggagacagctcctcctcgacccacggtgctctctcccaccaggcctaaggtgtgtgtgctgggctcccgggagcagctgtgcatccatcctgaggtgaagaaacaagagagtaaccatctacaggtaggctcctgggctcccgctccggctcagtgtccgacaggcgagtgctgctgggtgtccagagccccaggctgcgctcccgctgggctagggtttgaagttcactgggggactgcaggggaggacctggtgggggtggggactggcttcggtcctttcttggccgtgcttcagctgcgcactctgcccttcctcccacagatccacttgtgccgtaagaaggtggcaagtcgctcctgtcatttctacaacaacgtagaaggtacaagcagctgggtgggaccagggtcgggttggagtgtgtgcagcctctcagggtggagctcagtggtgtcacagcctggttgtgcttgcccggtggggcggccagtgcggccatgtacctgggccctgtcttctgactcggggccacccatgttagacttctgtgtggaagagctcacacagtggtctgagacagccagccggcaagactgcctctggctggtgcctggggccttggattttgggaaggctccctccatttcctgatgagagggtctccctgcacctaacctgctggtgcaaacagtaggggttttgctgaacaccggctttctcttcggggactttgttgcttgcccagcagcaggtgctccagtgaccggccctcataccatcttgggagggtgtcctggaagccgtgtctggcctcccgcgaccctgccccgtgtgtctttttcctgtgctgaccttgctgcggaaaattatggccctgagtgtgactccaggctgagtcctgtgggtccaacacgggatgccttggggcctcttctggagacgggatgtgagtgacaggagccggccggggcagcttgccctgtgactgcacgtggccacagcctgtgagggccgggggtgcttctccacccacgtggctgcccctcgggtatgtcaagggcttctggggctcatcacggggtcctagagacagtggcagggtgcacccccgttggctgcccttacagtttctgtgacctgagggtggcatctgtgcagtcggcgcggtctgtgcttctgtgggatcagggttccctctgtttcctgcctcagttggggctcaagcctcaggtgaggtggccccggagcactcagaaggcatcggcggtcctgtgggctgctttctgcactcacgtttgctgagtgctcagtgtgccaggactgaggaccctgaagctgctcttgtatttagggcggcgctcccctggcagagactgagccaggtggtcccgcatgacccactaccaggcgtttctgggccctggcccttggagggacagggtgggcggaacatgggcctgcagggaggctcccgcttactggaggcatgtgctgtgttgctggagacatcctctgtgttgcttcttgttcgctgtggtttttggtctggtggcaccaaggaccctcagtcatcttgatgtgtggttgtccaggcctttttgttggtcctaagaaggggctctgcctttgtgcccccaggttccctgacaggagctgccggctcgtcccggtgatgcctgcaggacgtgactctgggacggggggttgggcagatgtgctgatggaaattctcaagcaggcgtcatttccgaggtcctcacctggatttccaggacaggagtgcctgctgggtgtccccagtcccatgcagcgggggtccttgggatagcatggaacgctgagcatgggcctggccggccgtggtcctggacaagggcagtgccccggtggctgctgggcctgggacctggtggggacgctgggcctggtacctggtggggatgctgggcctgggacctggtggggaggcctctgactgcctcctggtgctgcttccgtctgtgttaggcctctgggtattggggcccccatctgtctcctcctccaggcctgtggactcagaccaggaagacacaggccagcccctgcctgtcccccttggcttgggctctcactgcccgacctggcgggaggttgcctagccgtgaaccttcgcaccctgtctgccaccggacaggctgtgagggggtgtctgcagcacctgcaccggcctgagcatcttcagagtgggctgcagctcctggaggggtctgagaggaagggaggcaggtattttgggcgaatgaggagacagctggagagctggcacccttcctggcctgcgtcctgtgaggactctggttggggacagcaagcttggggtcagcctggggcagagcctctgggacggccccgcccctcgtgccccttcccctcgcagctcctgtcctcgccccgccctcagctctccgccaggcaaggtttggcaagtgccgctgtgcggcagtgcctgctgattggctggtctgttgctatggtgctgcccaggggtgtgcttttcctcccctgccttccctgctatccctgggagtatctggggttgggtcatcgctggtgtgtgtgagtgtgtgtgtgtgtgtatgtgcacgtgtgcatatgtgtgcgcttctggcctctgcagctgagtcctggccctcggggggcctggcacctcctggggacaggcacaaagcagccatgatggagtcgggagctgggggaggccccattgccccacgtggctgccctgtgactctggggtgcttgttagaagaggtatctggttctgtctgtgtttaagcaactccctaaggaattcttgtggttccagtttggggggcctgtactgtagaggcaagggaggggcaggacatcccccagactctgacttctgaagccttttctgcccggggcctctccgccagtacaggcagtgtcctttgccagggctgccatgctgcagaggggagtgggccactgtttagcccaggaaaacctggctctcccttagctggaagttctgggcctgttgtggttggcagggaagctgagtgacggtgctaatcacaggggcacctgcaggggtttgtgggagatgcctctgtgggttggggcgataggctgaggggctgttcttccctgccctgaggagggctgagtgtagccgccactcctgtcctgtcttgggctgtctcggagaggatgcgtagaaccctcgggatcctgctggcctccgtctggtccaccctgaacctcaggccttctgggggcagaggaggattccctcaggatcactcgggtgggggcctctcttgggcacctgagaccctcagtgggtgctttgtggcgcgttcacggttggtgggggacgcccagccctgcccgccgtgtaggagccgttctgtcctgggcatccccctgtggtctgggacttagtggaccctgagggtgtgtgtttacccctgcctcacacctgcagaaaaaagcctggagcaggagctggccagccccatcctggacattgaggacttggtcaagagcggaagcaagcacaggtgagacccctcagtgaggccacgaccactgtccttccatggcccagctctcctgtgacctgtggaggcccggatatatttcttcacttttctttgttcctttttaaattatgaaactaaccaccattcagtacgaaaaagtttaagcagctctgaggaagatagagtaaaaaattgtctccctcttccctggccctcagccatccccggtggccaccgtggagtgtggacggagccctgcaggcctgtgtctgtgcggaagcacgcgcagttttgtctgcacagactgtcctgcagttggctgttttcactcagcgttgtgggtatagcttcccatgctggtgctggcagctcggccttgttcttttgaggacagcagatgtctcctatgtctacctcttacagcttcagagattcaagttataataaagctcttcttatattgagggggaaacctccctcccccttttttttgaaacagggtctcgctctgctacccaggctgcagtgcagtgtcacagtcttggctcactgcagcctcagcctcccaggctcaagcgattttcccacctcagcctcccaagtagccgggactgcaggcacacaccaccatgcctggttaatttttgtattttttgtacagacagggtctcactctgttgctcaggccagtctcctgagctcgagagttccacctgccttggcctcccaaagtgctgggattacaggcgtgagaccccatgcctggccagctctttttttttttttttttttttttgagacggagtctcgctctgtcgcccaggctggagtgcagtggtgcgatctcggctcactgcaagctccgcctcccgagttcacgccattctcctgcctcagcctcccgagtagctgggactacaggtgcccgccaccacgtctggctaattttctgtatttttagtagagacggggtttcaccgtgttagccaggatggtctcgatcttctgaccttgtgatccgcccacctcggcctcccaaagtgctgggattacaggagtgagccaccgcgcccggcccagctctgctttttcttagtggttctgcgttgtgtttgtttctatccaggaatagggttggttttacttttccatcgagtttttaaagagacgacgatttacatggtcggaaactcacgaggactccccatcccttggtcggaaactcacatggactccccatcccttggtcagaaactcacgtggactcccatccatcccaggcagcagcttcccacctgggccctacgtgcaggatgagggctccttccgggtcagaagacatggcggcctcggggcaccgtcccctgcatggggtgctcacaggatcttctcctctctccttcccagggtgtgcccttactacctgtcccggaacctgaagcagcaagccgacatcatattcatgccgtacaattacttgttggatgccaaggtgggggctcagtcctgtagctgacgactcctgatgtccaggggtgtccctgggcttgggaacagctgtccgagcctttgctgcttcagggccttagatcagcaggcctgggtgggaggactcacctctgtcactgggcaggggctcaacctggccagacacacttgtgagcagccccaggccacaggtcagttttctgagcagtctgggagcgggcaggctggtgggagtgaggagagacctccaggctgtggtccataggccagtgcccgctcttgatcctgacagctcaggttctctccttcacgtcaggccatgggaggcaccgagaacacaggaagcccactgactcccctcttcccagcgcgtgcccggccccacactcactccccctcccagcatgtgcccggcttcacactcactcccctcttcccagtgcatgcccggccccacactcactccccccacagcatgtgcccggcctgacactcactcccctcctcccagtgtgtgcccagccccactcccttccgccccgtgtgcccagccccacgctcactccccccgccagcatgtgcccggccccacactcaactcccctcctcccagtgtgtgcccggccctgctgccctcctccccatgtgccctgcttttgtgccccacactttttacttagtgcaggtgggatcacacgccacgggtcaatggtttgtgtgttcacgtgacgatggcgtggtgacgtttccagatcccgtcgttggttcgctcattctcggggtgtatatttattgagagctcatcatgctgggtgctattccaggcatagcaagactggcttcactcacatggagctttgattctagtggtggggacaggtggacagcaaaagagtaagcacgtgagctgatgatactgaagggaaatagagcagagggaggaggcggagaccgagccaagcgggcccaagtgcgatgtcggcgggaggtggggaatgctggtgggtctgaggggagcctcagcaggtgcagcagagcaagggaagaggtgagtgggggcggctggggggccgactcctgggaagctgtagcagaaccccacagagagctggtgaggtttgccgtggttgtgggtgactcggtgctttgagccctggctgcccctgggaaccatctggagagcttctaacccaaccaggcccctccctgggacagttatatcacagctggtaagccgagtctaacactttcacggaaacgcagaagatctaaaacagcaagatgaccgtgaagaagaacagagctggaggactcacctcgctggtttcaagactcctctaaagctgcaggagtggaggtggagatggcccagctcaggcacaggcctgcaggccatggagaaggcagcaagctcaagctgacccacacgcatgtggtcattgttttttttttcagttggaatctcactctgtcacccaggttggagtgcagtggcaccatctcggctcactgcagcccccgcccctaggttctagcgattctcccacatcagcctcccgagtagctgggattacaggcgtgcgccaccatgcctggcccttggtgattgttttttgacaaacatgccaatttaattgagagaggaaatgaaggttgatttctggttttctgaaaaaatggtgctaagaacagctggatatctgttcggaaaacagtgaatcttaactcttgttttaccctgtataaacctaaatgtaaaagctaaactaaaagttatagaaaggaacatgggggaggtctttgcaactttggggtaggcagagatttcttagtatggatacacaaggcactagccatgaagaaaaacattaaaatttagacttcaccaaaatttaaagcttcaactctgtggaagagttgagaaaatgaaaaagcagttaaagaaagggagaaaatacttctttcaaaggacttaaaaaattttttcagccctcctctgatttgaaaggacctttgaccagagtatgtaaaattctcccataactaagcaaacaacccacttaaccactgggaagggatctggacagacgtttcaccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcgccaagatgggtggaatggccagttaaccactgggagagcatccggacagacgtttcaccaaggtggatggaatgaccagttgagcacatggaaagtcgcccagcatctccagtcataggagaaggcagattaaagccacggggagccgacactgtggtcccactggcatggctgaaattcagaagccctgagtgtggcatgaggatgtggaacagctggatctcatccatcgctgtgaagttgtgtagccactccacaaacgtgtggcaaacagccgagccgggagaagggaagacgtgttcaaagattcatatgtggccaggctcagtggctcacgcctgtaatcccagaactttaggggccaaggctgggggatcgcttaagcccaggagtttgagaccagcctaggcaacatagggagaccccatctcaaaaaaaaaaaaaaagaaaaaagaaaagacttcagtgtgcaggtttaccagagttttgtttgcagttgccaaaactgggaagcagcccgcgtgagcccatccacaggtgaatggacagaccgtggtacccgaacactaacagcagccacgggcgtggactgtggtcacacagcagcagggagccgatgagtctcggacatgctaacccagagaggcccattgaggaggacctactgttttttgtgtttttgttttttgttttgaaatggagtctcgctctgtggtgcaggctggagtgcagtggtgtggtcttggctcactgcagcttccgcctcttgggttcaaacagttctcctgcctcagccttccgagtagctgggactacaggcacccgccaccacacccggctaatttttgtattttcagtagagacggcagttcgccatgttggccaggctggtcccaaactcctgaccttgtcatccactcactttggcctcccaaagtgctgaggttgcaggcatgaaccaccgcacccggctggacctactgttttattccatttatgtgacactctattaatagaaaaggcaggggtggggctggtggttatatggtgcacataactgccagaactcagtacacttaaaatgaacatcttaatgtgtgaaatttttttttttgagacggggtcttgctctgtcacccaggctagagtgcagtggtgcgatctccactcactgcaagctctgcctcctgggttcacgccattctcctgcctcagcctcccgagtagctgggactacaggcgcccgccaccacgcctggctaattttttttttttttttgtatttttagtagagacggggtttcacagtgttcgccaggctggtctcgatctcctgacctcgtgatccgcctgcctcggcctccgaaagtgctgggcttgcaggcgtgagccaccatgcccggccaatgtgtgaaaatttaaaagtaccaaagctggaccccaccccagattgctcccatgacactctgtgggtgggacctgggagttgggttttgttttgttttgttttgtttttgagatgaagtctcactctgtcgcctaggctggagtgcagtgacacaatctcggctcacattaacctctgcctcccagatgaaagcgattctcctgcctcagccttctgagtagctgggattacaggcacacaccaccaccccctgctaatttttgtatttttagtagagacggggttttaccatgttggccaggctggtcttgaactcctgacctcgtgatccgcccgcctcggcctcccaaagtgctgggattacaggcgtgagccaccgcgcctggctgggagttgggtttgtaaatctccctgagtggggctggggcagggaactgctgggtctgggtcttcctggctcctctggtctgtggcttcctgactgcggtggccgggggctcccagggcatcgtggccgtctgtcttgctgagcgtggcacgtgcctttccatgctgtggaggagcgtctcccggtatggcgaactgctggttagggtggggcggtgttgccaggtcatccaggtctggcctctgctctcgacatcgccggcgctgttgctcatctgcgcttgtgatgttcgatgcctgctgcacatgtcttggcttccctctttcccggcctctgtgagctccagcgctgcgtcccttctcttcctcctgtagagccgcagagcacacaacattgacctgaaggggacagtcgtgatctttgacgaagctcacaacgtggtgagtctccgctggcctcctaaacacctcctattgcttctggcctttttgtcaagagccacgcaaacctttctggaggggctctggccaaactcctgaagccctaggtgcccaggactggggactgagcacaccaggagcttctgccaccccctcccgccctgatccgatgcctctgctggggctggagactggccagctgggccagggacctgcccgtcaggcgcagggcccccacaggccgctcaccagaccctttccctccagccagctcggggtcagcctgggccagggctgtctcctctgccctcggcagcagcaggcttgtggtcttgcctgcagtgtctctgcccttccggccacatggcttgagactgaggcaggagaatcgcttgaaccttggaggcagaggctgcagtgagccaggatcacaccactgcattccagcctgggtgacaaagcgggattctgtgtcaaaaaaaaaaatgttgactgggcgcgctagctcatgcctataatcccagcactttgggaggctgaggtgggcggatcacgaggtcaagagatcaagaccatcctggccaacatagtgaaacaccgtctctactaaaaatacaaaaaaattagctgggcgtggtggcgtgtgcctatagtcccagctactcaggaggctgaggcaggagaatcactcgaacccaggaggtagaggttgcaatgagccaagatcacaccactgtactccagcctggtgacagagcaagactccgtctcaaaaaaaataaaatcaaaaagaataattggcaattccagtgaaataattgtttgtttgtttgttgagacagggtctccttctgtcgtccaggctggagttcagtggtatgatcttggcccactgcaacctccacctcctgggctcaagccatcctcccacctcagcctcccgagtagccgggactacaggtgcacaccaccacgcccggctaatttttgtattttttgtagaggcggggtttcccagcgttgcccaggctggtcttgaacccctgagctcaagtgatctgcccaccttggcctcccaaagtgctgggattacaggtgtgagccaccgcgcccggcctgaaacaatcgtttctaaatattggtgtgggccacacagtcatgtttggacctacttgtggccttttacagaccccaggccaaggctttgggaacttggctgtcagcctcctgtgccttctgcacccccaccccatttctgctttctggaacccccgatcctgtcctgttctgtggtgattcgggtgtgcttgggctctaggagaagatgtgtgaagaatcggcatcctttgacctgactccccatgacctggcttcaggactggacgtcatagaccaggtgctggaggagcagaccaaggcagcgcagcagggtgagccccacccggagttcagcgcggactcccccagcccaggtgcgttcatagccagactgcttggtcctgaggcctgcgctgctgcagggtgagccccacccggagttcagcacggactcccccagcccaggtgcgttcatagccaggctgcttggtcctgaggcccgtgctactgcagtgggcagcctgccctgtggctgtgtgtggtcggcctgggcaccatctattcaggctggcactgcagggcatccgcttctctcagaggcttcttgggtgtgaattcttcagggtcctgtagcctgtggaagggctggtattgttcagtagttctggtattttccaaagacctatgtcttctcccagccagtatcaacttggcctctactgtgtaaaactggaaaactctactttgtgaagctgagttgggagcatcgcttgaggccaggagtttgagaccagcctgggcaacatggcggaacctcgcccctgccaaaaaattagccaggtgtggtggtgtgctcctgtggtccaagcttttccggaggccgaagtgggaggcgtgcttgagcctgggaggcagagcttccggtgccccagatgactccactgcactccagcctgggcggcagagtgaggccatctcaaaaaaaaaaaaaaggaaaactaaatatattcactgtaagggcattttgcatctttaaatgacccacaaatctggcatgcatcagctgctctgcctgtaggttccttcccagtgtttgtccagaggtgtatttccacacagcgctagtcacggcatacgtggaaaacgtggaaacccttcatggatgttgtcagttggtctatattttctttcttttttttttttttgagatggagtttcacttttgttgcccaggctggagtgcaatggcgcgatcttggctcactgcaacctccgcctcctgggttcaagcaattctcctgcctcagcctcccaagtagctgggatcacaggcgtgcaccaccacgcccagctaattttgtatttttagtagagatggtttctccgtgttggccaggctggtctcgaactcctgacctcacgtgatccacccgcttcggcctcccaaagtgctgggattacaggcgtgagccgccacgcccggcctttgtccatattttctacatggcttctgtaaacagctgactaggagtctgtgtgaatatcttcataggttctgctgtgacactacttgctcgtgagcatctccaggtgtaaacagcatcagcttcccccattttcctttaaaatcgcacatgtggacggacaccacggggaccctggaccctggggagccccgtcctcacccttctcaccaggatggctgcttggtagagagtgagtttgcaaagttggcatttgtttagtacagaagttatcaggtgttctggctttagaatccctttatatatatatatatatacatatatttaagtgacagggtctcactctgttgcccaggctggaatgtggtggtacaatcaaagttccctgtagcctcggcctcctgggctcatgggatcttcccgtctcagcgtcttaaagcgccgggaccacaggtgtgcaccactgccaccggctctcaagattgccacgcagggagttgcagtgggggaaggggttcctgggactttgaacgctccacctccctcctctccacagtcccccaaccccacctctctaacggggtggacggccgcctctttccatccttcgcttggcgcagggtggggagagtgacaggtctccttccctcatctcggcagctgccatttcatcgcttacataacgtgggagaaacatccacccacccccaggcctgtgtgaacatcaccacggggccttctccactcttcagttttgttagttacttgatgtgcagggctttttgttgtaactagtgggggacgtgtggtggggtgggcttctgccatctcattcaggaccagaacttcagttttcatccctatctgttcccccacccctttggagatggggtctcactctgtcacccaggctggagagcggtggtgccatcacggctcactgcagcctccacctcctgcagcctccacctcttgggctcaagtgatcctcctgcctcggcctcccaagctcctgggactacaggcgtgtgccactgtgcttggcagggtccattcttttcctcacactttatttattgaagagcccaggccgtttaccctgcagagtcggaatctgtacaggaggggcagccacacgagttccccggtttactctgaacttaggtggcttgagggccccagttagactgcggccaccgtttgccgggctccagatgggacgtcctttctatcagaaggctcacagtatctcctttcccgtttcttcccatgtgaacattgttgctgctgaacacctgaatatgttaatcactgggggcttgcaagatggcagtgtgctaattccatcatctagtcagttagcaggaataacttaggaccacgccctgcaccatatcagctatgtggtgatcccattcacacaggaaaggtgggacaaatgctgggggtgggccgggtgtgctgtctcacacctgtcatcccagcactttgggaggcccaggcaggcggatcacgaggtcagagattgagaccatcctggccaacacggtgaaaccccgtctctactaaaaatacaaaaaaattagccaggtgtggtggtgcatgcttgtaatcccagctacttgggaggctgaggcaggagaatcacttgaacccaggaggcggaggttgcagtgagccgagatcgcaccattgcactccagcctggcgacagagcgagactccgtctcaaaaatcaatcagtcaatcaagtgtcatcactgaatgtttgtgtgtgaacgtggggattggtcctgccccatgctccctcctgaatctcactcctgacctcagttgctgcaccttgaggtgttttcatgtgggctcttgtgtcctgaccccggcggttgtggcctctttgctgtctgggagtcaggatttttcacactcatgtcctgctccagacctggaatcagccaagtctccaagaagccctgctttcttttcctgcaagacggtatttcaagacccgccatgcggcagcgggttggtcatggttactgggttggtcgttgttactgggtgttttcgtggagatacagccatacgcacaggtgtgttcacaaatgttaattctaaaggtcaaacacccggccaggcataagggctcagcggtaatcccagcactttgggagaccaagactggtggatcacctgaggtcaggagtttaagaccagcctgagcaacagggtgaaaccccatctctactaaaaatgcgaaaattagccgggcatggtggcgcacacctatagtcccagctagtcgggagacagacacgagaattgcttgaacctgggacatggaggttgcagtgagcagagatggcgctgctgcacccctgcctgggtgacagagtgacaccctgtctcaaaaatgaatagataaataaagataaaacacctgctcctcttggtgtctccagtttggatttggcctgtgtagcctcttccttcgcctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccctgttggtggatttggcctgcacggattctgtgtggcctcttccttcccatgttggtggatttggcctgcatggattctgtgtggcctcttcctttccatgttggtgtccttttttccatgccaggaatcctggttctcaagggcggggttgttggcacgagcgtgatgcagactgcctttgctgcctttctcttgcccagggctgaacatggagctggaagacattgcaaagctgaagagtaagtgttgccctccccgcctccttgcagctgggtggggcctcctccttgcgaggaggtgggtgacacctcctcgacccacagtgatcctgctgcgcctggagggggccatcgatgctgttgagctgcctggagacgacagcggtgtcaccaagccagggaggtgagaggcggggagccagccccttcactgcaggcccagcctagagctagaaacgggccatggtgcagtcctgggctgtcacatcacgagtgaggcctgttttcaggcctgttttccctttttgagacctgggaggagcacctgctttgcatgatctggttgctgagatgttgagaggagcagcacacactcccacgggacagcacacagccccccacggaacggcacacacacccatggaacagcacacacactcccacgaacagcacacacactcccacgaacagcacacacactcccacggaacagcacacacacccacggaacggcacacacacccacggaacagcacacacactcccacggaacagcacacacacccacggaacggcacacactcccacggaacggcacactctcccacggaacagcacactctcccacggaacagcacacacactcccacggaacagcacacacacccacggaacggcacacactcccacggaacagcagactctcccacggaacagcacacacactcccacagacagcacacacacacccacggaacagcacactctcccacgcggggccgctgggtttcctgcagtttctcctcctccaggcctttccctggaccctggtccagtccgtcatttgagcacaggtgcctgttagaacgagaccttcttgttaggacgatgagtgtcccagccaccacctcttttggactccgggaggcctggaacgttctgaacgctccgtggggctccagtcttctccgcagccagggcagcagggtttgctgtctgtcctgcaggcagatgaggagtcagggctggggcctgtgtgggggctctcctgagcgcacagccgccgaggtggagcgtgttctgcctgagcgccgacctggtcgggggaatcccagttgcttccaggtggagccactgtcctcagcgtaatgctcaaggctctggcctggctcctcggccaccctgcaccctcagggtcccctcctgtagcttctgctgccccatcactgtcactctccaaagctttggggactctgcccagagccaccgcctcccagaagcccctgacaacctcttgacgaccccctagtgaccccatccctcccctctgacggcggcccctgctctgaggcggcttcttttcctcggtgctgttctcgtgctggccaggcctcctctccccacctggaggctcctgagggcggaggcctctcacctccaatgctggcgtcccctggagggctgaatttgtttccgagggaaggaaacttccacagttgttgccttcagttccaaagctgcagcctgatttccccctccaggctcgagcctgttttcttctcggcagctacatctttgaccagtgtcgtcccccctcaggcccgagcctgccttcttctcctcagttcccaaagctgcagtctggtccccccgccaggctcgagcctgccttcttctcctcggcagctacatctttgagctgtttgctgaagcccagatcacgtttcagaccaagggctgcatcctggactcgctggaccagatcatccagcacctggcaggacgtgagtgctggcacggggtctttggtgcgggcaaatgtggcgtagggggtgcagcaggcctccatcttggcagtcagggctcccctggccgtcacctggccgtcagcaggaacaggcccacagaacctcatcttctgatcggggcgtggaggcgttagtgccacttgccagctgccgtagagcctgtcccagttctgcagctggcggcttcgtcctacagcctcatcccattattctgcttttgagaaagagcagcccaaggccctagctggcttgtggggcctctggcttctccacaccaccccgagttctgcttctcagagttgtggggtccagaggctttgcccagaggcggtgtccccatgggctgctctggtttgagacgccgggcccagcggggtctctcctctgctgcgctcccgggtgctggggagggtggcttttgctgcttcaacccttaggcgaccatagagcctcttttcaagtcccactgacccccttggagactctgtccctgcctggcttctctcctggctgctgggaagagcaggcgaactgcccgccctgaatggatgctgcgctccaccctgggccccccattgggcaggagatggagcttggcagtcgggctgagcgggctcatgctggaagggccggggctggggtcggggcctcccctgcctgcagtgtgggtgtcagcgccctgctgccctccaggtgctggagtgttcaccaacacggccggactgcagaagctggcggacattatccaggtggggcctgctcctctgtggcatctccttccctgatggaagccgggcgggtgccttctcctgctgtattagttaactgattctagacttggggatgggagaaaggcccctacaccacctgtttctgattggcaaactctcggctcctttccagtgccctaaacccacactgggcctcctgcagggatgggggaggacgaggtctggtggcacatgcccagggtgatgctggtgagggaggacgcaaaggacagtgggggccggggagccgctcctgccctgtccgggccctcaggccaggggggacccactgctggcagccccagcagccccagctgcacgcagatgaagagctctggacacacgcggcttcctgaacagcttctccagggacagacaaatggggaccctgcaggttcccggcaggggtgtccctgggagcccatgattgggggtgcgaccctggcccccttctcattggccccgtcctgtcctgcaatgcccgtcccatgtgaggtctgcttctggctccatgcctatggcagcacctgctttccctggcgtagaggtgcttgtccggtttgtggagggcacgccccattttgggtgctctgggcacgttgcctctccggggcctcggtggcttttttagaagcagactcagaagtccctgactggggaagccaaggcacaggtggctgtgtggagccctgtgaggcctcctctgtgctgcccacgctgtacctgctggccacacgagatcatggcagggttaggcagggctgcccagcgctatgacagcttcatgagtgtccatctggcctgtggggtgcttgagctgggggaggccgcagaagaaccctgggatgcatggctggcctgtgcatgctgctgggcatggagctgcagatcccggaacaagcaggcactgccttctccttcacagacgcagctctgagcgggggcgagacctgggcagggaccaggtggggtgggcacagggtggtggggcccaggctcagccctccctccactgtggccgtctctgtggccagtgacgccacagcctgtgtcttctctgtgcggtagctggggctggaaggacagcactgccttgtcctcccaactcctccccaaaggcacggtgggcatcccaggcccagacccctctgtctgtggctcctgcctgccaagggctgctgtgctgtcccgcatggagtgtggttggctcttcaagcaggaggccgtgcacctatcaggcggacctgcttccatgtccctgatgggtcactgcaaagcacctccagcacatggccaggcgaggtagccctgcagcccagggcctggagggcaggtgtgagctggcccgggcctgtccctccctggaatacagcttcccaggctcccacttatggagaagtctcctccacactatggaactgaatcctagaatgtggcttctgaggttcctacactcgaactgaatcctggaatgcggcttccaaggcttccagctatggagaagactccacactctggaaccgaatcctggaacgcggcctcccaggcccccagctatggagaagactccacactctggaaccgaatcctggaacgcggcctcccaggcccccagctatggagaagactccacactctggaaccggatcctggaacgcggcctcccagcctcccacttaaggagaagtctccacactctggaaccggatcctggaacgtggcctcccaggcccccacttaaggagaagactccacactctggaaccgaatcctgcacactccatcggtttggaatttcctttggctgctgctctaagtagccgctggtggatgactcagcttctgccagccctcgggtgcctggaggatgagggactgcacacagtgctcacccgcgttggctcctgagcccctgcaggtgtgggcggtgcccatagggctggtgctgggttgggcctgcagccctgagtcacaggtgaccctgggggcagagtggggccagtggccccaggaagaggatgtgggatgcacagctcagctggaggcgaactccaggcagggtcaggccgtgtgctcggaagtcagggcttagctggaggcaaactctgggcagtgctggcccgtgttggggaaccagttgcccctgggcccccgtgagactgctgggtcctcatccctctctgcctgaggccggagctgccctgggctgaggcacagggggatttgtggtggtgtttttttgagaaagggtctcgctttgtcaccccggctggagtgcaggggcttgatcacagctcactgcagcctcaacctcctgggcccaagtgatcctcttgcctcagccacccgaggagctgtgaacacaggtgtgcaccaccgcactcagctaatttttaaaatttttttgtagagatgaggtcttgccatgtttcccaggctggtctcaaactcctgggctcaggcagtctgcccgccttggcctcccaaagtgctgggattacaggcaagagcttccatgcctgcccagcagaaggcttttcgaaggaagctgtttcctgaggcagactcagccctgctcatggcagccaccagcgtgggggtgaacttgttctgttacttccatccccgtgggccaaatgctttggtaaaacacaaggccctgtgtttagctgtcttgacagtgaaaatggctgggaaggaaggaaggaacggaaggaaatttctctctccttctgtgcgtacccaggcacgtgcacatgcatgcagagtacgcacacacgcacgcacgcctgcacaaatccacgcatgttgccaagtctctgtgttccagccgtggtgtctgccccccggtgttctctagttcggcttctccgcatttctgtgaatgattccggcttcttggtgttcccagcagaactccctcaagtctgcggcggggctctgacggcggtggcttggctgacatggccacattgctgagcctgttgggggctttgcgttcctgttctggccgtttttggctcgttttccaggaacggtcgtcacgcgctcctctcctagtgcaggcatcattcctttcccattgatttgcagggttctctgtaagttctgaggatcccatatacatatactctctgtaagttctgaggatcccatatacatattctctctctaagttctgaggatcccatatacatattctctctctaagttctgaggatcccatgccgacatacatattctttccttgtctcatgctggtcattttttccattttcatgacaggtttggtgaacacatgtttccttgtcagatttttgttctgagcttgtgcctcccgaccaagatgctaaaccgggtcttgtgtattctccaaactgcactgtagagtgacggagctttgtgtctgggcctccatgccttctgacgtcacctgtgggggtgtgaaaggcagactctaccttgatttttcccagcacgccacaccggtggttctgtgcgctgaccgagcggctcggcttcccccaactccactgggcacctgccacacttttcctcatgtttttgttcactgtggttttgtcgtaagtcctggtgttggcctgaaccaatttctttttgtttgtttttgagacagagttttgctcttgttgcccaggctggagtgcagtggcgcgatctcggctcactgcaagctccgcctcccgggttcacgccattctcctgcctcagcctcccaaatacctgggattataggcacctgccaccacgcctggctaattttttgtatttttagtagagacgaggtttcaccgtgttagccaggatggtctcgatctcctgacctcgtgatccgcctcccaaagtgctgggattacaggcatgagccaccgtgcccagcctgatatttttagtagaaatggggttttgccatgttggccaggctggtctcgaactcctgacctcaggtgatcctctcaccttggcctcccagagtgctgggattacgggtgtgagccaccacgcccggcctcttgttcttttgaaacctgccctgacgttttttccatagtgcatcttggagtcagcgtgtctacttcctgtaaaaatcttactgtgattttgactagaatgtgttgaattcctgttttttttttgagtcagggtctctctgttgcccaggctggagtgcagtgggaccatcacagctcactgcagcctcaacctcctgggctcaggggatcctctcagctcaacctcccaagtagctgggaccacaggcacatgccaccatgcccggctaggtttttttttttttttttttggtgaacaccctggggttgcaccatgttgcccaggctggtctcgaactcctgggttcgggcagtttgctcctctcagcctcccggagtgctgggattacaggcctgagccactgcactaggccatgttgaatttctagattaatttggggccctcaggggcacagagaggagggctgggccagttggcgggaggagaggcccctcgggctgccgcattttcagtgcatggagatggcctatgttgggggaacacagagctcaccgggggtccctgcagggaggagaaagggtcaggcaggtgccagctcctgtccattggcctggggctgcatgatggcaggggccggtgaaccgatgacccctgggtgtcctgtgaccttctgtgtatgcggctgatgctgcagaaagtcgggtggcctcaggctcctgacggggctgcacttcctctgcctttcagattgtgttcagtgtggacccctccgagggcagccctggttccccagcagggctgggggccttacagtcctataaggtaggggccacctccaggaggcaggtggagggcagcccttgttccccggcagggctgggggccttacagtcctataaggtgggggccacctccaggaggcaggtggggctgggggtcttctggtcctaaaaggtaaggggctgcccccaggacatgggcggggcctccacactcctggtcctgtcccctccaggtgcacatccatcctgatgctggtcaccggaggacggctcagcggtctgatgcctggagcaccactgcagccagaaagcgaggtacagacctgggcccacacgctccccgcccgcccgggtgcagtgcccggcaccaccatgccacaggctaggcacatgcccagccgtggatctcctgcccccatgggcctggccaccttctccatatccaggccaatccagagcattctcctcactgtccctctgaagattggagttactgagagacgtaggagatggcctgatggcaccgtgacctgcccagagtcacctggttggtggtggcagagccacagcccagccaggcctccctgctgggacacgctcgtttatgccgaggccgtcagcacagagcctccacagtgaggcacggctctgcctgctgcctccacgcagcgcctggccgggccaagcctcagggtcacatctgaagggggcccggctggccctgttgtccgaagcccctggtgcgctcagccccgaggccccacgtgccttcttggcttcctgtgctccgtggcgtcttcgagtcggtgctgccggggacgctgtgtggatggggtctgtgagtgtgccctcggctccgtgtccggagccctgtggttcttggggtgtatctggccccacccccactgcgtggtgtccagggtggggcttcacggctgcagctgcgggagctgctgcccctgccttgtgctccagtggggccttgcctctgggcttggttcgtccctctctggaacattctttctcagctgctgtccgacccatggtggcatgacgtggccctggctgaagcagcccttgtgcggttgctgtggttgggtctgcctggccgagccggaagggaagggctgggagggcgtcagggtggcgtggcttgacccccgctcggtgatggtcctgcagcaaggcctctcccagcaggaagcgtccatcccggggggaggccggcgcccctcacgcagttggggttgcgggaggcagtgcgtgcctgaggcagccggtgcacagattccaagggcctggaatctgtttgttccattgacctctgatgtcacttgacttctcagaagcagccactccctgcactgggcgtttgtaggaaatgagctcctggaggagggggtggggaagttcccccattgcagggcacactcagccccaggaaggaaacgtgcctcgtccctgctgactccgaatcgcagtcagagtcgttctgcttgtgccgtgttgaattcccggcatccggcatccagactcagcctcctccccaggccacggccgccgtggccagtcggtcaagcccttctaggaacttcctttgagctggcgcccttgttcactgctgacgccactcagaggcttgtgcacgtgtcctgcttccaggcagagctgggaactcgcaccccgtcttctgcacgcggccgtggaatgtcgggatgccggcgcttccttcccgtgtgctcttggcggggtgggcttcttgccctgagccgcatgtcacagtttctgcagaagtttagggttggagtgggctgacctctctgcaggtgtccccagcctctgcctggggtctgcctcctactcccaggaccccctgtcccccagaggggccccaagctggcaggctcacactcagggcagcctcctttgttctgacttctgcacagtgggcctgggtggctgcccgcggctcgcttgcttgatgccagtgggtggagagggtgatgggcagagaggcaggtggtcaggcccccagtcccgtcctcacactctgtgccctctgccgccccccgccccacagggaaggtgctgagctactggtgcttcagtcccggccacagcatgcacgagctggtccgccagggcgtccgctccctcatccttaccagcggcacgctggccccggtgtcctcctttgctctggagatgcagatgtacgggccacccctgccagggcctgagcaccggtgacacctctgacatcagcggggtggaagtggtgggggtccccatgagccgggtgctgggggtctcgggcctcgagggctaaaggggtgctggtgcacttccccactgtctgctccctctggccacgctcagccctttcccagtctgcctggagaacccacacatcatcgacaagcaccagatctgggtgggggtcgtccccagaggccccgatggagcccagttgagctccgcgtttgacagacggtgagggcctgtccctgggccctgctggggtgggaggtgggggagcactgaggcctgaggtcctgagcagtggcctctccggctctaggttttccgaggagtgcttatcctccctggggaaggctctgggtgagtgccctgaatgccccagctgtgcccatcctggatcctggacccctgctcccaagagctggtagggaaccctgcagacatcctgcccctgccttgaccccggcccctgcacttccaggcaacatcgcccgcgtggtgccctatgggctcctgatcttcttcccttcctatcctgtcatggagaagagcctggagttctggcgggtgcgtctcccctgtgttctgggcggggtgggtgagggcagggctggagcatgaagcaggcagtggtcacagctcctgcttgccctcatcggatcggcggcgtgaccagggctgccgtgtccctgcctcttcctcccacaggcccgcgacttggccaggaagatggaggcgctgaagccgctgtttgtggagcccaggagcaaaggcagcttctccgaggtcggcacttggccggggctctgggcctgctgccccctcgtgcctcccctgcctctcacagcttccccaaggctgaccactggccctgaccatgggctccggcggctcccgctgcctcttcagggctcctgcgtttccttcctggccctgagtgttgcctcttatcttacaaagcccccagcaccgggtgggtgtggtaacagtggccctcctgtctgagtagccctagtcggccaccctggccctggggttccccgtgttttctgggaagcactgagcaggcgtggggtcagcctgggatccgtgccaggaagaagcttccagaacccgattggccttcctggctaggacgatccttcatcttggagcatgagacctgggtctccctcatgggggaggaaggggctgggggggggctccaggctcagcctcaccaactttccttccagaccatcagtgcttactatgcaagggttgccgcccctgggtccaccggcgccaccttcctggcggtctgccggggcaaggtgagctctccagggccctctgccctgacctggttgcctgttccctggtgggtgcttatggctccccagcagactctgggccctgggggctgcccggtcccctccttgggtcccacgagagcgactgctggccctgctgggagcgtgtcctgctctgggcctgggcaggcaggatgggagtttcctggccacaagagttggaggtggcgtctgggagctgtggaccccaagtggggtcctgacccacagatggagcttcctcccacccctggttggggacggagcctcggggaaggtggctgggctgggtgtgggcaccagggagaggagcccccacggccccaggcagctccctggtgtgtcccctaggccagcgaggggctggacttctcagacacgaatggccgtggtgtgattgtcacgggcctcccgtaccccccacgcatggacccccgggttgtcctcaagatgcagttcctggatgagatgaagggccagggtggggctgggggccaggtgagttacagcagggtggggctggggtaaggcggtctggtgactgagcccccgccccgtggccaagggagcccccgtgaccgagccgcctcgccccacagttcctctctgggcaggagtggtaccggcagcaggcgtccagggctgtgaaccaggccatcgggcgagtgatccggcaccgccaggactacggagctgtcttcctctgtgaccacaggtgcgtgcagtccggtggcaggcgcggcgccaggggacacgcccacaccccactgggcccctggactctccttccccacatgaggccccgtctcctccagagcctctccggctactcggggtcagcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatggttctgcagatgccagcgccggccccccgggctacagcacccagtgtgcgtggagaagatgctgtcagcgaggccaagtcgcctggccccttcttctccaccaggaaagctaagagtctggacctgcatgtccccagcctgaagcagaggtcctcaggtgcggacgggcagcgctgggtgggcggtgtgggggtggcggagcgggcggcgtggggcgggcagcaccaggcgcccagggcggaggcgactcacctggctttgtgcgcttcccctcccacctccaaaggctgcctctccctcctagggcagggcccccacgggctgcaaccctcccctacaggcagagaacgccccaggcaaggatgccccccgaggctgagactccccccaatagcagggaggacacccacaggcaggaccccaagtgctgggactctcccccaagaggggctttgccacaggcagggaccccagctggggccccccgtgggcttcactgcgcactcgggtgcccctgcagggtcaccagctgccggggaccccgagagtagcctgtgtgtggagtatgagcaggagccagttcctgcccggcagaggcccagggggctgctggccgccctggagcacagcgaacagcgggcggggagccctggcgaggagcaggtacagttccagggccttgggatggacacagaccctctgtctcctgaggccaacccgaccccgcccatctggcctcaggcacctccccacacacccctgtaaatcccctgcctggcaggcaggcgggcaagcgggcgggggatcccagctgcctggctgtctgtgggtcctccaccccacctcacccacaggctgctggctcccaggtggtgcatgccctggccctccgcgggtgccccccacatcactttggttctctggcgggtcagcttggctcagtgcactcaaggtcgggtgcccctgccactggctgcgcttgaggctggcctttctccaggaatgtgctgcgggtggaacccaggttccttcttccttggggccttttgccccagaagcccataattcctcaggccaacccgaaattttctccctgcttcctgctgggagccattcccctcttcctgcccatccctgcccttcaggcccctggagtgagctccaggtgcaggcaccaggcacctgtgtccccttcctgccagcccctcgctgtggtcggactgtcttccctggacctgctcttacaagtcaccacctgcgagcctcatgagccgctggtgtgacttggacaggaccaagttgtggcactgtcaccggggtgtgctgtgcccccctcccccgacctccatcttggctcagggctccttgggaccatcttccctgtgcgtccaggtgctttgggaccccagagtgtgtggttggggtctgtgtgtggttgtgagctgtgtcctcctcaggcccacagctgctccaccctgtccctcctgtctgagaagaggccggcagaagaaccgcgaggagggaggaagaagatccggctggtcagccacccggtgcgtgagctgtccctgcacctgtgccgaccaccatagacacgcatgggaacgcagccgtgggtgcccccagccacggctggtcccgatgggaccagggaatccacccccaggagctgatgtccagggcagctgtgatgctgacggccaggggctcaagtgtgtggtttcttctgcagggggctcatgagtcccagctggaatcaggccccacccttgggcaggtttggcatggggcctgcagcactgggcttggccctggcatttccctcaagtgtggatgcacacctgcctcatgtgagggacacagcccattcctagccttggatcaaagaacggagttatagccggagccaggaagccccctgcctgctggaaaaccccaagtgtggcggcctttgtccatgtcccttggcttctgggaagaactgggtggtgcccaggcagggctggtgccatcaggaagtgggtggctgctgaggggcctgggctggcgagggcctgggtggggagtgcctgggccgcccctgccttggtttccacgtttccgtgttggtctggggtgtgtagagagatgggcactgctcatccggaagcccctccttgtgcgctgccatcctgggagcctcagccgcatccgctgtggggcagggggcttgagggaggaggagagagacgggccatgcaggacccctggcttgaggcagagccaatctaccctttgcccattcactgctctcagttccctgccagcctctcactgtgtgacctcagacgggcccagccccacagctttcttcccgcagcccctccctatgtccatccagccagccagtttctcaggcagcagccccacctcggcagtcactgtcccagggaacgctcaatgttccaaggaaggctctgcagccccagggaccagatgatgaggctggccctgatggagcctcgggcctgtgtcctgcaggaggagcccgtggctggtgcacagacggacagggccaagctcttcatggtggccgtgaagcaggagttgagccaagccaactttgccaccttcacccaggccctgcaggactacaagggttccgatgacttcgccgccctggccgcctgtctcggccccctctttgctgaggaccccaagaagcacaacctgctccaaggtgccctggcttgcagaggccacccaccctgagggcagtgctgccgccgcgtgtggggtgggggccatctgggtccaaggtggtctctgttctctagagaaaaaggggcagatggggacagacgccccttcctctacaggcttctaccagtttgtgcggccccaccataagcagcagtttgaggaggtctgtatccagctgacaggacgaggctgtggctatcggcctgagcacagcattccccgaaggcagcgggcacagccggtcctggaccccactggtaaatggggccccaggtgggaccctcagactcctgcgtggaaggcagtgtgggccagagtcctgggctgcttggggtgggcatcctcgggccctgcttggccccgcctctctgttcccctatgggagtgatgggggcctccacctccaccaccagcaccagcagcaccacctccacctccacctccacctccacctccaccaccacctccacctccaccaccacctcctccaccaccaccacctccaccaccaccaccaccaccaccacctccacctccaccacctccacctccaccaccaccacctccacctccaccaccaccacctccacctccaccaccacctccaccaccaccacctccacctccaccaccacctccaccaccaccaccaccaccaccaccaccaccaccaccacctccaccaccaccacctgcaccaccacctccacctccaccaccaccaccacctccacctccaccagcagcagcatcacttgttggggagaccctgtgcaactccatgcacagccctgtccctgccatagccccgacccctaagcacagccctgtccaactgccacacgtcccctgcctcccatgcatggtcctggggggtcaactgcacacgccagggtcctagggtcctagacccctgtcctccctgtttctgcctctgtttggggtggagtccaagtctccagaggcggaagcatctgtgttcgtgtgttaatgaacagcccctacagagttcccctagttcacccaggggggaacctagcctgttgggacgaccccagatcccttctgggcttggtactcactgggatatcctcatgcctgcacccagcctacggctctgagctcctgagtggggctttggcctgcccgccactgttccagcccccatccagcaggctggtgtctcctctgatgcccccagcacccaggcgtgtacctgcctgggttttcccgccctggtctgaggtgggtgaggcctggcctccctagccagccctgcccccccaccccagggaactttccagatgctctcgaccagctttgtggctctacatctcttcatcaggaagaacggcgccggatcccaagctgaccgtgtccacggctgcagcccagcagctggacccccaagagcacctgaaccagggcaggccccacctgtcgcccaggccacccccaacaggtagctgactcctgaaccgtgtgcagcctacgacttggtgggtccctcagtggcttcacgaggctaactcttgagtgtggccggggctgcccctgtggggagccatctcatggtggggactgctcccggttctgcaccccgcagttgtcctgagcagctctccaggagttcctggaggaagggcgggcagggcggtgggactctcagtcctccaccccagcgccactctgagccatgctactcccacaccaggagaccctggcagccaaccacagtgggggtctggagtgcccagagcagggaagcagggccagcacgccgtgagcgcctacctggctgatgcccgcagggccctggggtccgcgggctgtagccaactcttggcagcgctgacagcctataagcaagacgacgacctcgacaaggtgctggctgtgttggccgccctgaccactgcaaagccagaggacttccccctgctgcacagcaagtggccctggcgtggggaacagccggtggggtggggggcaggggacaaaatgggggctgtgccgggtctgattgaagctccccgcagggttcagcatgtttgtgcgtccacaccacaagcagcgcttctcacagacgtgcacagacctgaccggccggccctacccgggcatggagccaccgggaccccaggaggagaggcttgccgtgcctcctgtgcttacccacagggctccccaaccaggtagggcacctgcctggctgctcctggcagcgccccaaccgcacgcagccctgggagtgagcagcaaagccccaggcccccctcagactcaagtctctgtctccaggcccctcacggtccgagaagaccgggaagacccagagcaagatctcgtccttccttagacagaggccagcagggactgtgggggcgggcggtgaggatgcaggtcccagccagtcctcaggacctccccacgggcctgcagcatctgagtggggtgagcctcatgggagagacatcgctgggcagcaggccacgggagctccgggcgggcccctctcagcaggctgtgtgtgccagggctgtggggcagaggacgtggtgcccttccagtgccctgcctgtgacttccagcgctgccaagcctgctggcaacggcaccttcaggttggtgcctggccactacagttcctgctgggtgtagccccaggtgatgggctgagggggaaagggcaggcccttgtcctggtggcaacgcctggcagacgtgtgcagtgggccggttgtctcacaggcctctaggatgtgcccagcctgccacaccgcctccaggaagcagagcgtcatgcaggtcttctggccagagccccagtgagtgcccacggaggcccccagcacacccaacgtggcttgatcacctgcctgtccagctctggtgggccaagaacccacccaacagaataggccagcccatgccagccggcttggcccgctgcaggcctcaggcaggcggggcccatggttggtccctgcggtgggaccggatctgggcctgcctctgagaagccctgagctaccttggggtctggggtgggtttctgggaaagtgcttccccagaacttccctggctcctggcctgtgagtggtgccacaggggcaccccagctgagcccctcaccgggaaggaggagacccccgtgggcacgtgtccacttttaatcaggggacagggctctctaataaagctgctggcagtgcccaggacggtgtcttcgtggcctgggcttggtggtgggagttgagggacagggagttggcagaggcccctcccagcctgccatgtgacactgtacttcctccacggtgggctcagccctgccctcatcctcacagccgcagccaagctgcagttggtaggggatccaccgacacaccaggctgcctgggctggtctctgggttgggagctgccccaggtgctgaggagggcagctccctggctggtgaggcccctcccagaaccacccttggactgagctctggggagggatggtaccaggtgggtgaggggggctgcctggggagggaggggttcctatggggcgtggcgaggctggcccagccctctccccgcccatatatgtagggcagcagcaggatgggcttctggacttgggcggcccctccgcaggcggaccgggggcaaaggaggtggcatgtcggtcaggcacagcagggtcctgtgtccgcgctgagccgcgctctccctgctccagcaaggaccatgagggcgctggaggggccaggcctgtcgctgctgtgcctggtgttggcgctgcctgccctgctgccggtgccggctgtacgcggagtggcagaaacacccacctacccctggcgggacgcagagacaggggagcggctggtgtgcgcccagtgccccccaggcacctttgtgcagcggccgtgccgccgagacagccccacgacgtgtggcccgtgtccaccgcgccactacacgcagttctggaactacctagagcgctgccgctactgcaacgtcctctgcggggagcgtgaggaggaggcacgggcttgccacgccacccacaaccgtgcctgccgctgccgcaccggcttcttcgcgcacgctggtttctgcttggagcacgcatcgtgtccacctggtgccggcgtgattgccccgggtgagagctgggcgaggggaggggcccccaggagtggtggccggaggtgtggcaggggtcaggttgctggtcccagccttgcaccctgagctaggacaccagttcccctgaccctgttcttccctcctggctgcaggcacccccagccagaacacgcagtgccagccgtgccccccaggcaccttctcagccagcagctccagctcagagcagtgccagccccaccgcaactgcacggccctgggcctggccctcaatgtgccaggctcttcctcccatgacaccctgtgcaccagctgcactggcttccccctcagcaccagggtaccaggtgagccagaggcctgagggggcagcacactgcaggccaggcccacttgtgccctcactcctgcccctgcacgtgcatctagcctgaggcatgccagctggctctgggaaggggccacagtggatttgaggggtcaggggtccctccactagatccccaccaagtctgccctctcaggggtggctgagaatttggatctgagccagggcacagcctcccctggggagctctgggaaagtgggcagcaatctcctaactgcccgaggggaaggtggctggctcctctgacacggggaaaccgaggcctgatggtaactctcctaactgcctgagaggaaggtggctgcctcctctgacatggggaaaccgaggcccaatgttaaccactgttgagaagtcacagggggaagtgacccccttaacatcaagtcaggtccggtccatctgcaggtcccaactcgccccttccgatggcccaggagccccaagcccttgcctgggcccccttgcctcttgcagccaaggtccgagtggccgctcctgccccctaggcctttgctccagctctctgaccgaaggctcctgccccttctccagtccccatcgttgcactgccctctccagcacggctcactgcacagggatttctctctcctgcaaaccccccgagtggggcccagaaagcagggtacctggcagcccccgccagtgtgtgtgggtgaaatgatcggaccgctgcctccccaccccactgcaggagctgaggagtgtgagcgtgccgtcatcgactttgtggctttccaggacatctccatcaagaggctgcagcggctgctgcaggccctcgaggccccggagggctggggtccgacaccaagggcgggccgcgcggccttgcagctgaagctgcgtcggcggctcacggagctcctgggggcgcaggacggggcgctgctggtgcggctgctgcaggcgctgcgcgtggccaggatgcccgggctggagcggagcgtccgtgagcgcttcctccctgtgcactgatcctggccccctcttatttattctacatccttggcaccccacttgcactgaaagaggcttttttttaaatagaagaaatgaggtttcttaaagcttatttttataaagctttttcataaaactggttgtagttgcacagctactgggagggcagccggggacacctgagccgcccgctgtgcccagatccctcaggctgcctgccatcagaactgctgcccggggcttcccctacctcagacagaccctccctgggaggatcagtggggagtgccacctctgcccccagtggctgtggcacgtggcaggggcccctgaagctcagcgagggtcagggcctgggagggtatcattgctggaagaacaggatggggctcaggccagccctagtcgccggggcccacactaaccccccacttatgaattcctcccactcccaactcacaggggatttcccgagaggggacctgccaaagacctcctccaggcctcccatgctttccgggaagtgaagcttctccctctctggggcaggctctgaagcctcccgatgcacccagagcaaccggggggctgcaccagccactcgcctccccagcacggccaggttcccggggctggaggtcccccccaggtcctgggaaccaacctgcagaacacacacagggtcccctggagaggacgcggggacttccagggcccgactcctgtgagtcacagccccgcagctgctgcgccacccccaccctgactcatgccccttcccagcagctcctcccaggaccccatgtccttcccacatccgcaggaagggagtgcctggactctccaggcccacctggggagcccctcacctgcccaccagcccctgagcagcccagtaacaccatcaccgtgtccaacagccaggagcctccaccctccaggagggaagggatggacagagccacactcgccgtctttattttgcactcaccctgggtgacactgggcaggccgctcctgcccacagccagactgaggaagaacacagcactcggcaggcccagtggggtccgtgcagggaggaccccaggaccagccttactcccgagcaggggacacagggccccacagagaacccctccgggaggttctctcctggctgggggagggctctggacccccacaaacactccccaacttgcggggctggggcataaaaacagccactcccagcaggccccctcagctttttgcatcagtcagctccctcccgggggattagggtgaggtgaagccaggcccaggcgtggggtataggtcttcccccgcaggcctcagccctgtcccgaggctgcatcacaatccagggcccccgctggcctttgggaacatggcctgggtcttcctcaaggcaagatcagccccagaccacttcggggtcacggggtcacggggtcacagggcagaagccagatggcagccatggctgacgggcctcctcctcgatggggcggagacagccacggggtctcccgagggtcccacagggctgtcctcatgcagcccaagccagcctgagcactggagccccaattcccaaccaggtctccctcagaccccccagaaagggcctcgaaaggccgccgctgcgccctgtggaaaggctgccgctgcagggcctgggccagccgggctgccagactcccctccaaagcctccggatgcctacgcttttccagacatagaggaaagtttgtcttcgagaaaacaaagtaaatagaagaaccccaaagcaaagcaaacccaccccccagatcagcagcatgggagccaacaggaggccactcctccagcaccaggggaccagccgtcccgacggcagcgcggctgcgcctacgtgatgtccctctgccgcggcggccggtgcacattccgcacgacacacttcaccatccactcgatgccctcgcgcacccctttgctgtgaagacagcgggtgtgaggcggggggtctcggtccccaaagcccccgcaggtgcagcccccactcaccctgtgagggccgagcaggcctgggtcaggcaatctcgcctgccgatcttgctggtgcagtcgctgaaggccgtcttgatgtcagggattgagaggcacgtctgggggaggtaaggccgtgaggagcagcccccacgtctggccctgtcctgcctgtgggcccgggactctcagaagggcgtatgcccttcaccccagggaaacagccagagctccaccagggtcccagtgtctcccacagagaccacagcagtgaggaccctgtgctcagcccgaggctgaacatggctggtagtgcctgagacaaactagacgtccacacggctccaaggagtccaccccccatcccctccctgggggacaccctgagccccgaggtggggcgctgaggactgaggcctcctgggcagtggcggaggcaggtcccaggggcccacacagccggggatgatggagaggtgggagccctgcatcagtgatggaggcagtctgcagtcatggtggcttctgctcacaaccacctgcccagtcttcaaaaagcagccctcccctccccttttcctccgaggggagacccctgccccgtaccagatgtccctcttgtcggctgagattgtaggggaggccagccttacaggctgggggcaacagagccaccccagagaaggcaggaagtgaagattcacctggccctctggacgccgggctgcttctgtgcaaagccactccaagagaacagctagaactcagcgtggccagtgctcccgggggcagtggcacctcagaggggtcttgaggggctgccctgggggtggggctggcacagatgccacctccaagggtagcaggaacaggtaagggtcagagctgactcccaccagggccccagcatcacttctttgagctctgagtttcacctgggtgtccccacagcttggccacacactcctgagacacggccgccctcctggggagaggtgccctgcatagcaggaagaggcctctgggcgcctgccctgaggtgggagaacctccagggctggcagcagcaggtctggagaggaaccaggcttgggaagctgctgggggcagggcaggccttgagaatggctctgtaccccctgggcagtcactgggcctggggtgtctgggtgcacacctgctccccttgctgtgggggaggctggggactcgggaagctgctgcgggaggcaggggtggggctcacctccacatcctgcttgttggccagcaccaagacggggacaccgcacagcgcctcgctggtcaccaccttctctggggagggcaggagaggcagcgcctcacacccagcatcctgcctctgactgcccaggggcccacaggcgtggacactgtgacagccactccctctgccccccccccccccgtcacccactaggcaggagcacttctgaccagacactgagcctgccccaggcacagagctgcccaagctggacctgcccccactcaccatccatccctcccagagcagccaggccgcactcaccaaacgcctgcttggactcagccagcctctcctcgtcggtggagtcaatgacgtagatgacgccgtgacactccgcataatactgggaggaagcaccaggagttggggctcagtccccaccctgccaagggccagcagagccaggcctgtgtcatggccacagtgaggggctcacatgaggaaggggcaagagggcagcccccaactgcaagacccttctgggatgcattctggggttgcggggagatctggtggaggtgtccccagacgctgctcctgagaacctgccggcaacctttggcctgatggtggccaaaggtgaaagacagggattgggccaggcgtggtggctcacacttattatcccaacactttgggaggcagaagcaggaggatcacctgagcccacttcacggccaacctgggcaacacagtgagactccgtctgtacaaaagcttatggtaatgtgcgcctgcagtcctagctactcgggaggctgaggtgggaggatggcttgagcctgggaggttgaggctgtagtgagctctgatcacaccactgcactccagcctgggtgagaatgagagaccctgtctcaaaaaaaagatagggtttgggggctggaggaacctagaccacagcctggcccgttgagggagtgcacctgtggggctctgtgccagcacctcgcacagggagggagtgtggccatgcggataagactgaccagcgccatctacgaagcgagccttccctgccaggacagggccagagtcactgagctcagacctctgcagcctgggctggtcagtcctgggctcgctggcaacactcctgggcaagacagggcacagcccctgcagcctcaggtacaagtgctgagccctggaccagatgagtgcacctctatctcaatcagaaaaaaacacagcaaactccgcgtccacgtggagcagacaacagctcacatttgccactttgcctccaggctgtgccagctctcctgtccaggcatgagtgcccagagacctagaactggatgctgaccaggtaggacaagctggtggtcagtgtgttaagacacacacacccgagagcatgagaagccaggaggcacagcccaactctccgaaatccttagggtgtctgagcagggagtaccagacaaccccatcccagtgccagacaagcttgtgcacctgcacttcccacagaggagagaagcctgtgcacctgcacttcccacagtggaaaggaggaggcccaaggccaggcccccccacccccaggaacttcccacagtggagaggaggcccaaggccaggcgccctccagggttctgcaggtagcgaggcccccccacccccaggaacttctctggcctacagacaggtcccacacagaggccgccaacccctcaagggaccctgcagtgtgccggctgtctgctgctgacacaagggagcaggcggaccctaaggtggagacctctgtggcaggaggggcggctctgtggaggctgcagcaagcccagtgagagaatctccacgtggctcctggggcttctgagcagggtggcagaaggttcatgtgcaaccgggtcctggaccatgggaccacgtggccagagccacccatcacacctaccaggcacaaggtgcacagcccagcagggccgcagtggacgggagcgacacctcagggctgagtgcgggcaggacccagagccccacgccccagtggaggcgtcacagcagtggtcattgtggggtgccccacaaggagggggaagagggaggtgtccaagcgtggctcctggctggccagctgaccccagtggagcagtcagagggactgtgggtctgagtttttctccccagcagcaatgggagctccccaactgcaaagtgccagccagcctgagagactagtgttacagcaaagaacccaggagctgaggtcctggcacatgccacacatgtggacaccaacccagggtccagccccaggacgaggccaattcgcaatgacgcccctttctgtggtgctggctctgcacaaggatgcaggatacaggaaaccagggtgggagcaggggcctcccttccggtccctcccagtgacctaggggggtccctgcagctgatcctcccagctctgagctcagcagggtcaggggtcccggccactagagcagcacatactcagcagacacgctgaatgacgagccacagctgcctcatgggcatgacttgcacctcatgtctaggagaccctggtgggcaggagatggggctgccatcccacagctgtcccacagctggggacccagggagccactggccccaccacggtggtgtctggagaagggctcagactgccaggaagtcgcaccccagcagaagtggtagtgaattgggagggcactcaaggaagggctgtgcagccccaagaccagcagcaaggatgggctacagtggcccccttaagtctccctcttccagtttcgccttaagagaggccctcaggaccttggaggaacccctctccaacgtggaagtgtgggtccacatagggctgcagctgtggccagtgcaggcatctctggccccactgtattcttgcttcatgttggagaacactgcaccagcagatggtctcattttggtttctgtgggacccactttggctgcaaagagccacactgccaggtcacacctgcccagggcagcccacactggggacccaccaggccatggtgtgaagtcccggccagcctggccccacatggcacagcatagccagttctcctccagggctccctgctgggccaaccacagctctgtggatcctgctgcctgagtcgacctctcctctcccgtcctccctgccttcctggtgccgacccccagtgtgcatcctgtacctcgacctgtctcagcatctgtgcctgagacaccggcctgtgacaagatcatcatcatctgtgtcactccccaagcatgctgcgcactggacacacaggccctgactcaacttgtcctgtctgacttcagtggtcctacaggatctatcagagatcacttggccatgggagaaatgtcttcttggctagaagtcacagcaggaggggacactttgggggcgcctaggaaaggggaactaggatcaaaaaagagatcaggacctgggcactcagctctagagatggcatcagggcagccaaggcactggggacaccccacacccactgtgccagcctagggcagggagcccgaggaagccacaggctctgccctgctcagtgctggactcagtgcctggcccaggctgagaaggagataaactgcagccttgggggtgtggggaaggggcaccacactgggatctcagaaatgcccaaaacctgtgtcaaaataggagactgccgctgtgagaccctgaggagtcttctggtgatcatggaagaacaaatgttaagctagaactgaaggaacctcatcaggggagaggcagccatcctgccgtccccacatctggtctttgccatttctgtgtcctgtggtggtcagcagcaaggtctctgagccgaaaggaggcactcactttggaggagtgcagggtccccaggtccccacactttgtcttgtcctgactgagaaagaaacagactgccctgacctctctgacttggccagcgaggttgcccttaggctcaaacccaagccagggtttgaacattcccagacacttgtaagatgtttaggttgttaacataatgttcaggtttcaaaacattgaaagaaactagccccagccctgaacccagatcccccccggcttcaggcatgaccagtgaacacgcccttctctcactggtcacctgaggatgccgcactctgtcaacaggttcccctaatacatgctctgatctgatcgccttggcatttagtgattctttccctggaattctccactggccccatcgcagggaactcccaagtgggaaactcccctaccaccacttttggggcaacttcagctaagggttcagctgggacaaaacagggagccactcgggaacctgggacaggaccagagagaaaacccgagggacagagtgggtaaggaaaactgctgaggaagggcccaaagggcactctggaaagaagtggcactggagggctggggtgggggtggtcctggccagggagtcttaccttgtcccacaaagactgcagctcttcctgccctcctaagtcccagaacatgagccgagcctttcccacatccacagtgccgactggggagaggaggaaacaggcaaggctcatgaccttggtcctcgacacacccagtcccagctctcccaggggatggggcaaaccatgctggtgccactcaaatgagacttgagaggggcccgacagggctgtggccacgggccagctggactgtgaatatcacggcatcctcaaggccccaaacccacagcctgctattgagacccttactgtttaggcccacggtggtggtgattttggatagactcatccccttgtagttcttgttaaatcgggttttcgactgctccaggaaggtctgaggagagaggcagaggcgaaacacatcaaggaggggctatactggcttccaaatatccttactcaggtctgttctttaaaagacagaaacagaaacagagcaacactctgctcttcaggaggctggtggtgactatcctgccgtctcaggtgaaatttggcttccgtctgggtagtgaacgtgcagctgacagcacaaaaccgaagggggcgccgccaggccgtgggaaaggtgcgcgcaagggcgtgggcactcaccgtcttcccagcattgtccaggcccaggatcaggatgcagtactcgtccttctgaaacatgtacttgtacaagcccgacagcagcgtgtacatcctgccctgggcaccccaacataggtcagtgtgcagccagaaagcacctcccctcccccgggcttctccacggtggtcagtggcgccccacgtccagccgaccgctcaggacgagagcctgggggccattcccgactcctcgtccctctcccaccccgtccctctgtaacttctcccaggtcagccgccactgtgtcctgctcacagcaatgactgcgacctctccgcatacacatcggttccggcccctcccctgctcgcgggactacccagccgggtgttcacagtgagctcagccgcgctcccgccctcccccgaggcttcgctcccacgcttcacgcgcgcggaacggggaacacactcgctgcagccccgcctgggccacggcaccctcgagcgccagccccgcgccccacccgggagcagcgagccaccggcgcgctccccaggagcccctgcaggcgccgggtagggacgccccatcaccccatttcttaaaacggggacggccctggggggagcggactacagggcgggtgagcagcggcgcggctgctcctggagtgcacctggaggcggcgcgcggctggcagggaacgactgcgaaggaagaacctgggtcgcggcccccggctacgtccgccccaagccgccgccgccaggtctgaggctccccgacaagcagccaaagctggctcctgtcacacccgcgtcccacctcgagtcctgggccgcccctcgggcctcgcgcctcaccgcacagcctgcggcctacctgcgtccgccgcgccctcggagccgctgctgctgacccccgctgacctccgctgaccccgcgctaaccccgcgcggcgcctgacgggacgcgggccggcctcagggaatgagctgaaccgcgtcccagcggcctccgcgctccgcttcccggctgcccccgcgcgccaagcacttccggaagcggcggcgctcgggaggaagtgccgatcggctgctggggcgaaaagggggcgccgggccgctctagccggtgaggccggcgggctctctgtggctgcggctgggaaaccgcgcggaggaggtgcccggccggggaccaggtggccgcggtttgcggggacgcggccctggccagacagaagagacgccgggcgggggggcgcggccggcctggaaggcggcgggcgcggcgggtgggctcggcggagggtgaggcggcggggcgccccgcggggaaggggctccggagtgacgcgggacccggctagcggcgagcccacggcggctcggaagggaagcgcggagcctgagcgggggtacccgggctgcgacctctgcgctgggagctgtgcctctgagccggtgtctccccgagggaaaggggacgtgcccgtgcccgtgcccgccctcaggctgtggggtcggtcccgagacgcggggctcagctggcttctcttcttgcagccctggtccagcgcctccctctctcagcatggacgaggagagcctggagtcggccttgcagacctaccgtgcgcagctgcagcaggtggagctggccttgggcgccggcctggattcgtctgagcaggctgacctgcgccagctgcagggggacctgaaggagctcatcgagctcaccgaggccagcctggtgtctgtcaggaagagcagcttgttggccgcgctggacgaagagcgcccgggccgccaggaagatgctgagtaccaggctttccgggaggccatcactgaggcggtggaggcaccagcagcggcccgtgggtccggatcagagaccgttcctaaagcagaggcggggccagaatctgcggcaggtgggcaggaggaggaagagggagaggacgaggaagagctgagtgggacaaaggtgagcgcgccctactacagctcctggggcactctggagtatcacaacgccatggtggtgggaacggaagaggcggaggatggctcggcgggtgtccgtgtgctttacctgtaccccactcacaagtctctgaagccgtgcccgttcttcctggagggaaagtgccgctttaaggagaactgcaggtaaagccctttgttgtcagatgccaaccttaggggcgtaaggggcacgcacacagggtcgggtcaggatcggccctccctttgctttgcagttttgtctcagcttcctggggcaggcgtgctttgacagctgtgtctgtgttcaggcgtctacgtcttccttctggggtgaatcaagaagcatggaaggaggccaggcgcggtggctcacgcctgtaatcccagcactttaggaagccgaggcgggcagatcacctgaggtcaggagttcaagaccacgctggtcaacatggtgaaaccccatctccttaaaaacacaaaaatgaaccggtcgtggtggcgcgcacctgtggtcctggctactcaggaggctgaggcaggagaattggttgaacccaggaggccgagtttgcagtgagtggagatgcagccactgtactgcagcccgagcagcagtgcaaggcttatgtggaagagagtaggtctccagcctatcgtcagtttttttttggtggttgttttaattttttttgagacagggtcttactttgtcaaccaggctggagtgcagtggcatagtcctggctcactgcagcctggacctcctgggctcaaccgatcctcctgcctcagcccccctaggagctgggctacagactcacgctactacacccagctaatttttatattactataattttttatcttttttttgagatggagtcttgttctgttgcccaggctggagtgcagtggcgtgatctcggctcactgcaagctccgcctcccgggttcacgccattctcctgcctcagcctcccgagtagctgggactacaggcgcccgccaccatgtctggctaattttctgtatttttagtagagacggggtttcaccatgttagccaggatggtctcaatctcctgacctcgtgatccgcccaccttggcctcccaaagtgctgggatgacaagcgtgagccaccgcgcctggccttttttttttggagacagagtttcactctcctcacccaggctggagtgtagtggcgcaatctcagcttaccgcaacctctgtctcccgggttgaagtaattctctacctcagcgtccagagtagctggcattacaggcgcccgccaccacactgggctaattttttgtatttttagtagagtcggagattcaccatcttggccaggctggtcttgaactcctgacctcgtgatccacccaccttggcctcccaaagtgctgggatcacaggcgtgagccactgcgcctggccctgttgttagttttattctctagagttcaacttttaaattttactttcatggagattttcaaacataccccaaattagagagtttagcataatcaccgcccacggtccatcatccaatgtcgtcatttattaatattttcccagtctcattttgtctgttctccctgccctatttttttctttcctgggccattttaaagcaaattccagaagttactggttttttccaattatgaatacttcatagttgcatctctaatctaactgattaggaaattacttaaaaagtaactttttggaagtccaagtccgatgtgaggacaaaaaagagtaacttctgtgtcataataggtaacacatttaatggtaatacctcttccatattcaaatatgaacaattattactgtaatgtctctatttccctaagcgcatagctttatttttcctcctttttacttttctcttagaagaaatatttaccaagccttctagtaggtaattttcttttttagccaatagttcaggctgaccgtgtaaccatccctagttctagttctagttctttgaatgtcttccttttttttttttttttgaaacagcgtcttgctgctctgtcacccaggctggagtgcagtggcacaatctcggctcactgcaatctccgcctccctggcccaagccatcctcccacctcagcctccctaatagctgatactacaagtgtgcactgccacgcccagctaatttttgtattttttgtagagacgggatttcaccatattacccaggtctcgaattcctgatccctttgatgagagatctgacacatccctgtggtgctccctctgggccaggcactgctccaagggtttcatatactttcattcatctgtgcaacagccctgtaggtaggccctgcagtcacaccatctgacagaggaggaaacaggagtagaagaactgagtggtccagggcttcaaggctcagagggctccggttgcccccagccctcgttccgtcccctgctccacccagtgctgcttgccatgtcggcatcaggcctgatctgaaagcttccggagcatcttacagacgtccaccttgccaccattcaggactgataagttctcttggatttgcgttggaccttttttttttttttaagatggagtttcactgttgttgcccaggctagagtacaatggcatgacctccacctcctgggttcaagggattctcctgcctcagcctcccaagtagctgggattacaggcgcctgtcaccacgtggtgcccagctaatttttatatttttagtagaggcagggtttcaccatgttggccaggctggtctcgaactcttgacctcaggtgatcccgccttggtttcccaaagtgctgggattacaggcatgagccaccacacccggcccaggatttctttatatattctggatatcatcccttatgaagtatatagtttgcagatatttgctcccattgtttgggttgtcttttcacttgatatagtgtcctttgatgcacaaacattttaaattttgatgcagtgcaatttattgtttctttattgcctatgtttttgtcatcaggtttaagaaaccacctcatccatagttatgaggattttcacctatgttttcttctaagagttctgtagttttagctgttaaatttaggtctttgatccattttgagttaatttttgtatatgttattaggtgagggtccactttattcttttgcatgtggatttccagttttcccagcaccatttgtttaaaagactgctttttctccactgaatggtcttggcacttttgtccaaaatcaattggcaatatatgtaagggtttatttctgagctctctctcctgttccattggtgtatatgtgccagtaccacactgttctgattattatagctttgtgataagttttaaactcaggaagtggtagttattcaccatttgctcctctttttcaagtttgttttgtttctggatcctttgcaatttcatatgaattttaggatcggcttgtccaattctgcataaaagacagtttgaattttgatatggattgcatagaatgtgtagatctgtttggggcacattgtcatctttacaatattaagccttctggctgggtgtggtggctgacgcctgtaatcccagtactttgggaggctgaggcgggcatatcacttgaggtcaggagttcaagaccagcctggccaacgtggtgaaaccccgtctctactaaaaataaaaaacaaattagtcggaggtggtgcacacctgtaatcccagctacacgagagggtgaggcaggagaatcgcttgaacctgggaggaggaggttgcagtgagctgagatcatgccactgcactccagcctgggtaacagagggagactccatcttaaacaacaacaataacagaagaaaaaaacagtattaagtcttccaattcatgaatgaaggatctgtccatttatttacgtctttaatttctttcaacagtattttgtactgttcaagtcttgcacattcttggttaaataagtattatttttgatgcttctctaaggaattgtttttcttttccttttttttttgagacagagtcttgctctgtcacccaggctggagtgcaatggcacaatcttggctcactgcaacctctgcctcccgggttcaagcaattcttctgctcagcctcccaagtagctgggatcacaggtgcctgccaccacacccagctaatttttttttttgagatggagtcttgctctgttgcccaggctggagtgaagtggcccaatcttggctcactgcaagctccacctcccgggttcacaccattcttctgcctcagcctcctgagtcgctgggaatacaggtgcctgccaccacgcccagctaattttttgtatttttagtagagatggggtttcaccatgtagccaggatggtctcgaactcttgacctcaggtgatctgcctgcctcggcctcccaaagtgctgggattacagatgtgagccactgtgcccggctggagttgttttccttagttacattttcaggctgtttgttgctagtatatagaaatacaagctgggcaccgtggctcacgcctgtaatcccagcactttgggaggccaaggcgggtggatcacctgtggtcaggagttcgagaccagcctggccaacatggtgaaatccagcctctattaaaaatacaaaaattagtctggcatggtggcaggtgcctgtaatcccatctactcaggaggctgaggcaagagaattgcttgaacctgggaggcggaggttgcagtgagctgagatcgcgccattgcactccagcttggggaacaagagtgagacttcatctcaaaaaaaaaaaaaaagaaatacagtggatttttttatgttaatcctgtattgattgctgaattggtttattagtgctaataggattttttatgcactatttaggattttcgatatatacaatcatatatattcaatatatacaattaatatatatgtgaatagagataattgtagtctttgtttctagtttgcatggcatttatttctttttcttgcttaactgccttagctagaacttcaagtacaatgttgaataaaagtgactagagcgggccgggggtggtggctcacacctgtgttcccagcactttgggaggtggaagtgggcagatcacttgagatcagcagtttgagaccagcctggccaacacggcgaaaccccatctctactaaaaatacaaaaattagctgggtgaggtgatgtgcacctgtagtcccagctacttgagagggtgagacatgagaattgcttgaacctggggggcggaggttgcagtgagccaagatcatgccactccactccagcctggacgacagagcaagaaccctgtctttaaaaaaaaaaaaaaaaaaagtggctagaacaaacatctttatcttgttcctgatcttaggtggaaaacttttttgttcctgatattaggtggaaaacttttagtctttcactgttgaatatgatgttacttgtaggttttctgtagattccctttatcgagttgaggaaattctcttatattcatagtgtgttgagtgttttttatcatgaaagggtgttgattttttttttaaagatagggtcttgttctgtcacccaggctggagggcagtggcatgatcatggctcactgcaacctcgaattcctgggctcaggggatcctcctacttcatcctcctgagtaggtgagactacaggcatgagccaccatgcccagctaattttttaatttttctgtagaggtagggtcctgctttgctgcccaggctggtcttaaactccagggctcaagcaatcctgcctcagcctcccaaagtgctgagattacaggggtgagtcactgcactgcacccagctgtgtgggatttttcaaatgcttttttcctttagatgatcatgtgtggtttttttcctttcattttgttaatgtggtatattgattttcgtatgttgaaccatccttgaattcctcagataaagcacgcatattcatggcgtattatctctttattattattatttttgtagagatgagatttcactctgttgcccaagctggtctcaaactcctgggctaaagtgatcctcctgcctcagcctccgaaagcgctgggattataggcatgagccacttggccctatcttttttctttttctttttttttttttttgagacagagtctcactctgtcgccgggctggagtgagtggcgcgatctcggctcactgcaacctccatctcccgggttcaagcaattctcctgcctcagcctcctgagtagctgggactacaggtgcccgccactatgcccagctaattttttgtgtttttagttgagacggtgttttgccatgttggacaggctggtcttgcactcctgacctcgtgattcacccaccttggcctcccgaagtgctgggattacaggcgtgagccaccgcagcgagccttatctttttaacagttaaaagtttaaggccttatcatgtaataacattgctggatttgatttgctgctgttttgttgagaatatttgcatctgtattgataagggatattggtctgtagttttcttttcttggcatgtctttgtatagctttgatgccagcataatattggcctcatagaatgagttaggaagtattctttatattatgggaagaggtaaaaagggattggtgttaattcttcttcaaatgtttgatagaattcaacagtgaagtgatatatacaatcatatatagagagagagagagagagagagagatggacttttcttttgttggaagtttattgactattgattcaatttccttattgaaattgacttttctttttggaagctaaaacgtataactgtagtgaaagtttctgaacttttctttcattggaagttttttgactactgattctttatttgttataggtctattcagattttctgtttcttcttgagtcagtttggtctcgctctgtcgcccaggctggagtgcagtggtgccatcttggctcactgcaacttctacctcccgagttcaagtgattctcccacctcagcctccccagtatctcggactacaggcgcacgccagcatacctggctaatttttgtatttttagtaggaacagcatttcaccatgttggccaggctggtctcgaactcctgacctcaggtgatccacccgcctcggcctcacaaagtgctgggactacagacataagccaccgcgtccagccttgagtcagtttagatagtttgcatgcatgtttctaggaatttgtccattttgtttatgttatctaatctgttaccatacaattgttcatagtatccttttatagccctagttatttctgtaagatcagtagtaatagctccactttctctcttggttttagcaatttgagtcatctcttttcttcctctttttttttttttgagatggagtctcactgtgtcacccaggctggagtgcagtggcatgatcttggctcactgcaacccctgcctcccaggttcaagcaattctgccttagcctcctgagtagctgggattacaggtgtgagccaccacacccagctagttttgttttgtttttttgtttttgagacggagtctgtttctgtctcccaggctggagtgcagtggtgcaatctcactcattgcaacctccgactcccagattccagcaattctcctgcctcagcctcctgagtagctggaactataggcgtgcaccaccacgcctggctgatttttatatttttagtagagatgggatttcaccatgttggccaggctggtcttggactccctacctgaggtgatccgcccaccttggcctcccaaagtgctgggattataggcatgagccaccatgcccagccagtttttgtatttttagtagagatggggtttctccctgtcggccaggctggtcttgaaatcctgacctcaggttatccaccagccttggcctcccaaagtgctaggattacaggcatgagccaccacgcatggcctgtcttttcttcttggtcattttcgctaaaggtttgtcaattttgttgatcttttttgttgctgatctctattgttttcccattctgtttcatttatttccattttaacctttgtttccttttttctgctggtttgggtttaatttgctctttttttcccctaatttttcaaggtatacagttaagttattgatttgagatctcttttttcttttctttttttttttttttttttttttttggttgctgttgagatggagtctccctctgtcacccagactggagtgcagtggcatgatctcagctcactgcagcctccgccgcccaggcgattctcctgcctcagcctcctgagtagacgtttcccggccaaggtgtttctttttgaatgtaagcatttacagctacagatttccctctaaacactgctttcactgcattccataagattgttttttgttgttgttttgttgtttgagacacagtctcactctgttgccgtttggagagcagcgatgcgatcatagctctgtagccttgagctcctggactcaatcagtcctcctgcctcagcctcccaagtagctgggactacaggtgtacaccactgcacctaactaatttcttttataagtttttgcagaggccaggcacagtggctcacacctgtaatcccagcactttgggaggccaaggtgggtggatcacctaaggtcaggagttcgagaccagcctggccgacagggagaaaccccatctctactaaaaatacaaaaattagctgggcgtggtggcaggtgcctgtaatcccagctactcaggaggctgaggcaggagaatcgcttgaacctgggaggcagaggttgcagtgagccaggatcacaccattgcactccagcctgggtaacaaaagcaaaactccatctcaagaaaagaaaaaaaaaagtttttgcagagacagggtatcactttgttgcccaggctggtctcaaactcctgacttgaaggagtcctactgcctcggcctcccaaagtgctgagattatgggcaagagccaccgcaccctgccacttggctgttttgttctgttgtatttccattttcattgatctcaagacatcctaatctcccttttgtttttttgttcgacttactcgttattcaagagtgtctttatttctgcatatttgtaaattttccaaaaaagtttttctttctttcttttttttttgagaaagggtcttgctctgtcgcccaggctggagaatggtggtgcacaatcttgcctcactgcaacctctgcctcccgggttcaagtgatcctcccacctcagccttcccagtagctgggattacaggcacacaccaccacacctggctaatttttgtattttagtcttaacgtgctggtcagactggtctcgaattcctgacctcaggtgatctgcccgccttggcctcccaaagcactgggattacaggcgtgaaacaccatgcccagcccccaattttttttttttaatagagagaaggtctcactcaagcccaggctggtcttgaactcctgagctcaagctgtcatccctcctcggcctcccaaggtgctgagattacaggtgtgagtcacagtacctggccttctttcaagactttaaaaatgccatcttggctgggcacggtggctcacgcctgtaatcccagcactttgggaggccgaggtgggcagatcacgaggtcaggagatcaagaccaccctggctaacatggtgaaaccctgtctctactaaaaatacaaaaaattaaccaggtgtggtggcaggtgcctgtagtcccagctactcgggaagctgaagcaggagaatggcgtgaacccgggaggtggagcttgcagtgagctgagatcacaccactgtactccagcctgggcaacagtgcgagactccatctcaaaaaaaaaaaaaaatgtcatctcactgccttctggtccaatagtttctgatgagaaattggctgttaatcttattgaggaacatttatatattgactagtcacttgtctcttgctgttttaggagattctctatctttgggtttcagcagtttgattataatgtatcagtgtggatccctcaatttataagctacttggagttcattggacttcttggatgtgtaaattcatgtctttcattaaatttgcaaagtttcagctactattctttgcatcttgaaatactagttttgtttctttctgtctgtttgccgcttatggaactttatgcatacattgatgtgcttcatggtgtagcacaggtcccttgggctctaggcatttttctttgttctttttttctttctgctcctcattttggataaattcagctgacctgtcctcaagttcactgtttctttcttcttccttctcaaatctgctgttgaaacttctggtgaaattttcactacagttactgtactttttagctccaaagtttctatttggtttctttctgtagtaattatcactttactagtattctctatttggttagacatggttcttttgttttcctttagttcattatccatggtttcctttatttttaaatttctttttatttagttattaattttttttttttttgaagcggggtttcactcttgtcacccaggctggcaggcaatgtcacaatcttggctcactacaacctccgcctcctgggttcaagtgattctcctgcctcagcctcccaagtagctgggattataggcatgtgccaccacacccacctaatttttggtatttttagtagaaactgggtttcaccacattggccagactggtcttaaactactaacctcaggtgatctgtccgcctcagcctcccaaaatgctgggattacagatgtgagccactgtgcccagcctctttttttagtgtatttaaggtaattgattgaaagtttttgtctagtcattcaaatgtctaggcttcctcaggaacagtttctattaatttctttatttttaaaaaattttttttaattttcttttttttttagatggagtctcactctatagcctaggctggagtgcaatggcttgatcttggctcactgcaacctctgcctcctgggttcaagcgattctcctgcttcagcctcctgagtagctgggactataggtgcgtgccaccactcctggctaattttttgtattttcagtagagacatggttttgccgtgttagccaggatggtctcgatctcgtgacctcatgatcctcctgcctcggcctcccaaagtgctggaattacaggtgtgagccaccgcgcccagcctattttttattttttgagacaaagtctccctctctcacccaggctgtagtgcagtggcacaaccctggcacactgcagccttaaccgtccaggcttaagtgagtctcccaccttagtctcctgagtagctagaactacaagcatgtgccaccatgcctggctggttgtgttgttactgttttagacacagggtcttgctacatttctctgactggtcttgaactcctgggctcaagcagtcatcccaccttggcctcccaaggtgttgagattacaggtgtgagccaccgcacccggcctgttaatttctttatttccggtgaatgggccacactttcttgtttctttgcatgccttgtaattttttgttgaaacctgcacaatttgaagatgataatgtggttactttgaaaatcagatcctccgccctctgcagggttcattgttgctgtttgttgtggattgtcgtttctcgtttgtttagttactttcctgacctttttaaataaagattatattctgtcaggggtgcttgtttctgttcttttaggttagtggttagcttgtgctttgaaagagatttctttaaatatctagtggcaaaaaggataaagaggccgggcgcagtggctcacgcctgtaatgctaggactttgggaagtggaggcgggtggatcacttgaggtcaggagtttaagatcagcctggccagtatggtgaaaccctgtctctactaaaaatacaaaaattaaccgggcatggtggcacctgcctgtagtcccagctactgggaagactgaggcaggagaatcgcttcaacccagggggcggaggttgcagtgagctgagattgcgccattgcactccagcctgggcaacagagcgagactctgtctcaaataaaaaaaaaaaaaaaaaggataaagagtgtcttccatcctttccaggttgcctctgtactggggcaagtccttcagtgtccgccaggctgttcacggcttttcctcagcctttacttcttgctcccatggagcctaaggatgaaccagaggtgaaagttgagggcctcctcaggtgtttctgagcccctgtctagccccagctgtgtgcatggccttctggatttccaagcatgaacaggagctttccaaagcccttagaccttcatgtagctcttttcccagcctcttccttcctaggcttttctgtcagctctttgcccatctgttgttgtccctcccccacaacttcaggtagtatctacctgtaaatgccttcaggccaggcgcggtggctcatacctgttatcccagcactttgggaggccgaggcgggtgaattgcttgaggtcaggagttcgagaccagcctggccaacatggtgaagccccgtctctagtaaaaatacaaaaattagctgggcgtggtgggtgcctgtaatctcagctactcgggaggctgaagcaggagaattgcttgagcctgggaggcggaggttgcagtgagctgagatcgtgccattgcactccagcctgggcgacagagtgagactccatctcggggaaaaaaaaaaaaaaaaaatgccatcaacagcacgaccctggaggctgccccagccctgagagagttcgagggggtgaaacaaaggcaagcccttcagggagacactagaaagatccaaatgcataagcaggattccttgagaaaaggtctgtatcatcccttctgacaccagcaagccacatcagaaatacaggttgccttccccatggctacatgtgagctggtagtagtggctgagcagaaatagcccagctgtcctcctgaaatttagcagggtcttacttcattgagcagtcatctggttcgtagacaccagagttacagaaaagtttattgggaggttttgacagtttaatagaaaaaagtttattgtgacagttttgacagctgaatagaaaaaagtttattgtgacagttttgacagcagaatagttgctttgctggagagacggatctttggagctgccaactccatcattttggtgatatccagctctgttgctgaatttttagctatgctgttttaagttattttcttagtggttgctctagagatgacaatgtacatctttaacttaccacaatgtacttcagattattactaacttaacacttaaagtacagcatttttttttttatggagtttcactctgtcacccaggctggagtgcaatggtgtgatctcggctcactgcaacctccgcctcccaggttcacgccattctcctgcctcagcctcctgagtagctgggactacaggcacccccaccacacccggctaattttgtatttttagtagagatgaggtttcaccatgttggtcaggctggtctcgaactgctgacctcaggtgatccgcccatcttggcctcccaaagtgctgggattacaggtgtgagcgactgcactgagcctaagtatggcaacgtgtctataacatagatctacttccgttgtactatgacatagttccccctccattttcctatagcacagtcccaacctcccttttcctctgacatagttccatcctccctcctcctatgacgtcctcccttctcctctggcatagctccatcctcccttctcctatgacacagctccatcctcccttctcctctgacatagctccatcctcccttctcctatgacacagctccatcctcccttctcctctgacatagctccatcctcccttctcctgtgtcatagctccatcctcccttctcctctgacacagctccatcctcccttctcctctggcatagctccatcctcccttctcctatgacacagctccatcctcccttctcctatgacacagctccatcctcccttctcctatgacacagctccatcctcccttctcctatgacacagctccatcctcccttctcctatgacacagctccatcctcccttctcctctggcatagctccatcctcccttctcctctgacatagctccatcctcccttctcctctgacatagctccatcctcccttctcctctgacatagctccatcctcccttctcctctgacatagctccatcctcccttctcctctgacatagctccatcctcccttctcctctgacatagttccatcctcccttgtcctctgacatagctccatcctcccttctcctctgacatagctccatcccctcttctccttcatgtattattgccatatatacatttatgtatgttataacttcagctcttcagcgttataattattgcttcaaaagtattttgaaagaagttgcctggaggcagtggcttatgcctttaactccagcacttttgggggctgaggtgggcagatcgcctgagccagggagttggagaccagcctgggcaacatgacgaaacccatctccaccaaaattacaaaaaattagtctggcatggtggcacgcgcctgtagtcccagctatttgggggaggatcccagctaaggtgggaggatcacttgagcctgggaagtcaaggctgcagtgagctgagattgtgccactgcactccagcctgggtgcagatcttatctcagaagtaaagggactaggaatggtggcttttatctctaatcccagcactttgggaggctgaggtgagtggatcaccggaggtcaggagtttaagaccagcctggccaacatggtgaaaccccgtctctactaaaaatacaaaaagtagccgggtgtggtggtgggtgtctgtaatcccagctactcgggaggctgaggcaagagaatcgcttgaacctgggaagcggaggttgcagtgagcaagatcgcaccactgcattacagcctagatgacagagcgagactctgcctaaaaaaaaaaaaaaaaagaaaagaaaagaaattaagatctggacactgtggttcatgcctgtaatcccaaagccttgggaggccaaggcaggaggatcacttgaggccaggagttcaacaccagcctgggcaacatagcgagactccatctctatttaaaaaagaaagaaattcaaagagaaaaaaagtatacttgtttttttgtatcatccatattttacctttcttttttttgcccctttttctttcctgtgaatttgagttactgtctagtgtcatttccttttagtctgaagaacttcatttagaattttttttttttttttttgagacaaagtctcactgtgttgcccaggctggagtgcaatggtgcagtctcagatcactgcaacctctgcctccctggttagagtgattttcctgcctcagcctcccaagtagctgagactgcaggcacctgccaccacccccagccaatttttttggtatttttagtagagacagggtttcactatgttggccaggctggtctcgaattcatgacctcatgatctgcctgtcctggcctcccaaaatgctgggattaccatgagccaccacgcccagcccatttagaatttctttttttttttttttttgagatggggtctcgctcttgtttcccaggctggagtgcagtggcacgatctcggctcactgcgagctccgcctcccgggttcacgccattctcctgcctcagcctcccgagtagctgggattacaggcgcctgccaccacgcccacctaattttttgtatttttaggagagatggggtttcaccgtgttagccaggatggtcttgatctcctgacctcgtgatccgcccgccttggcctcccaaagtgctgggattacaggcgtgagccaccgcgcccggctagaatttcttgtaggacaggcttgctagcaaccaattcagtgtttatttgggaatgtctttatttcagcttcattttttgaaggatagtttagctggctatagaattattaattgatcattcttttcagtgtttaaaagtgtcatcatgctaccttctgggttccattgtttctgatgagaagtcatctgtcaaattgtccctttgtacttgaagaattatctttttttctcttgatgttttcaagattttctctttgtctttggcctttagtagtttgtgatgtatctaggtgtggatctcttggtgtgcatcgtatttgggcttcagtaagcctcttagattcatagattaatgttttgttttgttttaccaaatttggagagtttttactcatcatttcaacaaatttttttcctgcccctctctcatctccttttgggagtaccactgcatgtatgttggtgtgcgttctctaaagctttttttttttttttccaaccttttttctccttattcctcaaactggattatttatttatttatttatttattttttaattttttgagacggagttttgcttttgttgctgaggctggagtgcagtggcgcgatttcggctcactgcaacctccaccaccttcgaggttcaagcaattctcctgcctcagcctcctgagtagttgggactaccggagtgtgccaccaccatgcccagctaatttttgtatttatagtagagacgaggtttcaccatgttggcaaggctggtgttgaactccggacctcaggtgaaccacctgcctcagcctcccaaagtactaggattacagtcgtgagccactgcacccggccaggataatttttaatgaatttttttcttctgccatctcaaatctgccgttgagtacatctaattaattttttttttttgagtcggagtctcactgtgtcgcccaggctggagtgcaatggcgcgatcttggctcactgcaacctccacctctcaggttcaagtgattctcctgcctcaccctcccaagtagctgagatgataggcgcccgccaccacgcccagctaatttttttgtatttttagtagagacagggtttcaccatgttggccaggctggtcttaaacccctgacctcaggtgatccgcccgcctaggcctctcaaagtgctgggattacaggcatgagcccggccttgaatttttttttaataggctttttgtttgtttgtttgtttgtttttgagatggagtcttgctctgtcgcccaggctgaagtgcaatggtgcaatctcggctcactgcaacctccgcctcccaggctcaagcgattcttatgcctcagcctccccagtagctgggactgcaggcaccctccaccacacctggctaaataatttttgtagttttagtagagacaggatttcaccatgttggccaggctggtcttgaactcctgacttcaggtgatctgcccacctcggcctcccaaagtccagggattacaggcatgagccactgctcctgaccatggctttagtttttagagtagttttaggttcacaacaaaattgggtggaggatacagagatttcacatatactccagacccccacacatgcaacagcccctccccacaacaccatcatgctccctcaccagactggtacgtttattacaatccataaacctacacagacccatcattgtcacccaaggtccatagtttacattagggctaactcttggtggtgtacattctatggactttgacacatgtataatgacaggcatctactattgtggtatcagacagagaagcttcacaacctcattctctgtactttacctgttcatcctgccctccccactacattcactaaaaatgtcctttcagtgattgtcctttttaactctggaatttccatttgatttttttttttctttttttctttttttttttagacagagtctgcctctgttgcccaggctggagtgcagtggtgccatctcggctcactgcaaccctctgccttctgggttcaagcagttctcctgttttagcctcccaagtagcagggagtacaggctcatgacaccacgcctggctaatttttgtatttttagtagagacggggtttctcaatattggtcaggctggttttgaacgtttgacctcaggtgaggcacatggtgaaaccccatctctactaaaaatataaaagttagctgggcgtagtagctcacacctgtagtcccagctactccagagactgaggcctgagaattgcttgaacttgggaggtggaggtgcattgagctgagatcatgccactgcactccagcctgggtgagagagtgggactcggtctcaaaaaaaaaaaaaaaaaaaaaggattctctatttcctgaatcattgccatcatattttcatttaattatttgaacatacttatagtagctgctttgaagtctttgctaaactcaacatctgggcccactcagagtcagattatatcaactgctttttttcctaaatatggatcatggtttcctgtttacctgtcttataattttttttgttgaatactggacatttcagatgatctatgtctggattctgagttgttttcctgagtcttgtgttctgtttgttttagttaagttgtttggacttaaactgcaaaacttgcccacccacccctgcagcctctgatatctctgctcagatttttaaattcttttttttttttttttgagatggagtcttgctgtattgcctaggctggagtgccagtggtgccatctcagctcactgcaacctccacctcctgagttcaagcaattctcctgcctcagcctcccaagtagctgggattacagatgtgtgccaccatgcctggctaattttttgtttttttagtggagatgaggtttaaccgtgttagccaggatggtctcgatctcctgaccttgtgatccgcccacctcggcctctcaaagtgctcggattacaggtgtgagccaccacgcacggccttaaattctattttttagtctggcttcctagcagttgcttctgtgtttgcatatggtagtggtcagccagggatttgggcaagagggtgtgctcaaacactcctaacccaaaaggctccccaccacaccatgtggtttcagagcacgttgtgagttcagccagcccctctctctttgctttcacttcaccctggcctctcttggagctcccaacacctgcagtggtttcctcaagagccaggcccttcctgggagagctgagcccttctgtggctctcattttcagagtcttcctgttaagtatctggctggcccagtgctcactccagctgggatcacagccccaaatgatcagggctgtcagttttctttgtaagtgtttatcgagtcaccacttttaactacgaggcctgggttttcccttctgtcccacatccacctctgctgctgctggtttttgcagccagccttgacctggtaaatcactcagatttgctgactcaggagtaggagccaggggcagccccaggtgcaaaggctgtagacttcccagtattctggcccaaggcccaacatttttcaagaagaatctcttctcagtgagttctcagctttggtcagtttccagaactctgaaaagttctaaatcagtgagttttgataattttgtctagttttagattattttttctttttttctttttttttttttttgagatggagtctcacttcgtcacccaggctgaagtgcagtggtgcgatcttggctcactgcaacctctgccttttgggttcaagcgattctcctgcctcggcctcccgagtagcataattataggcgcacgccatcacaccggctcatttttaaatttttggtagaggtggggtttcaccacgttggccaggctggtctcaaactcctgacctcaagtgatccgcctacctcagcctcccaaagtgctgggattacaggcgtgagccaccgctcccggcccatattcgattcaacgacctctctacttgagtgtggctggaactcagaagcttcttttagttttagatgttgtttgttttcagggttaagtctttactaattctggaatgtatttctgtcaatgctgtgaggtaggtgattgggttgggatcttttatgtatgaaaacccagtttttaattttctcttgtgaaatccatcgtctttctccttgcaccccatctgtgatgcttcctctgccacacgaggctttctgtgtgagggggggctcttcctggaggctctcttttgctccattgatcgatttgcctgttctcttggttttcagttaacttcatggatatgccattaacttctctccatggttagaaatttaggttatttccaagtttttcatatttggttaatatctttgtggccaaatctttacatacattctccttaaaaatcatgtcactgaggcggaaggattacatgagcccaggagttcaagaccagcctggccaacatgacaagaccttggctcaacaaaaagattcaaaaattagctggcatggtggcacactcccatagtcccagccacttgggaggctgaggcaagaggattgcttgagcccaggaggtcaaggttgcagtgagctgtgatcctaccatgcacttcagcctgggcaagagagcaagactctactgcgcacacacacacacacacacacacacacaaaataatagaagcactttctgggttaaagagtttacaaatttcaaggcttttaatattgtcaaatattctagaagaggttttactaatgatggtgtgggtgtgctgaaggggcgtatttaatcgaattcactctgggtttaaccctctctttttgaacatgttctcagtctcctttcagccagtctctgctgcagtgcatttgaggcacagtcctgtagcccctggcgcccccggtcattggcagggccctgtgtgcctaagaacagtaggcactagaaggaaccgcccaaaatcctggcctggggaggtgtacgaggccacctttgtctacgcatgagacaaaatccctgttccacctcactctgctccacccacccgttcctactggaaagacagccttggctccatgtcacgggctgaaggcctgtcctcagttgctccttttttgtttttttgagacagtctcactctgtcttccaggctggagtgcagtgacacaatctctgctcactgcaacctccgcctcccgggttcaagcgattcttgtgcctcagcctcccgagtaggtgggactataggcacgcgccaccacacccggctaatttttgtatttttagtagagacgggtttctccatgttggccaagctagtctcgaactcctgacctcgtgatccacccgtctcggcctcccaaagtgctgggattacaggcgtgagccgctgcacctggcccctcagttgcttttgtggggttgaaagaacttcctttttgaaacgatggcatggcagcagtggatggcggttggtttttcatgtctttatttggcaaagttgaagattgcagttctgtctgtccccacatttcctcttcattctctctctctctctctctctctctctctctctctctctctctctctctgtgtgtgtgtgtgtgtgtgtctcggttttggttttaattttactggttcactgatgcctaaaagtcaaggcatcactatttcataagcaggttctcctagtttgggggaggactcagtcatgcacatacacacccccagcacatctgccttgatgcactggtgctgtggcctgtgcagtagtgaggctgtgggagctgctgtcagaaggctgctgccacactgtgactccagcagaggcgatgggacacacggggcatattctggagcagccaagtccatcccgagagagaatgcgggtgtctgtgtgtgtgatgtgtgtgagactgtgtgtgtgtgtgcatgtgcatacatgtgtaaagtgtacagttggcccttgtgtgtgtgagattgtgtatgtgcatacgtgtgtaaagtgtacagttggcccttggtgtgtgtgtatgtgtgcatgtgcatacgtgtgtaaagtgtacagttggtccttggtgtgtatgtgtgcatgtgcatacgtgtgtaaagtgtacaattggcccttggtgtgtgtgtgattgtgtgcatacgtgtgtaaagtgtacagttggcccttggtgtgtgtatgtgtgcatgtgcatacatgtgtaaagtgtacagttggcccttggtgtgtgtgtgattgtgcatatgtgtgtaaagtgtacagttggccctgtgtgtgattgtgtgtgcatatgtgtgtaaagtacagttggccctttgtgtgtgtgagattgtgtgtgcatacgtgtgtaaagtgtacagttggcccttggtatctgcaggttccatatccatcatttcaaccaatctcgagttgaaaataattggggaagaaaaggatggctgcgtctgtacactgtataacaactatttacatagcatttacatcgtattaggtactgcaagtaatctagggatgatttaaagtacgtgggaagatgtgcgtaggttatatgcaaacactatgtcattatatataagggacttgagcatccttggattttggtttgcacagggggtttcccatggataccaagagactacgtgtgtatgcaagtgtgagtgtgtatatgcatgtgtgtatatgcatgccatgtgtgtgcatgtatgtgtatatgcatatatgagtgagtgcacgtgacagtctacacgtgagggtgcatgtgtgtgcgcgtgtgggtgactgcatatgtgtgtgcatgtgtgggtgcgggtgcatctgtgtgtgcatgtttgggtgcgggtgcatgtgtgcgtgcacgtgtgtgtggatgagaggtcgcatgtgtgtgggtgagggcgtgtgtgtgtgcatgtgtgtgggtgagggggcatgtgtgtgcacgtgtgtgggtgaggtgtgtgtgtgcatgtgtcagggtgtgtgtgcgcgcatgtgtgtgggtgagggcctgtgtgtgcgtgtgtgtgggtgagagatgtgtgcgcatgtgtgtaggtaagggtgcttgtgtgcgcatgtgtgtgggtgagggcgtatgtgtgtgggtgagggcacgtgtgcgcgcgtgtgggtgagatggcgtgtgcgtatatccatgtatgactgcatctgtatttgcatgagttcatgtgtgagtgcatgtttatacgcgtgtcagggtctctgtgtatgtgtatgacgtgtgagtacatgtgttaatgtgtgtgtacatgtgtatatgcctgtgtgcatgtgtgtatgcatgtgtatacatgtgtacttgtgtatgtgtatatgtgtatgtctgtatatgtgtgtgtatgcctgtgtacgtatgtatatgcgtgtgtgtatgcatgtgagtgcatgtttatgcgtgtgtatgtgtacttgtgtgtgcctgtgtgagtgcatgtgtgtgtacatgtgtatatgcgcgtgtgcgtatgcgtgtatgtgtacgtgtgtatatgcatgtgtgtgtatatgcctgcatgtatatgcacaagtgtgtatatatgtgtatgtgtgagtgtatgtgtgcatgtgtatctgtatgtgcgtgtgtatatgtgcatgtgtgtatgtgtgcgtgagtgtgtgcatgtgtgtgtgtatgtgtgcgtgtgtatgtgtgtgcgtgagtgtgtgagagtgtgtatgtatacgcacgcgtgtgtgtctgtctccctcaggacagtgcccaggcggatgggtcagtgctcctgggttggtttgcccctggtggcccatgtctgagccctgccccttacggctctgtctgcaggttctcccatgggcaggtggtctctctggatgagctgcgccccttccaggacccagacctgagctccctgcaggccggctctgcgtgtctggccaagcaccaggatggcctctggcacgcagcacgcatcaccggtgaggctggccgtgggggcctcccgggaacaccctcccaggccccacgtgtgttgtcactgtgtggctgctccctgcttcctttgggttgagtgtcgggactctggctctgggcccgaaatgagcacacctaccctcagcctctgccctgccttgctcctcatgtccagggtggttcccttcagtggcacctgctgtcaaggattctgacctgcagcttgtctctgcccccagatgtggacaacggctactacacagtcaagtttgactcgctgctgctgagggaggccgtggtggagggggacggcatcctgcccccactgcgcacagaggccacagagtccgactcagacagcgacggtacgggtgactccagctatgccagaggtatggcagcagctgcggagcccaggagccaggaaggtggggtcaccctgagaggctcctggccggtgagggcaccaaccatctaaccaaactattggagagtgtgtgactgcggcgagggtgccacctgtgcctgaggaggccgtgtgggtaggggtagatccgtggcggcctttatcttcaaggagtgtgggtgcaacagctacagtctcattgatgggaggccatggtcgtggctgtggccatgggagaggaggggcctggagttgccgaggaagtcacagaaaatgaccaactgatggggcctggagtgcaggaggggcagctcctctgcatggcttctcagacttgggacctgggtgcctgggatcctggcagacagaggttgtgtccagacagccagcatggaagtttcgggaatgggaactggtgggcagtgtccagctctccagaggggtgtgtgtatgcgtgtgcgtgtgtgtgtatatatgtgggaggtcacctgacccaagcatggcgggctgagtccaggaggggtctgcatgttggaggtgtacccagggatcagtgatggtggtttctgaagccccatgtccctggtgaaggaggactgaaccaaggactctgtgagggcaggtgaggcgctcacagcctcgcgaaggtggagaagggcaggggcaggagagggctgcggaggaggggccacggtgcagcaggccgtggggactgccatgcactctgcctggtgtcacatgcccacagcagcctcggtgacgagagcacggagcccaagaggtggggtgtcgtggctctgcccaggatctgagctcattggtcaaagcccgggtcaccatgcacaatcctctggcctggctgggccactgccctctgtccatctcttgcagtggtggggtcggacgccgtggactctgcacagtcctctgccctctgtccgtctcttgcagtggtggggtcagatgctgtggactctgggacctgcagctctgcctttgctggctgggaggtgcacacgcgaggtataggctccagactcctcaccaagatgggctatgagtttggcaagggtgagtacaagctgccctggagaagtgggcaggctgctgcagcatagcccaggtccagcagccatcaggttcccggggtcccgcagccatcgggttcccagggtcccgcagccacagcactgccatccccgtgctcctcagattcccggggtcccgcggccacagcactgccatccccgtgctcctcagattcccagggtcctacggccacagcactgccatctccgtgctcctcagattcccggggtcccgtggccacagcactgccatccccgtgctcctcagattcccggggtcccgcagccacagcactgccatccccgtgcctccgcaggtttgggccgacacgcggaaggccgggtggagcccatccatgctgtggtgttgcctcgagggaagtcgctggaccagtgtgtggagaccctgcagaagcagaccagggttggcaaggctggcaccaacaagccccccaggtgccggggaagaggggccaggcctgggggccgcccagctcctcggaatgtgtttgacttcctcaatgaaaagctgcaaggtcaggctcctggggccctagaagccggggcggccccagcggggaggaggagcaaggacatgtaccatgccagcaagagtgccaagcgggccctgagcctgcggctcttccagactgaggagaagatcgagcgaacccagcgggacatcaggagcatccaggaggctctcgcccgcaacgctggccggtacgtgtggggcccagctcagggcaaagggcgacccagggtggccctgcccccgggatacatgctggaggtcacctgacccaagcatagcgggctgagtccaggaggggtctgcatgttggaggacgggcagcgggcacacaggcagtgggtacggcagactggggttggtggcatggcccaggaccccacgctgactagtgagcccctccgcaggcatagcgtggcgtcagcccagctgcaggagaagctggcaggagcccagcgccagctggggcagctccgggctcaggaagccggcctgcagcaggagcagaggaaggcagacacccacaagaagatgactgagttctagagaccccacaagcactatggacgaagcgtgggaccccagcacgggctgccctcaggaagaccagtgttgcccgaggaggggccggcctgctggcctggggcgtgcagacactgctgagtggagacagagctgcggggtcccatctggacacttacttgcccacctgccagtgtcttgggcatttccttggcaaggacattaaagtgatttcatcacagtgtcattcagtggagatcagctggctgcagggtctctggggagagaagggtctgtgcagggctgtggtgagagacgggctgggctggaggggcctaggaggccggcattctcccttcttacccttctctgaccaaggcagatcggaggccagggtgcccgccaggctgcctgacacccacagatgggtggagctcagtgctgctccagcgggcgagacgggcgggagaggactgtggcccaccacgtggggcactcttggtgaggcaggcggacctggccctgtgggtttgggggttctgtgccagctctgctcacgtcttcgtgtgtggaggggttgtgagttaggctgtcagaacagtgcgggctagaggcgcacacgtttcatctaggcttcgggcggggcgcagcaggtgggtgaggctgcggtggtggctgctgcccagggtgggaggctcaggggaggcgcttggcgacaggagcaggaagtgatgaggtggggagctcagccgagggctgcacaaagaccttcctggcctgccccagacagagctgaggacccctggccgtgggcttggtaagtgccctcctggggggcagctggggtctgggaggccttgggatgtggctgcagctgggtcagtcagccaggctgaagcccactccctgggtctgagcagactggccccaaactccagagaccacccctcaccccccagcttctgtctctgctgctggactgtgctgtttgtaaggcatcccccaccccgagaagttctgctaagatccccaagaaggggacagatcctctctggcagagacactggcagacaagaagagccagagagaagtggggtgggggcatcagcacccccagcagctgctgctgcctgctgacccagcctccagctcctccgggtgcagggtccctcctgctgaccagcctccagctcttcccagttctgggctccgcagcgagcggcttgggggcactacctgacacaggagaccatgtctgggcagagggtggctgcaggtggagtctgtggccctgtggcgcacacccaggggctcccccgatgctggttactatctgggctatggtggccacagctgtcttgcccctcctcacggccgtgctgggtgttaccgtggtcacccgcagggacacggaggggccaggcagagcagccctagttcacctcaccgggagcccccgccagaaggtgggcacctctgggagggagggactgccaggccttggggcttcctgtgctgagtcagagctggaacgggagacgcaggagccccgcagccgcgggaggtgcagatttggggctgccaggtggcgccaggtccccttggccagcccccagcgcccctttcttctgtccccagggcctcggcttcacaggatggggctgccagtgtcctgggcccctcctgccctctgggttctagggtgctgcgccctgctcctctcgctgtgggcgctgtgcacagcctgccgcaggtaggtccctcagccgcgttctgtctggggcctcgctgcggctgccattcacagcccagcgcgggaaggggctggaggcaggtccgcgcacccagctcggcacgcgcgcctgcaccgggccttggacccgaggctgacgaccccgccccccgccccccacctctacccccaaggcccgaggacgctgtagcccccaggaagagggcgcggaggcagcgggcgaggctgcagggcagtgcgacggcggcggaagcggtgagtgccaggctgtcccggggaccagggtggggtccgcagggcaccgaccagccttcctcgcccccagtccctactgaggcggacccacctctgctccctcagcaagtcggacaccagactgcacgagctgcaccggggcccgcgcagcagcaggggtgagcagagggcggggcgggggcggccgggcggggcttactgtgcagcgcgtgccaacccctgggccagacccgctcctgccccctgcccggagtgaactctgccctgaccccacccccagccctgcggcctgccagcatggatctcctgcgcccacactggctggaggtgtccagggacatcaccggaccgcaggcagccccctctgccttcccacaccaggagctgccccgggctctgccggcagctgcagccaccgcagggtgcgctggcctcgaggccacctattccaacgtggggctggcggcccttcccggggtcagcctggcggccagccctgtggtggccgagtatgcccgcgtccagaagcgcaaagggacccatcgcagtccccaagagccacagcaggggaagactgaggtgaccccggccgctcaggtaacgtgggccagggtagggcgctgtgggtggggccggcagatcctcagcaggttggatggtgctgacccctcctcgggttggcttcctgtctccaggtggacgtcctgtactccagggtctgcaagcctaaaaggagggacccaggacccaccacagacccgctggaccccaagggccagggagcgattctggccctggcgggtgacctggcctaccagaccctcccgctcagggccctggatgtggacagcggccccctggaaaacgtgtatgagagcatccgggagctgggggaccctgctggcaggagcagcacgtgcggggctgggacgccccctgcttccagctgccccagcctagggaggggctggagacccctccctgcctccctgccctgaacactcaaggacctgtgctccttcctccagagtgaggcccgtcccccgccccgccccgcctcacagctgacagcgccagtcccaggtccccgggctgccagcccgtgaggtccgtgaggtcctggccgctctgacagccgcggcctccccgggctccagagaaggcccgcgtctaaataaagcgccagcgcaggatgaaagcggccagcctcgcagcctgctcttcttgaaagctgggcgggttggggcggggggcttctctggaaggcttggagctgtcccctctggccttgggggactggctgcccccggggcgcccgggcctagccgaggcggtgctcctgccggccagactctcggtcagtgcgggcacggggtcccagccactcctagggggcagcgcagccggcagggtggccgcccccgggtgggacttggaccctggactccacgggagggctccgccacccagcctggtgttacataaggggtggtggaggtgggcagtcgagcgttaaagagtaacctgctgccgggaagcccgccaagcaatcgcggccccttccccggctctggcagctctgcgagcgcgcccgtggggaacgggccctccccggcggggcgcgcgggcgcgcgaggtgggcggaggcctcggagctgtgccgggccgggcctccctccctaggccagcgcgggagcgacccggagggggcgggcccggggcggggcctcgaagcgctggccggcgggagcgcggccggccgggcccgcccgcctgcggtgtggacgccgcgcggccaatgcgcgcgccgggacgggacgggacggggcggggcggggcgggacgagacggggcggggcggggcgggccgggcagcctccgggcggcgcggcgcgggcggcggccggatccagggcgggggtcggcggcccggccagcccggcccggcccggggccgcgtcctgagagtcagccctcgccgctgcagcctcggcgcccggccggccggccatggagcgccccccgccccgcgccgccggccgggaccccagtgcgctgcgggccgaggcgccgtggctgcgcgcggagggtccggggccgcgcgccgcgcccgtgacggtgcccacgccgccgcaggtaccgggcgccggtgggcgggggcgccgaccaagtttctctcgctgcaaagatggcgtcagtgctgcccaaacttcgggcccccgggggcggggcagcggggagggcggccgcgtcggtccgcgcgtgtccgtgggtcccgccggggctgcgccgggcggccggggagcccttcccgccgcgccgggctgggggcggggccgggggcggggccgcgccgtccacaccggccgcagccggttttcgaggcgggcgccgagcggatccgcggcggaggttgagggacccccctcccccggccaccgcctccgctgagtctgccccctccccatccgcagggctcttccgtgggcggcggcttcgcgggcttggagttcgcgcggccgcaggagtcggagccgcgggcctcggacctgggggccccccggacgtggacgggggcggcggcggggccccggactccgtcggcgcacatccccgtcccagcgcagaggtgagcgggaggcccggtgcctcgggactcggtgtgcgcaggggcggtgggtggggtgcggagacaccggccccgacggaggccaggtcagggccccaggtttgtaattaccagccacccccaagctcttcagccctggaggagctgagcagaaatgatcgatgactgggagtccctacacctccctccaccgcagttcctcggggctagagctcagaacccggagcgggtggctgtgcgtctctgtgcagaagaggctgcgcggtcggcatggggcgactgtccaggaatccctggggctcctgaccgccacctcccaacccctgccaggccggacacctcggtctggctgccagggcaggggcgggccctggcctggctcgctggggcctggggagctgcccgtgcttccagcccagtctccccctggctgctgccggctgctggccactcccacctcccaggcctggcgtgaggcccacagctgctgttgcacaaccctggttaatgtgtgatggggggaggcctgggcctggcccgcccctctgccagggcttcagacccctgcccagccccagtatctgaaggaaccacagtggagccaagcccgcgatgtggagaactcaggcttcaggagaccctggccctgctcctggcggctccgggtggctttcagctctctctgcaacctgagctgggggaggagccaggcctcatgcccagggctgggagtggggagcctggtgtgcacgcgtgcccaggcctgcacgtggaccgaccaggggaggggcccagagctctggctgggtcacccgcaccccgcccccatctcctccagagccaccccaggaaaagcccggctggacgaggtcatggctgccgctgcccttacaagcctgtccaccagccctctccttctgggggccccggttgcagccttcagcccaggtaagactcagatgtctgcatttaggggtgtgggtggggacagggctcagaacctacagccacccagcctctgtggggcaagcagagccctcaaacctgggactcctttctaaaatggactcccgcaccctcagtgccccctactgaggccaaagcggcaggacccaggccttctggcctccctgacctgctcacctccacgcggctggccacacacgtctgccaaccctttcctgtgccgggggggtttctccccaagccctggggccagctcctccaagacgctctgcccaccagtctcaccggacttggtgaacaggggcagctcaggattagggactccctggacccacccgaagttctaaggcggggggcccgtgtccccacagagcctggcctggagccctggaaggaggccctggtgcggcccccaggcagctacagcagcagcagcaacagtggagactggggatgggacctggccagtgaccagtcctctccgtccaccccgtcacccccactgccccccgaggcagcccactttctgtttggggagcccaccctgagaaaaaggaaggtgagcttgggggcggcccccagggaggggcgggtgtggcggctgagcctgaccctggcccctgttgctgcagagcccggcccaggtcatgttccagtgtctgtggaagagctgcgggaaggtgctgagcacggcgtcggcgatgcagagacacatccgcctggtgcacctggggtgcggcggggcctggggtgcggcggggcctgcgggttggctggggttgtgaggcccggccaggccaccccttcagctcccactggctggctgtgtctcccgcaggaggcaggcagagcctgagcagagtgatggtgaggaggacttctactacacagagctggatgttggtgtggacacgctgaccgacgggctgtccagcctgactccagtgtcccccacggcctccatgccgcctgccttcccccgcctggagctgccagagctgctggagcccccagccctgcctagtcccctgcggccgcctgccccgcccctgcccccgccccctgtcctgagcaccgttgctaacccccagtcctgtcacagtgaccgtgtctaccaggtgggtgaggccacgggtggcagctggggcgggtctcagggctctctggaggggagtgaagccctggctgtgtctccctgtagggctgcctgacgcccgcccgcctggagccgcagcccacggaggtcggagcctgcccacccgccttgtcctccaggatcggagtcaccctgaggtgcgtgtgggctgagggcctgcggctggcaccaggtggggagggtcctggtctcacagcaccccatgtcctgtgaccccccgcacaggaagccccgcggcgacgcgaagaagtgccggaaggtgtatggcatggagcgccgggacctctggtgcacagcctgccgctggaagaaagcctgccagcggttcctggactaagtccggctcgttcaagaacataagctaccaccttctccctccccaccccctccaggcccggggctgaaacagcccgaggacagccccaggggctggctttcaccagctgcagggtctgcttttacttggggtgggggggcggggctgaccctgaaccctcccccccgccaggtcggggaggggtcccaccactcaaagtgcctctaaagaaaccagctttttgcactaaagccaaaccacaccgctgtccccttagccccaagggccctgggggcagccaccctcccgcctgtcggcccgtagatttatcaagggtgttatgggcccagctttggggggccagtcccgatgcactttgaggggtgttggagaggggactcccccactcgcacttaactcaacggctctcgggccctggggctgtttttaccatgtttgtttttgaagctcaggtgtctcacgtctgggctgcaccaggcgaagagagaaattaaagatttgaggtttttccagaagctttgtctgcctctcgggaggaaggccgtggggctgggaccctgtggtgggcaagtgggtggagtctggcagctgcccacagagggccgagggtcacccgtcggccgccgccaccccaggcgaggccggaggaaggatcatctgagacgcaggaggcatctgctggagcagcaatttcccaatttattgaaagtgatcgctttgcaaggatgtctaagctaatcccgtcacagaaaggaaacgcacaggcgcctaggcagaaacttggagactcaccgcagaggccacgtgaacccacggccacagagaggcaggacggcagagccatgatttcccaccgagcgattacgagaacctcttcccccaatagtagacacatctccaatacaaacacaggtttataataagtaataggaagtcaatataatatagattatccccagaaaaaaatcaacaatcttcaaacactgccctttttttgtgtgttttgtttttgttgacaggttgaaagcatgttgaaaaaaataaatatttaagaaaagcacacacagcaccctcactacaagtagttctaaaagggctgcatacaaaacacaatataagatctaaaaaaaaccaccaccattaagtatggctttcttaagagtcgcacatgtcacagaatgagctaaaataagattacttcttttataatattgcaaaaagttccagtttttgcattttctcagttttttaaagaggaagatgtgcaaagttggaagcagtaagctgcgtcttctgagtcagttccctacgtagccctggcagtgtcctgtgtcccaaagctcagagagccccagtgtacaacctggtcaggatccagagcttgacagaaaaatcgtggtgtccctgccccctccccgcccccaaataacaccatccccaatggactgtatttcccactttggtgttgtaaacaccaaaatacaaacagacacaaacaaaaatacaaaatgtgaaatgtaatctacacatttttcctcttcataaaaaaatatttattagtttgaacatcgatttaaaaaaaaatcagtcacataaaaaaaacccttcatgacatgtcttttccctccacgcctcctgagatggacgtgctcacctgggcctcggaaatcccacactcttcagtcggcaaactgcgaacaagaacaggaaatctgccacgcagcaaacacttggggaggtcagtgggacactgttggttttagggaagaaaatgcccctgtagctccggcggggaaccccaaaacggtcagcaaaggcaggccacacggagtgagccggccagatggagcaggacatcctgagtgtggagggggaggcgggcctgggtcctgggcagggtggcctgagagcagggactggtacaaaacccagagacattggtgggtagcaaaggtctggtttccaaatgcattttgtaagaaagtcagtctgtttagaaaaagggtttaaaaatcaggggaaaggtacaaagttctgagaattctcaaagaggccggggtggggctggcctggggtgagggctggagggctccgctgcagctccctggtagccatgctctccccctgggggactcgtgccagagccacccaccttgctcggtaagagtgggcagggctcaccgctgaggggccagcgcttggcccggctcctatccccacactccgtgtgcagaaaaatcttggcctctttctccagctttgaggagcccacagcctccgagctgaggggtgtgtgtgatgacagctccagccagggcaccctgtcattggtagaaccgggggccaatgtcaaaaaacaaaagccgtgactcctgcgctgtacctggagtcctccatgtactcctccacaggacccccggccagccccagccctccccgagcagcagcggtcagggaagctggtgctctacctgacaatgtggggaaaagcctggtatacaggctagaaaaagagagtaaaaactctttccacgcagccctgaagctcagcactccggggggtcttcacacgggcaggtcctggagggaaggaggaggccaccgcgcccacctcccatctgaaggcacagcaccgcagtggtggcctgtgccagaggagggggtgaaggatggaatgtcctcatggtgagtgctgtcagaggcaggcctgaacgagaagacaggccgtggcaacggtcccgaggctgtgagtctaggcagcctgcctccgggacccccaaagccaggcggtgcaccacagcacacaccgtgggacctttgcttttcactcaggaaaagaaagaacatgtgagtgcttctgaaaacacagcaagaggacttgagcacaagctaaaggaaaaacaaccctatatagtttcttcgagtgagaaaaataatgccaaacaaaataattttatgtaactacctcgatatgtctctgactacttaaaaatttggttacccacgcggggaggtgtaagcagcacactgcagttaggaacaccgcctccagtgttagcagcaaaggcaggagcccagctccagcccgtccaggaggggtcagcaggagcggccgggctgggccatgggcagaacaggacgggcagagcccggggtggacgtggcagcccaaggctctccgaggaagtgcacacgactgagccgaggcccttgcagagggaacctggtgtggcctgaagtggtggggggcacagggctgagggtcccctcctggaaggagcccccagggctgtgtccacctaagatagcacctggagccctcggcctccagcagggtctgcagctgtgttgtgtgttaagcaccaaagcccagaggtaagacggtggcagggctctctgtgcacctggattctacaggctgccatgggccacggctgcaccacgggccacggctgcagccacaggcagtgacctggctgctaggggaggggagggcgggctccagccgggctgaccgggtgtctgtaaaactctgcacctgctcaggccaggggcctctgggccgaacacaccaccccgcccagtgcccactggacccggccacaggcccatcacgtgtccaagccaggctggccatcacaggggccactcacacacccgcaccacctgctggggacttaggaccgtgctctcccttcactcaaacccaccctgtgccctcccccaactcacttcatgtctggtcccagagcacccctcttgctggggtcgcacctgcttagcccgcagggctggtttccgtggggggtgggttcagggggaagcagaggaggggccgcgagaggggtgagcgtggccctggccccgcagtggagacccaccggacacacacacgggtggacggagcgaggcagccaccgaccctgccggcgggcgggcctaggagagccaggcgaagtccttgtcagggcctcctggggggctgcgcggccgcggcgagtcttcctcatccttgtcgtccgccaacagcgcatcctcaggggccaggccctcgtcgtcctcgcccagctcctccgcctcccctcgtgggtcctcagggtcctccagatagggcccgtcgcctgggaacagcgcctctggagagccctcgccgcctccgccgccatggtccaggggcccggccatgccgcggccagcacagtcggtgcacacaccgtggcgcctggagccatgcctgatgcccacgctggcggcggacatgaagacgcggctgcacaccttgcacacatacttcttgtccttgctgtggacctgcagaggcagggcagggggtgagcagggcctggtgggttggggggcggggcagggggtgagcagggcctggtggaggtggggggggcaggtggtgagcagggccaggtggaggttggaagagggggcagggggtgagcagggcctggtggaggtggggggggcggggcagggggtgagcagggcccggtggaggttgggaggggggccagggggtgagcagggcctggtgggtggggggggtgcgggggtgagcagggcccggttggggttgggggggcacagcctcccgggccctccgagtgtctgcacaggcagagactcctggtgggggaggtgcgcagacaggagtgctcagaccttgagccccagctcctatcagagccacacagcagaactgcaggtggcaccaaggcagccctgtcccaaggggatgctggcacgagggcggcagtgcccctcccccgcaaacccagcccctaggtgggccagtctcagcgtctacactgtgtgtccaagcacccccaccagaggccccctgggttgacacacttctcacgggggtcacaccaccggcctctgcctaaaagcctggcttcctccaaacctccctgcaggacaggctgagggccccgcattggactggagctcacagagctcttcctgtacccagccgtacagggacgggccggggttggggctgccagccgggcaggtgggcccacacctcagcctggctgcgtggacaccccctcagcccctgaccccctcagtccctgacccctcagcccgaccctgactccaggaacgtgtaaaggaggcaactcccccactctcaggctgtttcaaggtcgactgagacatgcaagaagagagatgagcacttatggtcagaggaggaggtgtggctgccagggagggcagtcgtgctgtgccctgtgctgggcccggcagggagatggggcagcaccctgaagagggcccatgtggcaggacgcgaggtgctgggttcctggagggtctcagcactggcctcaaggcctgagggaactaccacacactgctggggacatgtggccccaggtgggcttccgctgagggtgggtgtggacacctgtgctgtgcagaaccagacctcagacatggccagggatggggagaggtggcccttgtacccactcacgggcaccctcggccacgccagctagaggaggccttggggggctggccctgatccctcacagcacagcccctgtctctgccctccaaggaccgagagggcaggacccacagaggaccccaatagcaacccctggcccctggccaagtccacacgaggggcttctctgaggtgggctggcctcaggtcagtcctccaggctgaacccggcaatgaccccaggctcccctcggctcctccctccatccacagggctgtctcccggggcctgcagcacctctgaggctgcacggagaactgaggctgggatgtgcttgtgagtttagctcttccttaaaccattccaaactcaccagttttctcccatgagcaagtacatacataatcaatgtgtgtcatggcggaagacggtcctgctacacttgcaaagacctctgacgggcaggcaccacagctaccacctccccatcctggggctggacccgggcccttacgtacttcctgcctcagtgttccgaatccacaggccgacaggccacccagcacggcccgacctccccttctagacccgcttccttgagggcagaggtgcctgtaacttcttccacaaagccgggaaccataaagacctcacttctcaaatgtctgcttccagagcaactgtgtgagctctaagcctggaccgggatgggcgctgtccagggatgtgagaccttcaggggcagctggtggctttcagggccagggcagcaccacacagcacacctcagatgcccaaacacgctaaccctagaaacagagcctcagacaacttggtgccagaactgctcctttgggcttttgttttgctgtattttatttatttatttttttgaaacagagtctcgctctgtcacccaggctggagtgtagtgttgccatctcggctcactgccagctccgcctcccgggttcataccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgccttggcctcccaaagtgctgggattacaggcgtcagccaccgcgcccagcctgttttgctgtattttaaaccaaggacttccagaacaaaaattcaagacaagccacagtagaaacttcccagcacagtaacctggtgcacacaggcccaggaagggttggagcggggctagtgaaaaacactgaggccccttgaggcctaggctcccatgtgtgcaggggccagggcacctgaggaggcagcaggggcagcttggggtggcacagggaccatgtggccagggctggatggctgggaactcatgcaaatgggcaaatgccctggaaggaagcaagaaggaagacgggacaccttggcagcccgcccaggctctggggcactgtggctgcaagagcacggctggcccaccctccaaatgtggccctgccaaggcatggggggccctgccccagccactggtgctcttcctggagcgggtggaggggccacccaggccagggaagggctgacagtgctcgtaagtgccatcgtgaaagtggaggctggaccggctagagctgctgtctcacactcgggtctccacgctctcaggtccaggaccccagagaaggccacacacagagcctctcctcagaaaaagtcaagccccatatgcttgcttgtgtttgttgttctttagagacagggtctcactctgttgcccaggctggagtgcagtggtgcaatcacagctcactgcagcctggacctcactgggctcaggtgatcgtcctgcctcagcctctcaagtagctgggaccacacttggctaacttttttttttttttaattttttgtagagacagagtctcgcaattttgcccaggctggtctcaaactcctggcctcaagctattctcctgccccagcctcccgaagtgctaggattacaggcatgtgccaccacacttggctttccatatgttataagtacattttccagggaattatgaccccctgaagcccaatcatgaaccccaggacaaaaatcccagccctggtcggacacagtggctcacacctgtaatcccagcactttgggaagcagaggcaagtggctcacttgaggccaggagttcgggactagcctgggcaacacagcgaaatcccatcaccacaaaacgcaaaaattagctgagcatgttggtgcacacctgtagtcccagctacttgggaggctgaggtgggaggatcgcttgagcccgggaggtcaaagttgtagtgagctgtgtcacgccactgcactccagcctgggtaacacagtgaaaccctgtctcaaaaaaaaaacaaaaaaacaaaccctaaccctatccaacgagaaggaacaggcagccacactgaacctcaaacaggatcaaaacgtttactgagaggttaatacggatttgctgaagaaagacgttgcaatccatgttgttaaaacgtgttagcacctatcagtttaaaaaacaagatgcgattttctctgaataggaaacatgtcggcctggtgcagctacccctccccccgcccccgcggctttttataagtggtttgtaagatcagccctgtggcctgtgtgaacagaagcacatcctccgctacggaaaacaaggctggggccccggcggctccgcgtggatgtgggtctgcttctggccttgcagacctgccatctcgtggtccaggggccccctcccaggactgttccttctctactgtcctccacctcgcaaaggcaaatgtgggggcatcagggaaggccagagcccagcactaagccccgctccatatccactccagcacacatcccaggcggcatccgagggcctggagtggcccttcgcccacagccggccaggcaaacacggggaggccagggccctgcacccctctagctctgcagcttgacctcagggagctcccacaggggtcgttaccccaaatgggtatccaccactgcactggaaaagcagcaaccaacagaacctgacctctggcgctcggttccgccccccagtgggtctccccataaagccccgccccccggtgggtctccccatgaagccccgccccccggtgggtctccccataaagccccgccccccggtgggtcgcaccatgaagccccgccccccggtgggtctcccatgaagccccgccccccggtgggtctccccatgaagccccgcccccggtgggtctccccatgaagccccgccccccggtgggtctcccatgaagccccgccccccggtgggtctcccggtggagctcggctcctgcaggtccgctccggaacctgctgactctcctgcgattcctaaactggcagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccccgaacccttggggccgccccgctctgggctgcctgtgccccacccgcctcactggttgatctcacccacttgagatgccctcgccaggccttttttggcaaatctgcctccctgttcccaggctgcctttttctattatttcctccccaagcaaatccatccactccacacctgctacctgacaacgacctgccagtgctgagctccagggtgggcgcggtgggtgcagacaggtcggcaggcacaaggacagggttctccctcccgaggcagggcgggggcgggggggcgcagaggtggctgagggttgggggctccaagcagagcgagctgagtttgccgaggcctggctgccttggcggccagcaggtgagcagggtgggccgaagcctctgcaggggccatgtggcccagccacacccaggaggccggggcagagcagacaggggcccggggcggatctccctgccctgctgtcgtcccccctgtgcagagtggacccggtgtggggtccggggcggtctgcgccctcatcaggacccgcctgcccggacatcgtggccacgcgcagcgcgcggcacgcggaccctccccgcactcaccagcgtgtggcgcttcatgtgctcgcgccgcgtgaacttcttcccgcagatctcgcaggggtagggccgctctcccgtgtgcgagcgcatgtgtcgcttgaggatgcactggtgcatggccgagaagctgcagtacggacacttgaacttcttcctgatcaccgtgaactcattcactgaaagagagggacccgcgaggcgtcagcagggcttgggatgtaccgccctgcggcccacagaccacggctgcacgccgcagcccagcagccaggacgggctgtctcccacggccacccactgggggctggtcagcactgcgacaggccaggctcccccaccatctgcataaattgtcccacccactgtctggcaggggcggtgccagcaaggctgagccccagggagctcaggagccccagctctcaggagatctttccatccaggccaaaggcaggaggcaaggggtaagaacggccaatgctgaacacagtgcccggtccctgcaggaccctccttccagccctcagaccccactgggcatgtgtgggtagcaggccctgggcgtggtgtccgatcagacgcctccctggaggcagagaagaaacaaacactgtggagtaatacggacccaaaagtgtgcaggcgaaatgggagatgtgggtgcaactcaaagtcctgggctcttcttgctggacgccggagaagcagccagacccatttaatcaagttcttttcccccaaccctgagacccaacgtcactcagtggcaggaactccacaccaccatctccatggtgcgtgccctggggccaggctcaaaaacctgggggaccctcagcacgcccagtgccgttatgctactcaggcccagataccagcacgtcagacctgggcatgggccactgagagagcccggagcagccacgtccacgggaccctacgggagacccacctgaagcccggtgcacgcatgtgccgagggctgctcaccctgggattaccatgtacttgctgctgtgcaggacatcttcccctctgcatactgtgaccacctttcagtgctgggatttttaactacacagcttttggatgtctgaacacatcataattaattaaacaggcactactgctgaacacgtttctgtgttttcacccttgtggacccttcagtgaggctcctacagatgggtctttgcagccctctgccacctcctgaagataaattctgacaagtgggataagcacctgccctcctgaccagcagtccccacttgccctgcagggagggtctactgaggctctgggggctccagtggacaggcacacccccatgacaaggatctcccaaaaggcagctctaacaggaaactcagcatctgccaggagcgctcattttgtgagactggagcatgtctgtgtggccaagacacagaaaaccccggaggccccgcctggcacggcagcacctctgaccagctggctgtgttcggacgcatgtccccgccgcacatcccccgagtggctcctgacgaggaaatcccaagctcttcctggcctgtcctctgtcagccacactgtgcccctggctctcctccgtgagtcagtaacaagagacttctccttaccgccaccgtcccccaggccacccttctcaccctgacagcgcctggttctcgcattatcacacccaacagagcaaacgctccacacattctaggctagaaaaggagagcaaggaaatgagtttttctattagtttatttaaaacagcattttttttctctttttttaaacaagatgaggtctcgccatgttgcccaggctggtcttgaactcctgggctcaagcgatcctcccgccttggcctccaaaagtgatggggattataggtgtgagccactgtgcctggcccaaaacaactttttttttttttagacggagtctcactctgtcacccaggctggagtgcagtggctcgatctcagctcactgcaagctctgcctcccgggttcacatcattctcctgcctcagcctcccgagtagctgggactacaggcgcccgccaccacacccagctaattttttgtatttttagtagagacggggtttcaccgtgttagccaggatggtctcgatctcctgacctcgtgatccgcccgcctcggcctctcaaagttatgggattacaggcgtgagccaccgcgcctggccaaaactcttttgagaatatattcattcatggtttctactcttcctatataaacatgaaaattaaaattttgaattatatattttagccatttttatttaattcagacctacatgttaaatatttatctctgtatagaaaccctgtatttttttacctagaaaaacaacttagaatggacatgagcaggactcagcgttaataaccccgtgagaataaacgccacggacccagggcagagccgcagctgcggacggtcccctcaccacctgcatgtgctgaagctgcctgcgatgcacttcggcttcttcttaatgctctgttttccggtcactaccataacacagcaccacaaagcgtgaggctcagaacagcccggtccactctcttgcagttctggaggccaaaggtcagagatcaaggcatcagcacgggctggctctctccagtagctccggggagggtccctccggcctcttcagctcctagtagctccagctgccccttggcttgtgaccgcatcgctccagtctctgccaccatctgtgtggccttttctctgtctgtgtctcttcctcttctcttagaaggacacttgtgattggacttaggacccatctggacaatgcaggaggacctcattttgagatcctttatcacatctgcaagacctttttccaaagagtcacatccacaagctctgaggatcaggacggagtgttcactgctcaacccacgacatttgactgacagtactgtgatcattgagggaatttcactggctgtcattactaaaataatttcttactggaaacaacaccttccatgatttatttgtgatttacagtctatatatcttagaaaaaacttacatcacgtagcttcattctcataaacactgggaagcctttaaagtccatttggtaacaggaattaaataaaaaagcataaagatcattacacggaaacgggcactctcacgacctgtcctaaaaacggaaccctttgccaggaatcaggtgttctcgcaaggaaaaggccaacttccaaaagagtaactgagaagcgatgctatcagagctggcgtggaccccctaaaataggacattcagcgacatccggctgcgactgtacagaattgcccctgtgaaaacactgcagtcattcgtgccggactggaggcctcccctaagctcagggaagagcagaggtctctggcctccctgcaccaagccaagtcggctgcatggccacctgcccttggcccttcctctgtcccctcccagtgcgctttccgctccaggagaatcggacctgtcctaaatagccactgtaccagggaacattccagaaccttttcatgatagtgtcaaagactgcaagaaaccagccgtgaagcaaatggactggcagttggcttcagacgggcagacaggggacaaggcatcttcggagggttcaagtttgctgcttcctgagtcttcatcacaaaaccatctggatattgaattggtctggatataattttcaaaagactgcactttgagagcatctccgaaagggatccaaacatcaactgttctttgtttttttgtttacaaatgtattaggctgtcacttaactctgtgttagaatgtgatgaaattgtgatctgtccagattattttcaaaaacgttttaagccttatgtaaagtgcaaatacgtatacagctcaatgaactttatctacatacaccacacatcgccaaacaggcactgcgtgttcccagcaccctcgaacaagcctctggccctcccctagttgtaacccccagagagcaccctctgccctcaatcaccacacgttttattgccctagggcttcgtatacgtgggatcctaccctcgtgttgggctttcttcactagatgtggcccgcactgctgcctggaggaggatgtggttgtttgtggtgcgtggtactccatgacaccactaagccacatgtccatcctgtagataccagtttgggcctattgaacaatggagatctgatggctcttacatgtgtcttttggtgacttaagttctcattatttctgttgggcatgccctggcggggaaggggggcttctggaccacagggtgttcacctgcttggcttccgcagatattgccaattttccaaagatttatgattcctctcaaagtaatttttgtgcttggtcagaactaggggtcaagattccctatttttggggaggggaacagaatcttgctctgtcacccaggctggagtgcagtggtgcgatctcaactcactgcaacctccgcctctgggttcaagtgattctcctgcctcagcctctcgagtagctgggattacaggcactcatcgctacaccaggctgatttttgtattttcagtagagacgcggtttcgccatgttggccaggctggtctcgaactcctgacctcaggtgatccacccgcctcggcctcccaaagtgctgggattacaggtgtgagccatcgcgcctggccacgattcacttttttcctccatgtcaatgtccagtcactcagcaccatatcttgaaaagaccatctgtcccacattgagttgcagagtgggctttctggtgcctcacgggccctggcggcgtgtctaccctgcatcaccaccacagcgtctccacgacggcagcactagaagccttgatgtctgcatctgtcagtcctccagctttctccttcctttccaagatcaccttagccatgtgtaggaaccctggcttttatttccaggtttctgatgccctgacatctggggtctccatgaccctgcaggaacttcccctcccagttcctagagatagcagtcggaatcacctttgagtgcacctttcacaggtgaaccaacccatccagagctcacactccctccacccgccccgtccagggctcacactccctccacctgcccatccagggctcacactccctccacccgcccatccagagctcacactccctccacccgccccgtccagagctcacactccctccacccgccccgtccagagctcacactccctccacccgcccatccaaagctcacactccctccacctgcccatccagggctcacactccctccacccgcccatccagagctcacactccctccacccgcccatccagagctcacactccctccacctgcccatccagggctcacactccctccacccgccccatccagagctcacactccctccacccgccccgtccagagctcacactccccccacccgccccgtccagagctcacactccctcctcctgctccataggttctcacactacagccagtatcccctcccctaatcacccctgggccatacaactagacacagctcctatgcccagagcctgctgaaattattcaaatcacacaatcccaaaccagcttaccctgccttgcccgttcctccccacagaaaccaaacaaggctccggcctgcatttccccctctccctctgcctcctgactgaccctggtgcttccccatgtgtctctgcctgggctggtgggcctgctattctggaaattggtgagtgtaacaaacttcttccctttatgagttatttctgtgtctgtgtcctacgacaccagattaacacaaatccccaggtgcccttagatccctatcctagatcctttgcatctccaaatatatttagcagtcagtttactcacacacgcacgcgcacgggcactcacacacccctctgctgggatcttaaccagaattgtgctgacccaatatatcaacttaaggagagtcacatctttttttttttttttttgagacagagtcttgctgtcgcccaggctggagtgcagtggtgcgatctcagctcattgcaagctccgcctcccgggttcacgccattctcctgcctcagcctcccgagtagctgggactacaggcgcccgccaccacgcccggctaatttttttgaatttttaatagagacgggtttcactgtgttagccaggatggtctcaaatctcctgacctcgtgatccggccgcctcggcctcccaaagtgctgggatgacaggcgtgagccatggtgcccagcggagattcacatcttaacaatagtgagtcttctcctccatgaacatagtatctcccttcatttatcattatcttctttaatttctcccagcaatattttatagttttctgtgtagaggtctttgcatattttttgtttaatttattcctaggcatttgatgtcctataaaatgaaactctgttatttatagaaatacaattgacttttgtatattgagtttcgtacattggctgtatatccagtatatttaattatcctgttaaaaatctaagtttctagattcttttgaatgttctatatgcatagtcatgtcacctacaaatgatgcttttacttattcccttccattcatttctttttcttttttttctttagtaaagacagggtcttgccatgttgcccaggctggtcttgagctcctgagctcaagtgacccacccacctcagcctcccaaagtgctgagatcacaggcatgagccacagtgcctggcccctttcatttatcactgtattgcacagcttgggacaaggggtaggactcagggaggaggggggcaagggaggttcctgacatgacacaaacattaggaaggcaagagctctcaggggcagccctgcacacacaacccgggcaggatctccagccaactctgaatataagtggtgacgatgggcgtctgtgtatcgttcccgtgctcagaggctaagtcatcatgatttcacaattaaccaaaaggttaacttttttttttgtagatactttttgtcagatttagaacatttctttatactccaatttgccgattcttatcacgaaggctactgaattttatcaaaagtgtttcctgcatttattgaggtgatatagcgggttctctcctttattcggctaatgtggtaaattctacacattgattccaaacactcacttaaccttgagttcttggaatgagcctgcggaccatgcaacacggttcttcctctgtctcactggattcaatttgctggtatttactttaatagttgcacatctctgctgagtgataatttcctttcttgaaatgccacgtcaggctctgggatcaagaccatgccagcttagataggctggagactgttcctttcttctagtatttggaagatatgtctaacgttggcgtcattttcttccgttaaaattggaaagaattcactagtaaaggcactcgccctgaagctttctctgtgggaaggctttaaagttattaattcaattttctcagcagatcataaaaccattgagctcttcctgtttgctccagttttgataaattctgttttccaggaattttcccatttcctccaatgtgtcaaatatattcgcataaagttgtgtataataatcttatctatccaatatccgttgatcacttttcacaggagttatatcagtgtttttgttttttttttttgagacagagtctcactctgttgcccaggctggagtgcagtggcacaatctcgattcactgcaagctccgcctcctgggttctcctgcctcagcctcccgagtagctaggattacaggcgcctgtcaccacacctggctaattttttctatttttagtagagacagggtttcaccgtgttagccaggatggtctcggatctcctgacctcgtgatccgcctgcctcggcctctcaaagtgctgggattacaggcgtgagccaccgcgccaggccgagttatatcagttttattatcttttcaacacactggctttgggcattgttcactttcggttttggggtttgcccaggctggaatgcagcagtgcaatcatagctcactgtaaccttaaactccttggcctcaagcgagccttctgacttaacctcccgaagtgctgggattacaggtgtgcaccaccatgccagctacactgttgatttttgtatgcctgctttctacttcattgatagctctttttttttttttttttcagatggagtctcgttctgacatccaagctggtgtgtggtgccatgatctcggctcgctgcaacctccgcctcccaggttcaagcaattctcctgcctcagcctcccgagtagctgggattacaggcacccaccaccatacccggctaatttttgtatttttagtagagacagggtttcaccatgttgaccagactggtctcgaactcctgacctcaagtgattgacgcacttcagcctcccaaagtgctgggattacaggcatgagccaccacactcaccctgatatctattctttatttcccttctgttactttctttgggcttaatttgctatgctttttcttcttgacaaagaaatttagaacctttcttctgtcctaatatataactagagctgtaagtttcccttaaatattgctttagatgtgggcctaaaagttttgatacagcattttttcattatcattcagttaaaaatattttggccaggcacggtggctcacacctgtaatcccagcagtttgggagtccgaggcaggtggatcacaaggtcaggagttcgagaccagcctggccaatatagtggaactctgtctctactaaaaatacaaaaattatccaggcgtggtggccggtgcctgtaatcccagctactcgggaggctgcagcaggagaatcacttgaaccccggaggcagaggttgcagtgagcagacatcgcaccactgcactccagcctgggtgacagagcgagactctgcctcaaaaaaaaaaaaaaaagtttatcatttccatagggatttattctttgacttgagggttgtgtaaacgtatactatttgatttgcaagcatttggggatattctagtgtcttcttgttactgatttctaattccagtttgctaaggtcagagaatatactctctgatttcaatcctttgatatttgttgaacctgaattatggccctggttggtctattttggtaaatgtttcctgtccatttggaatatcctgcacttttggtgtaacgttcaaactgggctaattgtgctgttacagccagtatctctatgaacacagatgcaagactcaaaccaaacattagctaactgaatccaataatacagaaaaagaatagcagcttgtgaccagatgtgtttatttccaggaattcaaggtgaatttaacatttgaaaactgtgttcaaatattctctatccttactgagattttgtttgctgttctatcaattactgagataagtgttttaaaacccccaattgtaattgtgaagttatctctttttttagttctgccagcttttacctcatgtattttaaaactgagctgttgccgggcacagtagctcacacctgtaatcccagcactttgggaggccgaggtgggtggatcacgaggtcaggagatcgagaccatcttggccaacatggtgaaatcctgtctctactaaaaatacacaaaaaatgagccagggtggtggcacgcgcctgtactgccagctacttgggaggctgaggcaggataattgcttgaacctgggagacagaggttgcagtgagccgagatcgcgccactgcactccagcctgggcaacagtgagacttctctcaaaaaacaaacaaacaaacaaacaaacaaaaaaaaaaccaactgagctgttaggagcaatatgcattaggattgttatatttactactgaattgactaattatcattatgccagtccctcttgagtaatacttctcaaagtttactttgatattaagattgctatactgactttctttttggttagtgtttgcttgattcatctttttcttttctttttttcttttgtagagatagggtgttgctccgttacccacgctggagtacagtggcacaatcatagcacatggtaacctcaaacttttgggctcaagtcatctcctgcctcagcctcccaagtagcttgaatcactggtgagcaccaccaaacccagctaattatttaattcttttagagatggggtcttgctaagttgcccaggcaggtctcaaactcttggccccaagtgatcctcccaccttagcctcccaaattgctgggattacaggtgtgagccactgtacccagccaataaatagtttttaaaaacaggctatgtgttttgttcatttttaataatgtaattattgatgtggctggtgtaaggctatcatcttgttttttatttgtcctttatgctttttgttcttattcctcctttcttgccttctttcaaattaatcacgtattgtatcgggccattcttgcactgctataaagaaatacctgcaactggataatttatgagaaaagaggtttgattggctcacggttctgcaggctctacaggaagcatggtggcatcagcttctggggagaccttagggagcttccaatcatggcagaagtcgaagagggagcgagcgtttcacaggacaggagcaggagcaagacggagggtcatgggggaggtgccacacgcttttaatcgaccggatcttgtgagacctcactatcatgaggacagcactaaggggagggagctaaatcatccatggaaggtcccaccaggcaccacgtccagtattgcggatcacagttcaacatgagatttgggtggggacagagatccaaactgtatcaagaattattccatttcttctcctcattgagcctttgaatcacaccacttttcctattttcagtcatcattcctgtgactataaagagtcagaaccacacgacagttaactctcatccaccccacatgctaatagtgtcatatgttttgcttctatttaggtttaaaaatcccccaaattataattgttgctttaaacaatcaagattattttctattactcacacagttgccttatctggtgctttcttttttctttttcttttttttttaaataagagacggccttgctctgtcatccaggctggagtgcagcagtgcagccacaactcacaccagcctcgacctcctgggctcaagcgatcctcccacctcagcctcccaagtggctggaactacaggcatgagccattacacccagctaattaaaaaaaaaaatttataggccaagcacggtggctcatgcctgtgatcccagcactttgtgaggccaagatgggtggatcacttgaggccaggggttccagaccagcctggccaacatggtgaaaccgtctctactaaaaatacaaaaaatcagctgggcatggtggctcacgcctgtaatcccagctactggggaggctgaggcaggagaatcacttgaactcgggaggcagaggttgcagtgagcagagatcgcaccattgcactccagcctaggtgactgagcgaggccctgtctcaaaaaaaaaaaaaattgtgatgaatatttttgttgggtatagagttccaggttggcatcttttgctttccagtacttcaaagacgtcattcattgtcttctagcttctgtagtttctgggaaagtcagccatcactgttgttcttctgaatgttaagcattttttctctgttttttttttttttgagacggagtttcgctcttgttgcccatgctggagtgcaatggctcgatctcagctcaccgcatcctccacctcccaggttcaaacagttctcctgcctcagcctcccgagtagctgggattacaggtgtgtgccaccacacccggctaattttgtatttttagtagagatggggtttctccatgttgaggctggtctcgaactcctgacctcaggtgatctgcccacctcggcctcccatagtgctgggattacaggtgtgagccactgcacctggccctctggctgcttttaagatttttttttgtttttcttttgagacggagtcttgctctctcacccaggctggagtgcaatggcgcggtctcggctcactgcaacctccacctcccaggttcaagtgattcttgtgtgtgtgtgcgtgcgtgtgtgtgtatgtttgtatgtgcatgtgtgcgtgtgcatgtgtgcatgtgtatgtgtggttgtgtgtgtgtgtgcgtgtgtgtgtgtgtggggcttagaggcttggggtggggggcagttgtatgcagaagctggggtcctcctctttgtttcttgcttcttgggattttgcccctcaagtcccggctcctctggctgccccgaaggacaatctctatctgtacactgccgtccgctcagggtccacttcctgctccagggtttgggaaatatgccagcaacaccactggggtgaagggcagctcatctgtgttctctcttctctcaaggatcacagcgttgtcccacctgcactggcccccttcccgggtaggttatgtgtgggcgtttcttttcttttttgatacagggtctcactctgtggcccagctggagtgcagtggtgtaatcatggctcactgcagcctcgacctgctgtgcccaagcgatcctccctcctcggcctgccgagtacctgggaccacacgtgcacagcaccacgctcagctaattttaaactttttctgtagagacaaggtctccctatgttgcccaggctggtcttgaactctcaggcttaagcaatcctcccgccacaacctcccaaagtactgggattacaggcatgagccattgcacccacttcatatgctgaatgaatgtctgtgtagtttcaggggaaagaatgttagaagtagggataaagtcatactgctatctattctaaaaatgttcttagagcccttatcattttactatctgccacgagcatatttttttaggttctatggcacatgtctacaatttttaaattgttttcaaaaagttaaccaaactctttcagcaaaatggtacggagagaatctctacaaccaggcctccttatcaacccccaagacaactctctccccgctgggcccacctgctgcccaccctggagagcaaaaggcaaagctgtcatgcggcctctgatgtacctgcttcaacagcactagggtgtgccctgcccatgaacgcagagcccaggcgtggactaatctcacagtcagatgccacaagtttcttctgtcatggtgcccaggttgagacatatcatctcaggcccaacagctgagagatcctttttttttttttttttttttttttttgagagggagtttcgctctcgttgcccaggctggagtgcaatggcatgatctctgctcactgcaacttccgcctcccgggttcaagtgattctcctgcctcagcctctcaaatagctgggattacaggcgcccgccaccacgcccagctaatttttctatttttagtagagatacgatttcgccatgttggccaggctggtctaaaactcccgacctcaggtgatccgcccaccttggcctcccaaagtgctgggatcacaggcatgagccactgcacctggccaagagatcccattttgaccaaaaaaaaaaaaaaagcttcattttctctacaactgatattaaaactccaacaggcatttgcataaagaggcgtctggcagctcagaaggcacggcctgtgtggactgctctcccgaccctcacagatgccagcagagcgcggtcacctttggtaaaatgccccaaacctcactagaaatcccacttttctccatcttcagaaactcatctcaggaacataaaggaacataaagatttgaggaaccaggggaggctccagcagatggttccagctgcagtggagatggggaccgtccggaaaggggatgggctgttgggcagatggtgggacgcgtctctggcctgggagcgggctcccccgacacgccaccttccctgccagatggtgcttctgggtattccagaatctggaatgggggatgcctatccccctcctgagcccacctgctgctctgggtccctggagcccaccaagtccacaaccacctgctctgaatagaaagctgacattgaacctaacacgtccgacgaggacgggcaagggcaccgcggggcgctctttctgaaaagcagcacattcccgtaattccacgccgacacgtggagcgccgcgcacatgccaggcacacaccgccaaggacgccgtggcaggctttgtctttcgatctccctagaaagttgctgggtcggagccacgtggctccacttcccacggatggggacatgttttcccgcccctgaaagccccccgtccccacacattggcaatcccgtaggatctcggtcatctgaaccccgtcgggcagaagctggaggtccacccgccccagctgcccaccggctgggcatggagatgccttcacctggcagcagccggcagaggactcgagaaatgaccacagaaaggcacacaccggctcccagtcacagctctccgcagatatccccctccgacgcggctgttcggtcacccagttcccctcctgctcccacacacttgagagctctctcgcctgggcagctgcacccagctggagcccgggacccggacgccaaagctctggccgcagcactgaggtcaaagcaaacgccggctccagcgcacagaccagaggcacccgcagttctgtcccaaaccacttccagcaggggaggtgccttcgctgctgtcacttgcttcacagagctccttagctggcctcagggtaaagctgtcagcgcccaaggagctccaggcgaggccaagccgtcctggcactggctgcccccagggctgggcaagtccatccagggctgggcaagtccatccaggcctgggctggaagaagactcctcaggcatcctggacaggccacaggccctgcagaaacccaccctcatgccagcgggagccaactctggaagaggactgctccgcccagctctccacgccatgagaggtgtcgatctggaaccagagacagacaagttacagaccgtcaggatgggataaaagcagcaagacttctagtgtggacactctgctgccctcactcacctgggatgttgtccaatcactactaagacagcctgtcaacagccatctggaaaggaagactgtaattaattctcaataaagagacactcaaaaatatatgcattaacaaaacattaacacctgccaccaaaactatcctgtgagaaatgagaaacgactcgtgtgggaatagcaattaatttcaaaatccaaaatgtgtggttaaggctgggcaccgaggctcatcctagcactttgggagaccaaggaggctcatgcctgtgatcccagcactttgggaggccgaggcaggcggatcacctgaggtcaggagttcaagaccagcctggccaacatggtgaaacctcatctctactaaaaacacaaaaattagccaggcgtggtggtgtgcccaacgggataccctaacctgtaatcccagctacttgggaggctgaggcaggagaatctcttgaaccccgaaggtggaggttgcagtgagctaagatcgcaccactgcactccagcctgggtgacaaagccagactctgtctcaaaagaaaaaaaaaaaaagtggttgagctcttgttaaagaatttttttttctccagggaggtacacaccccatggccctttctttatagaaaagactccgcgacttcaggcacaggaaggagaatgccttccaccagggctctgcgcggctcgggctggggcagtggaacggcttccaccagggctctgtgaggctcggactggggcagtggcctccgagtcgggggttggccagaaatgtgcagtgaccaggcctggaagggaccggccaccaccactgagctctaggaactgatgtttccaacccactgcaacatgaattgaatgtctttacattaagggaaaaaaattgctcaaaatataaaaaccaattcaacttcatacaacctgttgctgtgggagtggaacaattactattgcaaaagcgaataactcggctgacctaaaatgggttttctctgtacctggctgagttgagggtgggagaggagggcacatggagagcaggtgccaccaaagtgcctcctcggaggtgcccgggctcatctgggccgtggccacgcacacatgggtgtcagggacaccatgccccaagtgtttggcccagttgccccagacaaagctggccaccctggtgtcttacctgagctgggggaggctgtgccggctccctgggctgggtctggcggttccccagagctcatcctgtggctctgagggtggagggtggaggggcttctgttctgccatcagcgaccctcacaagggacccaggccctgggaacacaggaaaggaggagtctcacccacaggaacgcgcaccagctgctgggttctagagagttccagaagcactgacgatcttcccggcatgcggtgtgagcccggtgatgccccaagggtctcgctggaggcaggtgtttgaacgctttgatcagctggccaaccccaaatgcccgaggtctccacccatgacttctctgcggtgtgtctctttcctaggagccaagtgattccaacagagggttttggtggaggaagtcggagcgtgaacacctctggactgcagaaatgctctcctgatgagaacgccaaggcacgctggcctggaccacctgaaagtgcagcaccatgtccaccaaatgccctttagtcggcaactgttcacaattccagtctcgatccagaatcaagttaaagttctcgattcatcctttaaataccacagggaaacagtctttaaaccacaaccaaaacaaagacaagctgcaactgttctctgcaaaacgcctcctgacgcccgggcccagccgctccgccatctccacggccaccttctccagtaacgagctggtcagaagccgtccccgcaggaaaggactgcagggagctggggtgagcttcacgggaggcggcaccgcaccgccatggctgtccctagaatccttgactctttaaaagagtgaggggggttacaccagcaacgctccagaggccgcgtcccacatttccgggcacggctgatgcggggcttacagtctcctgtccccggccgaccggccggcggcgcatcctcggcttgtcagtgtgaagttggcttcctcgtgctgtttggagacacgaaggcagcacacacctcaaggccccaggagatcagcgccagcccagcacaacttgtgggcagccatgttctgagcctaaatgacagttttcatggtttctactgggagaacaatgtctagtaacagagaggaggcccgcctactgctgaaaaaggaataaaagtaagcacgaagttcaacagaattgaatgagaagtatggcaagtcctctgacagggatgtcagagattgatggtctagtaatgaaactgccatctgtttaatttaacagccaagccaaggttactggtcctacaaatccaaggaaactagttcagtttttctagaatgttccagaacccatccccaaaggccctctgagtgtcggctgctctgtgctgctggcctgctgcctgcatatttaatggttctctaaattcagaaatctgcgaccaccatcccatttttgtgcagaattgccacggccggacgctgtttgttgaaccacggcgcattcatgacgaggagaactgggcaggcggtgggatccccacccggcaccccgtaccgcaaaggggcagtggacacacagtgaggaccgccgtgtccccatttcctgcacgatgcgccagcccacggggaggtacactcgacaggacaccctagagaccacgctaacaagaggcccagccctggaaatgctcatcgcctgcaaccagcacatggagatggtcgcaagtcagcaccggccacgcccggcacagcagccacgccgctcgaaccacagcaggggccacgtcagcaggaggtcgcaagtcagcaccggccacgcccggcacagcagccacgccgctcgaaccacagcaggggctactcgccctcccaggccctcttcagagctggcctgagttgaagctgcgttcctcctgctctgagggctgggtaccggggaccctcgcccagccgaggccgctcttgtcttcttctctcttccgacagggagcggaggagagaggagccggcggcccccggggctcaggggcgcatttccagagctgcaagatggcgggggggctacgccacaagctgcaatgagctgcccccactctccggcccccacagtcacccccacattcagcaatgggaggacacggctctgcgtccatgaccctccagaaggaggggagggagagaggggggccacgcggtcccgccgggcctggcgctcccgcacggtgttgagagacttagaagtccgtgagttcaacgcttcagatcagcagacggcgtcagaccccggggctcagttctctcccccgatcagcgtccacctgggtaccggcgagtggggctacgccgtgaactctgaggcgctcctccaccgcggcagccccccgagaggccaggcccccggaccccaccttcagatcacaccgaggcgcctcggctaaggcttccctggacgcaggcgctggtgtccacggtttactcccgcgcggattccacgggaccacctgtcggggacagaaggcctacggcagtgagggaggaccacagaactttggaaaatccaagttttttctgagtatttccattatttacctcagtgcatgccggaaacaggcaggggccacacaggatgccagaaaattacgttttaaaataacctgtcccccgccgagttctacagccactctgctgggcaggcgtctggggcatccagttcacagcccgacaggcgaaggatgctgacaacttctaaaccgtgtttacagaaaacaaaagggcaaattcttttttttttttttttctgacgagtttcggtcttgttgcccaggttggaatggcatgatctcggctcacggcaacctcctccttccaggttcaagcgattctcctgcctcagtctcccaagtagctgagattacaggtgcccgccaccacacccgggtaattttttgtatttttagtagagacagggtttcgccatgttggccaggctggtcttgaactactgacctcaggtgatccacctgccttggcctcccaaagtgctgagattacaggtgtgaaccatcatgcctggcccaaaagggcaaattcttacaagagaaatagaaaatttagaatattaaaaatgaggttagaacttaagagaaataacaaaagacccaccagccaacttcacctggaattagtcacagatgaactaaaaactgagtgagatggggccaggcgggatggctcacgcctataaacccggcactttgggaggctgaggcaggcagatcgcctgagctcaggagttcgagaccagcctggccaacatggtgaaaccctgtctctactaaaaatataaaaattagtggggtgtgggggcacccatctgtagtcccagctacttgggaggctgaggcaggagaattgctggagcccgggaggcagaggctgcagcgagctgagatagtgccaatgcactccagcctgggcaagagagcgagaccctgtctcaaaaacacacacacacacacacacacacacacacacacacacacacacagaagtgcggggtgtgccctcaccccaccttcaggatttaggacacactcaggatgcagaggacacagcactctcactgcagggagaggccctgggaaaaagccagaaccactcaaggtcccagcctcaggctccgcggccactccctccacgtgctccggggctcgcttccggaaaggaggggcccagaacagaaaagccccgaggaaggggagaaactgccagggccaccaaggccgagctggggtatgtgttccccaaggtcagacctggcaccacagggcccacagctcgtatgccacgggtgaaatcgacatcttctgccaagccgtgccctccgaccccatctgctgcacacacaaaccagcaaaggcttcatggacggagccacacccagggagggctgtcagacgcagaaacagtagaaaaagcacaaacaaattgtttcccctcagtccaatggcttttttttttttttttgagacagtgtctcactctgtcacccaggctggagggcaatgatgcaatcatggctcactgcagcctcaacctcctgggctcaagcgatcctcccacctcagccgcctgagtagctgggactacgggcacaaggcaccatcatgctgggctaacttcttgtagggatggggtttccccacgttgcccaggctcccaaagtcgttcttaatgaccaagacacaccagctgtacctggggtgctgcaaaggaactgggtgtgttggggtccctgccctgaatgagtgtatacgacggtctgagagatccacaggaaacagcacccaagcccctcatgtgaaaaggcgctcggaggggagggtagtgagggaggcctgggatccccctccgacggcacccacgggcatgtgccaccggccgcacccaagctgctcatgtgaaaaggcggtcggaggggagggtagtgagggaggcccgggatccccctccgaccgcacccacgggcatgcgccgctggccgcacccagcctgtccctcctgacgcccacgaaacgtgcccagcgctccatctgaccggctggccgactgcaggatgcccacatgccctgccaccgcctcctggaaaggccccagtaccccggggtttgctcaaatccaaccatttctgctgacaagtacacttttgcatttgagaggggacggggccaacatcttggagcataaatcacaaacactctgcctgcaccgtgtttgatattttagaaacgctattttgtttgaattcacaacagctgtgtaagtggcaccccccgcccccccccccccccccagtttttcagatgtgggaagtgaggcctcaggatgtctgtgacagcccagcacccacagcttgtcccgtctgtgcagtgctcagccctgagcctcactttcagggccaagacccttcgacggacacggctcctcactgagtacacggaataaagggaaggtgaacaccactttccacatgtagtctttattacccacaaacagttggcatcagtgctcacaccaacgcgaaaattcgaaagaatattttagtgcttatgaaaacaaagttgtaaaaatattgttttttagagcagcgtaaagaaacagagaaacagatatacttcccaaatcccagcatcaaggacagctggcacgtttccttccttcacttccctcaatactcagcaaacaatgtgtccacaccactcagcacgcctggaccccagccgcggaggtgggggcatctcatgccggactcgctccctcctcccctggagagaaacgggaggcgcctcactcactctcagccgcatgctgagtgccagctatgtgctaggtgccagcaccaggccttgcccgggggcccacatgagcgcgagaccagaaggcagctggctgggggctggctgcggtgggttttttttgtttttttttttgtttttttttttgagacagagtctccctctgtcgccccggctggagtgcagtggcgcgatctcggctcactgcaagctctgcctgccgggttcacgccattctcctgcctcagtctcccgagtagctgggactacaggcgcccgccaccacgcccggctaattttttgtatttttagtagagacggggtttcaccgtgttggccaagatggtctcgatctcctgacctcgtggtctgcccgcctcagcctcccaaagtgctgggattgcaggcgtgagccaccgcgcccggcccctttgtttttttaaactccgaaagctgaatgcccccgtcttgtcaggaagtcagtcagtctggggtgagcccgacacgcagcagtggctgaacttttggccacatctcggcaggcgcgtcgtcgtttggattcagctggggacatttacgttttaaagacaacctccgacgcatctttaaaagtcacacgccaccagcatcatccagcgaaggcaacgcaaggcgaggcccccaagtgcaatcggctcgcagcggccgcccccatctcccttgcgcgaaacgagcctcagcacgaaggcgacagaggggccggcagggggcgcccgagcccgtctctggagcacaaagacccccggcccctgcgcgacccggacgagctcgcattcagccaacgactcctgtgagaaacattccagcaagcactcggctgctcccctgcccgccgcgctcacaaccgcgtccattccctcctcactctaaagccagccccccgtgcacctgagaggccagtccaggctgtgacgccgcatcctcacctcccgcaacagggaggtcagcaggcggccgagcagcagggacagaccctcagcctcatctcatcttggcccgggacctgcaaccctcagccttcaaaaccacaccaaagccaagcggcccccagggcctgcacttacgggacagcgagtgggcccctctgggcaggtactcgaacagcagggagccgtcatcccccagcacgtcggccttcagcgacagcaggctgttcttactcatgagcgccgcgcgcaggttggccaccgcggtggcctgatgcagggcgtcgtccttctctggggtgaggggagggcccagatagctggcttctcctcccaggagaccctcctccacctgtgcatagagctcggccctctctcctcggctgtcggagctgctggcttcggtgacggacaggtccgcatctggggacagagggacacacgtcagaagacacgggtcgttcccagactctccaagtgggacaggcgacacatttagaaggacagcgaccagcttctgcctgagctacagagcagcatcaagtccagcccaccctgggagccgggcacctgccccagcaatgcagcagcctcggcccagcccggcctttcctgcccacccaggtcccatggctgcggtggagtctcagccaaggctttggaggacggctcaactcagaacaacggggttgccctccctggacgaggcgctgcagacctggtacctgctctgctccagggccgagggcctgagagtcagaggctcctggggcggcagtatttccatctcgcaaagacgaggagaggctcaaaatggatcaatgacgttagagctaaatctataaaattcttagaagaaaatccgcatgatctcagatttggcaataggttcttagatacaaaaccaagcacaagcaacaaaataaattggactcatcaaaattaaatgtctgtgcttcaaaggatactaccaagaaagtgacgccgggtgcggtggctcaagcctgtgatcccagcactctgggaggccgaggcgggcggatcatctgaggtcaggagttcaaggccagcctggccaacatggtgaaaccccatctctactaaaaatacaaaaattagccgggcgtggtggcacgtgcctgtaatcccagctactcagtaggctgcggcaggagaatcgcttgaacccaggaggtggaggttgcaatgagccgagatcacaccactgcactctagcctgggcgacagaacaacgctctgtctcaaaaaaaaaaaaaaattgcaacctatatatctgataataaaaaggcaaatactgtaactcaatataaaaatgggcaaaaaatcttactagacatttgtccaaagaagatgtataaatggccaagacgcacaggaagagatgctcagcatcacccatcactaaggaaacgcaaaacacaacacgattccaccacacaatacggttccagcacacgccacggttccaccacacgccacggttccaccacacgccacggttccagcacacgccacggttccaccacacgccacggttccagcacacgccacggttccaccacacgccacggttccagcacacgccacggttccagcacacacccactgggatggctggatataaaaaggccaggcaccgtggctcacgcttccagtcccaacattttgggaggctaagaccggaagatctattgagaacaggagttcaagaccagcctgggcaacacagcaggacaaaaagttaaaataaaacaaaattagctgagtgtggtgggttgtgcctgtggtcctagctactcaggaggctgcggcgggaggatcacttgagcctgagaggttgaggctgtggtgagctgtgatcgagccactgtactccagtctgggtgacagagtgagaccctatctcaaaaacaacaacaaaaaagatcagataatattggcaaggatgggaagaaatcagaaccctggaaccttgctggtaagagtgtaacatggtgccctcctgcggagcaggtcggcaggtcctcacaacatcaggtacaggaatcaccacggggcccagcagttccacatgtacgcatgcagatacccacgagaaatgaagacacaaaagctcacagaaaacctcgtccaggacgcgcgtagcacgttatccataacagccaaaaggtggaacagccaacaagtccatcgatggacgaatggataaacataacaggtccatccccacaatggaatattatgtggccatgaaaaggcatgaagaacagacacaggccaccacacagaggagccgtgaaaacatgctcagcggacgaagccagacacagaaccacgcagaggagccttgaaaactgctgagtgaacaaagccagacacagaaggccacatgccatttcatttccattaaatatccagaacaggcaaatcaagacagaaagtaggtttgtggctgcaaaaaggggctggggaggggtctcggatgagggctaagtggtgcagggtttccctctgagccgaggaaaatgttctaaggggactgtgctgatggctacaggatgctgtgaatataccataccaaaaacctctgaactgcagactttaaatgggtgagtggggtgtgaatcatctctcagtaaagcttctatttaacaacaacaacaaaaacaacaaaaggtgacgacttgagtcatgaattcaacggattcctccgagtgtcagctcaggccagccagggctttgtggagtaccctccctctagtggggctgtatgcacgatatcaaaacacccccagaacacgctgagcgatgatgatttgcagatattttcccacagcaagagaatggattttccaccgtggtcgttgacaggaatcgggatcagaaccacagaaacacaggggcatggggcagggggcacttggagcaggggcagaggtgacgtctgcaaacacccctggaacaaacatgcacacgtgaggcccagcagctgagagctgggtgtggcaggtgggcagggcccccgtcaggcagcacacggggtgagtccagcctggcaggagcgggtgggagtctccagggacagtgacattcggaccgtcgagctacctatgacttcttctggaggcctctaagggatatgtttccaaactctactctttttccaaactatactcctttttatatttttttacaaatccctcgatgacacatcatattaattgtgcatttctaggaactaaatatacaggttatatccaaacttatgttaaggctttgtcttagcttgggatgccatgacaaaataccacaggcagggcggcttaacaacgaaaattagtttcctcacgctctggagactgggaagtccaaggtcaaggtgccagcagatctgctgtctggtgaggcccctcctgacctgcagatggcggcaggtgagccctgggggcccctcctcagagtctgggagcagagtgggtggtgggtgctgtgtgctcacgagcgtgttcagggatcagggccccgcctgtgacttcactttatcacttccttcaaggccctccccagacgcagccacacgggggctggggtttcaacacatgagtgtgggggtgcacattcagctcataacaggcttcaaaaaaaatcacccaattttattttatttaattaattaattaatttatttatttattttgagacggagtttcgctcttgttgcccaggctggagtgcaatggcatgatctcagctcaccgcaacctccgcctcccggcttcaagtgattctcctgcctcagcctcctgagtagctgggattacaggtgcgtgccaccacgccggctaatttttttttttttttttttttttttttttttgagacggagtcttgctctgtcacccaggctggagtgcagtggcatgatcttggctcactgcaagctccgcctcccaggttcacgccattctcctgcctcagcctcctgagtagctgggactacagggcgcctgccaccacacctggctaattttttgtatttttagtagagacggggtttcaccgtgttagccaagatggtctcgatctcttgacctcgtgattcgcccccctcagcctccgagagtgctgggattacaggcctgtgagccaccgcgcccggccgctaatttttgtatttttagtagagacggggtttcaccacattggtcaggctggtctcaaactcccaacctcaggtgatctgcccacctcagactcccaaagtgctgggattacaagcatgagccaccatgcctggccaaaatcacccaattttaaagccaaattttaaatctaaattattgtaacaaatcaaggtgaaaaacacataaaagaaatcaggataagctgaaagaactctcccttgtgtgaaatgctaaaatttgggtttccgccaggcacagtgtctcatgcctgtaatcccagcattttgggaggccgagatgggtggatcatgaagtcaggagtttgagactagcctggccagcccggtgaaaccccgtctctactaaaatacaaaacattagctaggcatggcggtgcgtgcttgtaatctcagctactcggcaagctgaggcaggaaaatcgcttgaaccagggagacagaggttgcggtgagccgagatcacaccattgcactccagcctgggcaacaagagtgaaactccatctcaaaaaaaaaaaagacagataaaagaaattctcattaattttatgtatatagtagttagcaaggtaactcaatggataaaagacaggtttcttagcaagcagcactggaacaaccttataatcctatgtaaaaagtgaacctcaagctgatctcacgccacatacaaaaaaaccaacttgaatcatggagctatgcgttatacttaaattgataaaaactcaagaaaaaccataggagaaagtctttgttggctgggcacggtggctcatgcctgtaatcccagcactctcggaggctgaggcgggcggatcacgaggtcaggagttcaagaccatcctggctaacatggtgaaaccccgtctctactaaaaatacaaaaaatgagccgggcgtggtggcgggcgcctgtagtcccagctactcgggaggctgaggcaggagaatggtgtgaacccaggaggcagagcttgcagtgagccgagattgcaccactgcactccagcctgggcgacagaatgatactccgtctcaaaaaaaaaggatcctcctgaagagacactgttaaatgaaaaaaggaggccatgcacagtggctcacgcctgtaatcccaacattttgggaggccaaggcgggtggatcatgaggtcaggagttcaagaccagcctgaccaacatggtgaaaccccatctctactaaaaaaaaaaaaaaaaatacaaaaattagctgggcgcggtggcgggtgcctgtaatcccagctattcaggaggctgaggcaagagaatggcgtgaacccaggaggcagagtttgcagtgagccaagatggtgccactgcactccagcctgggtggcagagcaagactctgcctcaaaaaaaaaaaaaaaaaaaaaaagaaagaaaaaaggagccaaaggccaagagaaaatattttcaaagcacatacttgatgaaggacttggaacgagaacacctaggaactctcaccactcagtaataaaagatgggcagaagatctgaacagacacttccccaaggaagagacccagatgtggagcaggtgcccgatgctcatcaccgccagctgagccacgacactcactcggccagagcctcacggtcaccacgtagacagcccaatcgaaacacggcaaaaagacctggacagacactttaccaaaaaagatatatgaatggcatcatccgccatcaaagaaatgcaaatcaaagaccatagagaagccaggtgtggcgtctcacgtctgtcatgccagcactgtaggaggccgaggcaggcggatcacctgaggtcaggagttcgagaccagcctggccaacacggccaaaccccgtctctactaaaaatacaaaaaatcagccaggggtggtgctgggtgattgtaatcccaggtactcgggaggctgaggcaggagaattgcttgaacctaggaggcagaggttgtagtgagccaagatcgtgccattgcactccagcctggacaacagagcgagactctgtcaaaaaaaaaatagaggccgggcgcggtggctcacgcctgtaatcccagcactttaggaggctgaggtgggcagatcacaaggtcaggagatcgagaccatcctgactaacacggtgaaacctcgtctctactaaaaatacaaaaaaaattagccaggcgtggtggtgggtgcctgtagtctcagctactcaggaggctgaggcaggagaatggcatgaaccggggaggcggagcttgcagtgagccgagatggcgccactgcactcaggcctgggtgaaagagcaagactccgtctcaaaaaaaaaaaaaagaaaagaggcgtggcgattttcaccaaaatccccggctactgtatgcaaacccccagtggtgagccaatgactcctgcagagacgcccaggctgcaacccccgagccgtggttttgccaccttgtggcagaacgactccgcagacctgattcggttcaggatctcacgatgagtcctggatgagccacgtgggccctaaacggacccaccagggccccgtcagcagagaaggaggcaggagggtgacagaagcgaggatgggaaggggcaggaatgatgtcgggccacgagccaaggatgctatggcttccagaagccagaagaggcacatggactcccctggagctccaggggatgcagccctgccggctgcttcagacttcagagaaccgtgagacaaaacgtgcattgctctgacaataagtctggtcatttattacagcagccatcaggagccaggtgcttgccaaaagcacaaaagccacaaaagacacctgcaggagagcctcacagccctgagcctgacacccaaacgcccacatccagacaaccacagaacaggctgcagccacgccccatgccccacgacccacgccccacacccacaggtgaggagcagtgttgctgctggctgcggccgtgagtccctcccacaccaggacaaggagcaaagccagagatgcaaggacaccctgccgagtggctgcgttaaaagttcagttggccaggcagtggctcacacctgtgatcccagcaccatgggaggcccaggcgggaggatcgctaagcccaggagtttgagactggcctgggcaacatagtgagatcccgtctcccgtcatagtgagatctacatctctataaaaaacatttttaaaaattagccaggcgtggtggcgcacgcccatagtcccagctactcaggaggctgaggtgggaggatcacctgagcccaggaggttgaggctgccgtgagccgagattgtaccactgcactccagcctgggcaagagagtgagaccttgtcttaaaaaaaacaaaaaacacagctgggcgtggtggttcatgcctgtaatcccagcactttgggaggctgaggtgggtggatcacaagttcaagagattgagaccagcctggccaacatggcaaaaccccgtctctactaaaaatacaaaatatcagctgggcgtggtggcacgtgcctgtagtcccagctactcgggaggctgaggcaggagaatcacttgaacccgagaggcagagattgcagtgagccgagatcgcgccattgcactccagcctggcgaccgagcgagactccgtctcaaaacaaaaacaaaaacaaaaaatactctgtccagtgccgagtgcagaatttttttaaaaataaaacaaaaacaaaaaacagcacgttcctgtgaagggtgttattgtctctgtccccgtcaccagctgctccccaacagactgtaatgtgatcaaagctgattgcaggtaattctgttcatacctgaaagcaaaaacatctagagaaggcgcagctgagttctcaagcttcccaggacaggactgaacaggggagtggattaaaagaggccaagccaagcatctcccgagcagctgtgggatcggggtgcggagccggacgcccttcccaccccactactgaccaaagcacatgatgtcatcttttggttgaaacccttccacccaaaaaataaaaagaccatcccaagtgcaggaaattttcttcaacagaacaatcagatctgccgtgctgctgaaacaggctgtgaaaggtgttcaggaggcgaaacattgttcaggaggccaggtgggggaacctcacattccgtcgggcaccaggagggccgagatgccacgcacactcaggacaggagtccctgcagggacgtaacctcagaggtaactccctgccctcgtgtgatcaggacggctgagaccgtggtgggggtcctcctccccaaccttcgtggagagaaagagggaacaccagaaggggacacagccacggccccctccgctcaccagttcctgctttatccccagcaaagagctctgggggcggtgaggagctgctgtcagcacaagggagagaaaccctgagacccgccggaggcaggccggcctggtccaagaagcagctcgaagaccaccctaccctgagagctgggaccctcactcccctcccggagcagacaggaggcttgcaggcagtgctaggcacccgagaggccattgtcccccatctggagctcccgcagttctgatgtacgcttaaaaatcccaacatgtcaagctcccacctcaccagggttcaagtacacacttcacagaacacacagatcctcctgtagcagcaccgcttaggcatgtgtggggccatttagttggggcacctgggctgtttctttaccatcttctcatgcagtagctacacatccactttgtcaaggcctcaccagtcacctctcaggtccttactgtgctccctccgcagatgagaaggagacgccagggcctggggaggcacgggcctgcctgcctgccccatagctgcaaacatgaatctgaacattttaatgctatttcccacaagctctcatagaagtgaactgctgtaactcagaaataaatttcaagggatactgtttcttggaagctgctcagttagaatgaatttggcctccctgcctagaaaatcactcttaaaagcaaacaggcctcagggtcaccaggggccgggatgatgcacagaggggttggggcatcggcgtcgaatgatccacggtgaccacttgacatgtgtccttagaaaagagactttgtggccgggcgtggtggctcacgcctgtcatcccagcactttgggaggccgaggcaggcggatcacgaggtcaagagatcgagaccgtcctggccaacatggtgaaaccccgtctctactaaaaatacaaaaattagccgggcgtggtggtgggcacctgtagtcccagctactcgggaggctgaggcaggagaatgatgtgaacctgggaggtggaggttgcggtgagctgagattgcaccactgcactccagcccggcaacagagcgagactcaaaaaaaaaaaaaaagaaaagaaaagaaaaagaaagaaggaaaagggactttgtggcccggcacactggctcacgcctgtaatcccagcactttgggaggctgaggcgggcggaccgcttgaggtcaggagttcgagacaagcctggccaatatggtgaaaccccgtctctactaaaaatacagaaattagccgggcgtggtcacgggagcctgtaatcccagctactcggaggctgaggcaggagaatcacttgaacccaggaagcggaggctgcagtgagtcgagatcacaccaccgcactccagcctgggtgacagtgacgctctgtctcaaaaataaaaaaaatttaaaaaagggcctttgcttctataaatgggatgaaaattaaaaatcctcttctctaagatagaataaatctttaatggaaacaaactgacctccatgggatcatgatctacttccaaaccccaagcttccaaatcccagcctgagggctcagacggaggacgcagctcagggagtcactggccgccacagcgtgggcagaaccatcctccatcctcacacagctcacagccttgtgtcctcatcttagcaactcggaataatctaatggaagagtttcacagttgccttggaaacccaagggatttaagactctaacaaaagtacacagccaaaatcacttgttggattctaaaaacaccttctgctcgacaactgcatttaaagcattcagcccacaggcttaaggagtgcactatttctcagtgcctgcatcgactctcataatacaaaggcctccagcacgggcacctgccagcgagttacgtgcacgcacagggaggtggcctgggaccactgggaggggcctcgctgtgctgacaacggaccctgcagcgcatctgtaaacatcagaataaaccccccaaagccgtgtctcttgccagggaccactgcttctcagattttagttggagctagtggaagattataaacagttacaagcagatggaaaggccactggccctgacctgctgcctgtacactctccacacgcacagcagcacatagagaaacgattttcccaactgctaatgtctggagacatttttggttgtaccaacgggggatccaaaggcaggtgctcctggcatctgtgggtggaggccacggctgctgctaacatcctgcagtacccaggacagcctcacgatggagcacaactcagcccgaggctgagttaaaccaactgctgttttttgtttgttttgaggttttttgatttgttttgttttgttttgagacagggtctcaaccctgtctccaggctggagtgcagtggcgcgatctcagctcaccgcaacctccgcctccctggttcaagagattctcctgcctcagcttcctgagcagctgggactacaggcgcgcaccaccacgcccagctaacttttgtatatttagtagagacggggtttcaccatgttggccacgatggtctcgatctcctgaccttgtgatccgcccgccttggcctcccaaagtgctggaattacaggcgtgagccaccccgcccggcctcggataacttttgtattagaaatgggatttcactactttgcccaggatagtcccaaactcctggcctcaagggatcctcatgcctcggcctcccaaattgcctccaaaagggattttgggcctgagcgactgcacgtggtcaccaacttttactgaacatccagggtctggccgtagctcagtgcaggacgcacagcaacaacagatgagaatgaataaaatctacattgtgtcaaagtagaacagcatttacccgcaggtggggtagaggcaagaggaaggtactgtatgacggatacagtttccctttgggatgatggaaaagttgtgatcgcagaacttcatgcgccacagaagggcattttggtcagggatggaccacagataaccactgtggtcccgtagattagaacgcagccgggaaattcctgtcacctggtggcgtgacaggaatagccatcgccatcctagccatcgccatcctagccatcgccacatcctagcacaactttaaaaaatcagtttagtgtaggccacgccaagtgtttataaagtctgcagcagtgcacagttctgtcctcagccttcatgttccctcagcactcgctcacccagggcaacctgcagtgcagcaagctctgtgcatggcaggggccctacccaggcatgccgttatcttgtataccctatttttacagcaccctttctatgtttagacacacaaacacttcccatggtgccacagctgcctgcagtgctcagcaccgtaactaacactggcaggtttgtgctgggcctataaccggctgcactttctagttttgtgacgggcgctccatgacgctcccagagcaacagaatcgcctagcgatgcgtttcttggaacctatccctgtcatcaagcaacgcgtgactttaatgccagtgaaatgtacatttgaaaatggttaaaatggtaaggtttacattatgtatgttctaccacaatgataaaagttaacgtattatcgagctgtgttcactcccggctctcgcagatctctcagcgacggagaggagggaccagggtcaggagaagaggccacacccgccctgcccaggaagccctccagccaggggggcaggcagcgtctcccactgcgccacccacacacggcatctgcgacatttttcagggcctcccaccctgcggcttgctgtctttcgtcctcctctgtccactcacgccctcccacgttcatttccaggcttcatcctggaggaacctccccacgggcagcacctgctaggacacctccatttcttctttcctttaattaagagacagggtctggctctgtcgtccaggctggagggcagcagtgcaatcacggctcactgcagcctggacatcttgggctcaagccatcctcccgcctcagcctcccaagtagctgaagtacaggcacaggcaacaccacacccaactccaaatatccttccttgacttgggccacagcctggggaaaagagcagaggccaaatccccacaattattattaatatcacatgcccagcaccatgaatggtggccagtattcagcaaacatttaatttattatttacaaatatggaagacacataagggacaaccattcaggtggtgacgtccagcttcaacagagctaagctcagagcccctttgcagtgagtaataggcaggacccaaggggagaccctgtatcatgaggtgtaagaaaaaacatcagccaggcgcggtggctcacacctggaatcccagcactttgggaggctgaggtgggtggatcacctgaagtcaggagttcgagaccatcctggccaacatggtgaaaccctgtctctactgaaaatacacaaattatctgggcgtggtggcacgtgcctgtaatccccagctaatcggaggctgtggcaggagaatcacttgaatccgggagacagaggttgcagtgagccgagatcacgtcactgcactccagcctgggcaacacggtgagactgtctcttttttttttttttttgagatggagtttcgctcttgttgcccaggttggagtgcaatggcgcgatctcggctcaccacaacctccgcctcccaggttcaagcgattctcctgcctcagcctcccaagtagctgggattacaggctacttttctgtatttttagtagagacggggttctccatgttggtcaggctggtcttgaactcccgacctcaggtgatccacccacctcagcctctcaaagtgctgggattacaggcgtgagccaccacacctggctgagactgtctcaaaaaaaaaaagaaaaagagaaaagagaggaaacaaacatcgcctgttggcttcaacagcagaacccacaggtgtcagcagacacaaaatccacttgccgggaaaggctgcttcttggctgtaacctctcaggtccccaggtcaaggcaagctgagccaccaaggacaaagtacattcacatggtgtttccattcaacattcactatagcaacagtgaccaaaggcagaagtccaggatgaaaagcctggagctgaaggccaccctggcaagcggccagtcgagttaccccagtcagggctcatgggagggtcccacaggccaggggaagccgaccctgcaggccacgccctcaccagggctgaggggtcccctcccggtgtcacccaccccccggctcacgtccctgtggcttcagaggggcccagcccaggcagcccccgtgtgtgggtgacaccagtgccgtgctgatggggacagatacacagggtctccaagggccctggtgatgccctgccctttgagatgcattggctgcattcccagcggtcacgacaacctcctgtaagaggaagtgaccctagaaagccaccagtgtgagcctggacatgcgtcactgcctccgcacagcacgcggccgtgaggcctggacacactggggcagctgagcccccgtaacgagtgaaaggcttacttgagtctcggctgctgaacggccaccccgacgtcggcaggaaggacggcaccggggagctggcccggctgtcatcttccacctgctgtgtgatgtgccggacggtctctttgtttttccgattcttccttcggcccgtgggctgccaggcatcaccagcactctgctctgagaaagagttctgtactgcaccgtccttggcagaaggcagctcgctccctccgtactgagacggtgaaacctgctcttccttgatgcgcagaggcccgtagcccacgtctccaggccatagaggctgtgaagaaacatcatcagggccatcggccttgggctcctgatcctctttcccgtagctgctccctccgtcgtgacagctggcgatggccgagtctccggaagaattggcaggactcgttcgccgtgccagccacggggagatgctcctcccagccatcacggccgagatgagagcttccgtgctgctgctggacgaggcgccgatctcgaactccgcaagctcatctgaggcgtccgacttgatgctgatgtccagcgccgccttgatgaagtcgtggcaggcttgcacgatgtccgtcatctgcaggaagctggcggctgacatcacctcgatgacgttcctgctggtgagcgccaggtgcgctgagtacatgaagtcgatgatggccttgaagccctgggccgtgacgatgtccaggtgcgtgaccgtggcctgctccgacgtcttctgcacctggcagtagagcgtcttgaagtagcggctgctgcccagcaggacgttcttgtgcgccttgaagaccttgccctccacgaccacgcagacgtcgcacaggacgccgtgctgcctctgctcgttgagctcccgcagcaggtgccggtagtgggacgtgatttccatatcttcctttcggttgttcatttggaagccctggtgtcgcctcttctacagactctgtggaggtaagaacaagagttacccaagctcagcacagacagaggccgtgagaggacgccgggcggggcgcaggagggccatggggcacagagtgcggccagtgggaggacgacccacgcgagagcccatccacaggtgtgcagcgggaggcctgtgtctccgcctgaagcagggcagcaaacaccggagggcaccagtgcgtccagggtgggacgtctgccacgtgtttccgtgctcgaggctaatggggttctgaacagaatcccacatacggcaactggcatatcccaggaacgatgagaacacccagccgtggctgagcaactcttacccaaactgagaactcggttaaatgacctacactgtggccatccctcacgcttgaagaaacattcttaaggaaaaagaataaaacttccaggctgggcgcggtggctcatgcctgtaatcccagcaatctgggaggccgaggagggtggagcacaaggtcaggagatcgagaccatcctggccaacatggtgaaaccctgtctctactaaaaatacaaaaaaagcagctgggcatggtggcgggagcctgtagtcccagctattcaggaggctgaggcaggagaatggcgtgaacccgggaggcggagcctgcagtgagccgagatcgcgccagtgcactccagcctgggcgacagggcgagactccatctcaaaaaaaaaaaaaaaaaaaaaaaacttcttacacaaaaaaccacagaataaggaattaaagcattcatagccttagtcctgaaaatttccaaaactctgagctcaaacgagctgaagtcttctggaggagggaggcttcctggcttaggcctgggtccctgcccagcactgggacagggcaggagggagctcaggccctgcggctgccagcgccctggacgtctgagacacgactggtctctgggtccccctcatcagaagacagccctgcctcacagagtcacaggacacacagaatcatttctgaattgggtacaccccgtcccggagtctctcctgtctctccttagactcagggatgtgagtcctccgcctgttctcgtctgctggggccgccctatcaagcctgggaggctcaaacaacagaaacgtattctcaagtccagaatcaggatgtcggccgagctggtgcctgttccagcccctcccccagccggcgttctgtgtggaggcatcgcacgagctctgcctctgtctcaacacggcttctcccggtgtgcacgtctgtgtccaaatgtcaccctttcacaaggacaccagtcgtccgggagtaggggcccacccccacggcctcatcttaattaatcatatccacagtgaccctgtttccaataaggtcacattctggggtcctagggggctagaacttccacagacaaatcgtaaggggacacgttcaccccacagccctgcctgggaaagaaacagtggttgggtctctcccgttacaaaccccattctccagctgataagtcaagtaggactcacctgaaatgctaaatgtgtttaataggagaaaactaagcgagcgtgggagtattacatgtccttccggcaaggagcccccacatgcagccctcatgggggacggggtcgggggctcagcagttttgtatcacacactcctgggctccgactggttacgacatacacaccttcacttagtcatgacagaatattttcttctttttttttttttgagacggagtctcgctctgtcccccaggctggagtgcagtggtttgatctccgctcactgcaagctccgctcccaggttcatgccattctcctgcctcagcctcccgagtagctgggactacagacacccgccaccacgcctggctgacatttttgtatttttaggagagatggggtttcaccattttggccaggctggtttcaaactcctgacctcagatgatccacccgcctcggcctctcaaagtgctgggattacaggcgtgagccaccacgcccagcctaaaatgtcctgagaaaagtaattattctgtctcacatttcacaggccgggaagatgaggtagaaaggagagagaagcttttgtgcctgtctctgccttcagggtcctgggccatcccctccttggatggtgtggggttcccaggcccccacagccggtgttgcctgccgggagacgcgctgcagaagaccgggcccagcctccccttcacttcctgcccgccgggcacgagggctgtgacggcggtgaccgctgaccattacaggaagggcctcaagcccccaagatgccaagaccaggcccccgcctgactccaggtgctgcctcaacggcggcagagaacaaaggccccatcccgccccacactggccccgggcttgagggctggaggcaaacgcgtgtgggtgcgagcagaacaaggagctgccgaaaaggaagagatgacattcggagcaggctgtggggagggggtcatgtgctgaggccgcccagtggttcttgaccggagagcatctcagagccccaggagggcagggcaggtgtcccaccaggcacagcttcacccagattaactaggcatcggggaagtgaccaaaacacacttcaaacccaggaaaacaaccattcaatcccgaagctggggggtccacaagtgacacctggctccgggccacgtgatgggaaccgtcaaaagctccaggcaccctgtatccaggctaggaagctgaccgatcatatttaatttcctacgtgaataaaacgtctctttattcatcaggaaaacagagcctgtaagaattaaggagaactatgaaaacaacaacaaaaaaaatgccagagattttatagaagcagcggctacctcacaacggtccacacctccacgtaagattttatagaagcagcggctacctcacaacggttcacatctccacataagttcaacttaaatcaaaagttctgaaatacatttaataatgtatttcaatccaatcagggcagcttaaaatcagttatatactcagagattttatagttaaaaaaataaataaataaaattttcatttgggaaaaaagttatctgtcaggccaggcgcggtggctcacgcctgtaatcccagcactttgggaggccgaggcgggtggatcatgaggtcaggagatcgagaccatcctggctaacacggtgaaaccccgtctctactaaaaatacaaaaaatttgctgggcgtgatggcgagtgcctgtagtcccagctactcaggaggctgaggcaggagaatagcgtgaacccgggaggcggagcttgcagtgagctgagatcgagccactgcactccatccagcctgggtgacagagcaagactccgtctcaaaaaaaaaaaaaaaagttatctatccactaaaaggaaaaaagtaacaatcttttgcagtggcacgatctcggctcacggcagcctccaactcctgggctcaagcaatcctcttgcctcagccacccaagtagctaggaccacaggtgcacaccccaatgcctggctaactctttcattttttgtagtgacaggagtcttgctttgttgcccaggctgatctcaaactcttgggctcaagcgatcttcccacctcggcctcccaaagcactggaattacaggcgtgaaccaccacaccctgacaaaaaacgataatcttcaaaagagattagtcagctacggaaatattaagaatacacataatctctctaagcccagaacagggaagttctaggagaatatttgaatttacatttcaaattcaataatctctcagcatcagaaatctgctcgtggggccacgtcaaccccactgtggtagaagagcagctgcaaccccaaaacagaagcacccggggctactcaggctcgacacgcaagcagcggacttgagctcacaacccgtattctgtgtgggaagcacctgccctggcctggaggagcacaagatctaacggacacacccctggccacaggacacacctgtgggcagacagctgcatccacaggacacacacctgtttgctgggcacacctgtggctgcggcaaaggctcacaagcacttggtacatctcaggtccccgtgtggcacccccgtgcgcgaggtgccccttcagagaggagctcccgatccacactggggcacaggtgccaagtctccaaagagtgggtgctgcgggctgcagggaccaaggggcacccgcggctgcactgatgtcaggttgcccaatagctaccctagaccctcagagggacgccgcctctgctgtctcctccaaacaccgcctcagctttttctgaggcttcttggtatctgctttacttatatatcacgaatctcaagatccttcccttcaaacagaatcgcttatgaaacgggcatcagcataaccactctggtgaccacaacaacctgaagccatgctccaaactcacaagccgcgtcaccgtgcaggtgctgggggcacaaacccacgcatggctctgcctcaaccgccgacaaccaggtgcacgggacgctgcgcagttacaccgtgcaggctctgccccaggtgcacaggacgcggtgcagttacattgtgcaggcagtgaggggggctgcgtggggcctgtcctgccaggcaggcaatgcgccagcacactgtgcttttgggggctatttcaaaccccaatagccaccaggagagggagaggtggtctccacagtgcacgctaacgaactgagggcctcaaaaccagcacagctgggagggattcagcggcgagcctgtgcttctaggtccaaagcccgggtgctcccacccatcgtgccgtcctgtgctggcaccaggtcggccaatcctccctgggatccggggagcaaggtcatgcacctgtgtccccagcagaatgaccaccggcaaacaggctccgccaaacgtggcttctatcctcctcctccctgggtcagctggagtgaaggaagagtggcctctgccgaatgcgcataggaacggcccagcctctagggccatcttggaagtggcggtgcccatcccaaatcctctctccaacagactcccggaaggtgacgggtgtccatcattgagcgcctttgaagactgtaaacaggcgcgctgctgttgaggacgcacacttcccactcactccaatcctctcatttgaggacgaatgtgccctggccacagcctggatagatgcctgtgtcgcaggacgcagaccaaggaaatctgaagaccgcgatgaatatactccatttgctgcactgtgtgttcaaagtattaatttagggggcagactggggttatttttccccgcgtccctaaggagctctgcccggaaggctgtttgttctaataaaaatgtaaaacagcaggcgtgattcaggcggtagtgtgtctgccgcatccaccggacgcccgatccgcgtagggcacaaggcagggagggcgggaggcctcgggtgccccctgctggcagcgcctggcacgcggcgtcccgggcctccggctcctcccctagggcccatccctgcgtctaattccaaaccactcagcgggcaagaacgaccctctcaaacatcaactcacactgttttaccacattcacacttgatctctctgttttgcctctgacttgaaacctgcatttccgttaggctccacttaaacctttcatttaaaattctgcttaaggccgagtgcggtggcgcacgcctgtcatcccagcactttgggaggccgaggcgggcggatcacctgaggtcaggagttcaagaccagcctggccaatatggtgaaaccccatctctactaaaatacaaaaattagcaggacgtgatggcaggcgcctgtaatcccaactacttgggaggctgaggcaggagaatcacttgaacctgcgaggcggaggttgcagtgagccgagatcataccattgcactccagcctgggcaacaagagtaagactccatctcaaaaaaataaaataaaataaaaataaaataaaataaaattttgcttaaaatgtaatctaacaggccaggcacggtggctcaggcctataatcccaacactttgggaggctgatgcaggaggatcacttgaggtcaggagttcaagtccagcctgggcaaaatggtgaaacccggtttttgtttttgtttttttatatatactttaagttctaagggtacatgtgcacaacgtgcaggtttgttacatacgtacacatgtgccatgttggtgtgctgcacccattaactcgtcatttacattaggtatatctcctaatgctatctctcccccctccccccaccccacaacaggccctggtgtgttccccaccctgtgtccaagtgttctcattgttcaattcccacctatgagtcagaacatgcagtgtttggttttctgtccttgtgatagtttgctcagaatgatggtttccagcttcatccatgtccctacaaaggacatgaacgcatccttttttatggctgcatagtattctatggtgtacatgtgccacattttcttaatctggtctatcattgatggatgtttgggttggttccaagtctttactatcgtgaatagtgccacaataaacatacgtgtgcatgtgtctttatagcaacatgatttataatcctttgggtatatacccagtaatgggatggctgggtcaaatagtatttctagttctagatccttgaggaattgccacactgccttccacaatggttgaactagtttacagtcccaccaacagtgtgaaagtgttcctatttctccacatcctctccagcacctattgcttcctgactttttaatgatcaccattctaactggtgtgagatggtatctcattgtggttttgatttgcatttctctcacggccagtgatgatgagcagtttttcatctgtctgttggctgcataaatgtcttcttttgagaagtgtctgttcatatcctttgcccactttttgatggggttgtttgattttttcttgtaaagttgtttaagttctttgtagattctggatattcgccctttgtcatgagtagattgcaaaaatttcctccgattctgtaggttgcctgttcactctgatggtagtttcttttgctgtgcagaagctctttaattagatcccattcatcaattttggcttttgttgccattgcttttggtgttttagacatgaagtccttgcccatgcctgtgtcctgaatggtattgcctaggttttcttctaggatttttatggttttaggtctaacatttaagtctttaatccatcttgaattaatttttgtataacgtgtaaggaagggatccagtttcagctttctccatatggctagccagttttcccagcaccatttattaaatagggaatcctttccccattccttatttttgtcaggtttgtcaaagatcagatggttgtagatgtgtggtattatttctgagggctctgttctgttctattggaaacccggtctttacaaaaaatacaaaaattagctgggcgttggccgcgcgtggtggctcacacctgtaatctcagcactttgggaggccgaggtgggcggattacctgaggtcaggagttcaagaccagcctggccaacatggtcaaaccccgtctctactaaaaatacaaaaattagccgggcatggtggcacatgcttgtaatcccagctactcaggaggctgaggcaggagaatcacttgagcctgggaggtggaggttgcagtgagccaagatcatgccactgcactccagcctggccaacagagctagactctgtctcaaaaaaaaaaaaaaaaaaattagctgggcatggtagtgcacacctgtgagtcccagctactaaggaggctgaggtgggagaatcacctgagcctgggaggcagaggatgcagtgagccaagatggtgccactgcactccagcctgggtgacagagcgagactctgtctaaaaaaaaaaaaaaaaatgtaattaacagataaatcaccattttaaagtggaagcaagatacccttggctctagaatcaaactgccagtggccaggagggctctggggaagacaaaggtggccgcagccatctgtccagatcaagtttaactcacctactctaagaactgctctccacaattattttggtgaaactgttttgttttcagacaaggtgtcactcagtcacccaggctggagtgcagtggcatgatcagggctcactgcagcctccacctcccgggctcaagcaattctcccacctcagccccctgagtagctaggaccacaggtgcacaccaccacactcagctaatttttttttttttttaatttcttacagagacagggtttcaccatgttgctcaggctggtctcgaagtgctgggctcaagccatccaccagcctcagcctcccaaagttctgggactacaggcgtgagtcatcacgtgtggcctggtgagactaacttttttttttcttttagatggagtcttgctgtcgcccaggctagagtgcagtggtgcaatctcagctcacagcaatctccacctcctgggttcaagcgattcttgtacctcagcctcccagggaagctgggattacaggtgtgtgccaccacacccagctaatttttgtaattttagtagggacagggtttcgccatgttggccaggctggtctcgagctcctggcctcaagtgatcctcccacctcagcctcccaaagtgctgggattacaggcacaagccaccacgtgtagcctggtgaaactaatcttttagcaggaaaacgttttgaacagacacatcacaaagaagaagcatcagcaggcacacatggacagaggcttccccagctgtcggggaagtgcgcccggaaccacagcaagctcccccatgagagtggccaggactaagaggcaaggccacaccatgtgtcctcgaggacacgagcacctggagcctgctcagctgctgagggcacatggaacggtgcagccgctgtggaaaacagttcagcaaagctgaactccacaggacccaacaactccggtacctacccgagaagcaaaaccacctgtccagacagactcatgcgtgaacgttcacaccagcttcgctcagaacagccaaggtttgggaacaacccgaatgtccaaatgtgcatcaacaggtgagcaggtaaacacgggatgcttccaaactgcagaggcagctcaggcacaagaaggggctgctgggctccgtcccggcctcggcaccctggggcacctccctgctcagccttccgtccccctatacaggtcacatccacgccacacggattatcccacagttacgctgagtaagagaagacagtcaccaaggaaagcgtgtgattccctttataggaaactctagacaacagaagtgagtccacagtggcagacaaccggccaggggctgcctgggctggggtagggggagaggctgcgggaagctcctgtggtgatggtgagagttgacagcatgctggcaagccctcacagccctcactcactcttggcgcctcctcgacctcagcgcccactctggctgcacttgaggagcccttcagcccgctgctgcactgtgggagccccttcctgggatggccaaggccggagccggctccctcagcttgcggggaggtgtggagggagaggcgtgggcgggaaccggggctgcgtgcggcgcttgcgggccagctagagttccgggtgggtgtgggcttggcggccccacactcggagcggcccagggcaatgaggggcttagcacccgggccagcagctgcggagggtgtccgccagcagtgccggcccaccggcgctgtgcttgatttctcgccggccctagctgcctcccctcagggcagggcttgggacctgaagcccgccatgcctgagcctccccctccccgcagtgggctcctgcagagcttccctgacgagtgcccctccctgctctaccgcgctgggtcccatcaactgcccaagggctgaggagtgcaggtgcacagagcgggactggcaggcagctccacctgcagccccagtgccggatccactcggtgaagacagctgggctcctgagtctggtggggacttggagaacctttatgtctagctaagggattgtagatacaccaatcagcactctgtgtctagctcaaggtttgtaaatgcaccaatcagtaccctgtgtctagctcaaggtttgtaaatgcaccaatcagtgctctgtgtctagctgatccggtggggacttagagaacctttatgtctagctgagggattgtaaatacaccaatcagcactctgtatctggctcaaggtttgtgaacacaccaatcagcgccctgtatccagctcaaggtttgtgaatgcaccaatcagtgctctgtgtctagctatctagtgaagacttggagaacttttgtgtctagctcaaggattgtcaacgcaccaatcagcaccctgtcaaaatgggccaatcagctctctctaaaacagaccaatcagctctctgtaaaatggaccaatcagcaagatgtgggtggggccaggtaagggaataagagcaggctgccccaaccagcagtggcaacttgctggggtcccctttcatacattgaaagtgttgttcttttgctctttgcaataaatcttgctgctgctcactctttgggtccacactgtctttatgagctgtaagactcaccgtgaaggtctgcagcttcactcctgaagccagccaagaccacgaacccaccagaaggaagaaactccaaacacgtctgaacatcagaaggaacaaactccagacacgccgcctttaagaactgtaacactcaccgcgagagtccatggcttcattcttgaagtcagtgagaccaagaacccaccaattccagacacaatggggacggcctgtgtctccaaagccaccggcagctccacccaagagttcgagctcatcagattatgctcgttaaacaagtgctgtttgctgcacgtaaattatgcctcaataaaggattagtttttgtaaaaatatttttcctcagctataatcctgtgcttatccaaggacctcactgccatttgttacgggttgaaccccccgcccccgcctcccaaattcatgttgaagccctaacccctcatatttcagaattccaccttatttggaaataggtcattgcagatgcaattaattaagatgaggtcgctggggctggacacgatggctcacacctgtaatcccagcactttgggaggcagaggcaggcagattgcttgaggccaggagtttgagactagcctggccaacatggtaaacccccgtctctactaaaaatacaaatattagccgggtgtggtggcgcacgtctgtaatcccagctactcaggaggctgaggcacaagaatcacttgaaccgggagacggaggctgcagtgagctgagattgcgccactgcactccagcctgagtgacagaatgagaccctctcaaaaaaaaaacaatgaggttactgggggcccctaatccagtatgataagtacccttaaaaggggaagaaatttggacacaggtcggcacaaagcggcagcggcggaggccccggcaagaggctggagagaggcctggagcagacccccagcaccctcccagaaaccgcggcgggccgacaaccgaacctcagacccccagcaccctcccaggaaccgcggtgggccgacaaccgaacctcagacccccagcaccctcccaggaaccgccgcggccgacgaccgaacctcaggcccccagcaccctcccaggaaccgcggtgggccgacaaccgaacctcaggcccccagcaccctcccaggaaccgccgtggccgacgaccgaacctcaggcccccagcaccctcccaggaaccgccgcggccgacgaccgaacctcaggcccccagcaccctcccaggaaccgcggcgggctgatgcccaaacctcagacctccggcctccaggactggagggaacagatgtctgttgtttacgacgttccctttgtggccctttgacatggcagccccaggtcactgacgccccgtttctaccaccaaagagcgcgatgccacagacgccaacaggaggaaacacgtttctgggcagctctgcccactcttgcgaagaaacccaccaacccggctcccccagggcacctcaccagcaggaaccaggcgtgggcaccatcccccaggatgccatccaggcagggaccagtgtgggcaccatcccccagggcgcctcaccagcaggaaccaggcacctcccctcacaccaaggcgttcatggtttaccttcttctgaaaaaattaaggttaagacatgaatactgtgaaactgtcgtacaaattaaatttcatatacatcatattaccattgttcgtggtcgcatttcaaaatttttaagtgagctcctgactagaaaacactccaagacatgttagcagagtcgtctttcgacagcgagaccggtggtactatccacatcatctccagtgagcaagtgggtgctggcgatgaggactttaggttttccacatggcagcccccatgtggccatctgaagatgcaaagccatgtctgccggccccgggctgcccaggccccgggctgcccaggtctctgtcggaggccctgccagccccgcccctccctgcccactggcccctttcagttccttcatctccagcccggctctgacgcccaggccgcctcctccgccttcccgaacctggctaccgtcacttccttctttttgtttttgtaatggggtctcactctgtcccccaggctggagtgcagtggcgcaatctcggctcactgcagcctcaacctcccaggctcaaggcatcctcccacatcagcctcctgagcagctgggaccacaggggcacgccaccacacgggctaatttttttgttttgtagagacggggttctgtcgtgttgcccaggttggtcttgaattcctaaacgaacctgccgccctggcttctcaaagcgctgggatgataggcgtgagccactgcaccgacataacgtcacttccttctgtcgggcgtccccagccagagcccagcacgcttcccctttccaaacacctctcactgccctgcgctgtcccatctcagccccagccaccagggtctcggtgggctgtggggtccctgaatggaggggcttccactcccacctcagcagctccaggcctcagcatccctccagctccagccaggtgcccaccagtcacacgcaggggaagcctggagcagtgcctggctcgggccatgtgtgagggtggcaggggtgcctccagatgggcacaaggtgctctgggcacccaggagggggccggggcagctgagctcctagtctgtcatttgggttatagatgacacagtggaacaggtcagatctgtaaaggcgaatcctgccatgaatcacaacagcagtcctgagccctctcagccaatggacacagcctccccctcctccaggaagccctcccgggcgtcactgttcttacactgacagcacacatgccacctcgctgcctgacactgccctgccctcctctcagcccagggaccacatctcaatgctggacaggcccaacacatacacttggggtcaacaaaactacagtaccaggccgggcacggtggctcacgcctgtaatcccagcactttgggaggccaaggcaggtggatcaccaggtcaagagatcgagaccagcctggccaacatggtgaaaccccgtctctaccaaaattaaaaaaattagccaggcgtggtggggggcgcctgtagtcccagctactcgggaggctgaggcaggagaatcgctataacctgggaggcggaggttgcagtgagctgagttggcaccactgcactccagcctgggcaacatagtgagactccgtctcaaaaaaacaacaacaaaaaaaacctacatgacttttttttttttttctcagaaggagtctcgctctgttgccaggttggagtgcagtgacacgatctcagctcactgcaacctccacctcccgggttcaattgattctcctgcctcagcctcctgagtagctgacattacaggctcacaccaccatgcctggctaatttttgtatttttagtagagacggggtttcaccacgttggccaggatggtctcgatctcttgacctcgtgatccgcccacctcggcctcccaaagtgctgggattacaggcatgagccaccacgcccgacctacagtaccttttgaaaattaaatctgtaatactgatttacagtatttcaaaaatgtctcatactaagtgctgatagaaggtaaaatgaaacagcagccgggcagtgtggtacacacctctaatcgcagcacgttgagaggctgaggcggcagaatcacttgagcccaggagttgcaggctgcagtcagtgagctccgattgcaccactgtgctctagctggagtgacagagcaagacccccatctctaaaggaaaaaaaaagacacagggaggagagaaggtcatgtgaccacaggcagaaactggagtgacaaagtcacaagccaaaggatgcctggagccaccaggagctggaagaggcaggaaggaccctgcctggagtctccagagggagcatggccctgagacaccctgagttccagcgctggactctggaactgagaggagacacctctgctgccgcgagctgcccagcaggtggtactttcacagcagccccaggaaactaatacacaaagccatgcatcagcttttttttttttttccttttttttgagacggagtctcgctctgtcgcccaggctggagggcagtggcacgatctcggctcactgaagccttcggctcactgcaacctccgcctcctgggttcaagtgattctcgtgcctcggcctccccagtagctgggattataggtgtgtgccaccacacccggataatttttttgtatttttagtacagacagggtttcaccatgttggccaggttggtctcgaactcctgacctcaggtgctctacccgcctccgcctcccaaagtgctgggattacacgcatgagccaccatgcccggccccaacttttaaaaatattataattttctcagaaagctaatcagctggctgggaaaggtggctcacgcctgtaatcccagcattttgggaggctgagacgagcggatcacctgaggtcaggagttcgagaccaacctggccaacatagtgaaaccccgtctctactaaaagttaaaaaaaaaaattagcctggcatggtgacgggtgcctgtaatcccagctactcgggaggctgatgcaggaaaattgcttgaacccgagaggcagaggttgcagtgagccgagaacatatcactgcactccagcccaggcaacaacagtgaaactccatctcaaaaaaaaaaaaaaaagaaagaaaagaaagctaatcagcttaacaaggcaagaaaactatttgtgtacattttaaatctgagatactgctatggctaactctgacctgaaatggtaacttcaaaaaaaatagaacctaaataagaaggttgtaatacctgcttaaaataaaggcaacactatgctctcaaggaatatgatggaatctttctctttttttgagatggaatctggctctgtcacccaggctggagtgcaacggtgcgaccttggctcactaaaacctccacctcccacgttcaagcgattctcctgcctcagcctcccatgtagctgggactacaggcgcccaccaccacgcccagctaattgttttgttttggtttttttttttgagatggagtctcgctctgtcggccaggatggagtgcagtggcgccatctcggctcactgcaagctccgcctcccaggttcacgccattctcctgcctcagcctcctgagtagctgggactaccagcgcccgccaccacacccggctaattttttgtatttttagtagagacggggtttcaccgtgttagccaggatagtcgcgatctcctgacctcatgatgcacctgcctcggcctcccaaagtgctgggattacaggcgtgagccaccacgcctggccaggattggtgttaattcttaaaatgtttgatagaattcaacagtgaagtgatatatacaatcatatacatatatagagagagacagagatggacttttcttttgttggaagtttattgactattgattcaatttctttattgaaattgacttttctttttggaagctaaaaagtacaataactgtagtgaaagtttctgaacttttctttcattggaagttttttgactactgattctttatttgttataggtctattcagattttctgtttcttcttgagtcagtttggtctcgctctgtcacccaggctggagtgcagtggcgccatcttggctcactgcaacttctacctcccgagttcgagtgattctcccacctcagcctccccagtatctcggactacaggcgcacgccagcatacctggctaatttttgcatttttagtaggaacggggtttcaccatgttggccaggctggtctcgaactcctggcctcaagcaatctgcccgcctcggcctcccaaagtgttgggactacaggtgtgagccaccgcgcccggccttcagctactccattttttaacattttgccgcatttgtttacatcaagcaatatgatagaatccctaaccagttactttttgcttaaaagctgtactaggccaaaacaagcgaagcacccgtctgtgtgaggcagcgggtctggcttacaggcggcgcctcagggctcgctccccctccgagcgggtctcactcccagagcggggctcgcccggtgtctggcctccgaggccgtgtgcccaagtccccaccttgtgcggcacaggcccttcccacaggggacactcacggaagctgaacggaccttcccacaggagacactcacggaagctgaacggaccttcccacaggggacactcacggaagctgaacggaccttcccacaggggacactcacggaagctgaacggaccttcccacaggggacactcacggaagctgaacggaccgacggaggtggcgtggatgagcagcagccgcctgagcagtgaggaaaccccgcggacagcgcggtaaggaccccacccagattactggatttcaccaccggccgccttcgatggaggagtcctcagtctccacatccgcacggcacagacggagggggggcccatggggccccagcgatgaacctgtcaggggtcccctgtaccctgtaggccagtcaagccatccttcccagcccttgccccgggggctgagcgcaggggagggcccggaaggcagacgccacggagcccggggcttcaggggggcgtggggcggaagcggggccagggcggaggtcacggacagggtcatccggacccacaaggagtctcagccccgggcccggcgggagggaagggggaagccaggctcttcctcctagggcagggcctgggctccggggcagtgtgacctcccgcccctaagcgagtcctgcctccccatgagacctgagctcctccagcgtgggtgggaggcggacagagcctcccccagagaaggccctcctcggtccagcgctcggccaggacaggcgccaaggccgccttaagaaataaaaccagcaggcgcggtggctcacgcctgtaatcccagcactttgggaggccgaggcgggcggatggtgaggtcaggagatcaagaccatcctggctaacatggtgaaaccccgtctctactaaaaaatacaaaaaaaaattagccgggcgtggtgggggcgcctgcagtcccagctactcgggaggctgaggcaggagaatggcgggaacccggggggcggagcttgcggtgagccgagatggcgccactgcactccagcctgggcggcagagcgagactccgcttcaaaaaaaaaaaaaaaaaaaaaaagaaaaagaaaaaaaaaaaagaaagaaaactccatgattcatgaggtaagacctgggagctggcggctcggtgctccggtgctgcagaggcactcaaggggctctccacgttcgccttccacgttccccttcgcagggaccgcagcgcctggggcacttcgccatgggcttggccgaagtgggcactaaaggtgcagactcggtggagccaaggggggcaaggtcagcagccctgggggcgcagccctgggggccccgccgtgggccacgcccagcgcgtccagtcctcatggccgcgtctattccaggaatggggtcctggggttcggcacaggcctgctggggtggtggccccacatcttgcctgtgtccccccatattatgcccaagggagcaacaaaggccacccctgggtccaggcctcaggagctcacaggagccctgagcccagaagacagcagcgccctcacgcggtcctcagcaaacctgccagagcccagcaggtggagaggactccgggagacagcaggagctccgcgacctcccttcctctcccctcttctcccttacgaagttagccgtgtggtggccagtgtggcttaactcaatgatacaattttaaagatttctggaaaggacttaaaagacacgtgcttaactctgagaaaagatttcaaggccaggccagaatggtggctcatgcctgaaatcccaacgctgagggaagccggggcgagcagatggcttgagcccaaaagttcaagaccagcctgggcaacatggtgagaccccatctctacaaaaaatagaaaaaattagccgggcatggtggtgcacacctgtagtccccgcgactctggaggatgaagtgggaggatcccttgagtcgggaggtcgaggttggagtgagccaagatggcaccactgtactccggcatgggtgacacagcaaggccctctctcaaaaaaaaaaaaagaaaagaaaactctaaatacatggaactggcaaacattaacgtaatgtcaattacaaaggtggccgtgacacaggaggcccagagtggggcggcccttgaagcagcctgcagcgtggggatgaggcctacagatgcctctgcctctttgactaattccacttctgagactctgccccaaggaaataacccaaaaagctaattggttccaagatgttccaagcactgctatggctaacagtgacaaacagaaaaagacccaaacactcgacaattcgaagatggcccagaaaaccgtcaagtattaaaactgagcaaaacccaattccaggaacattaaaaatgccagtcacgtggatgcttagaagtttatcagaaattaacgggaagaaatgagaacagaaagcccagctggtcgtgtctgcacaagctcacacacaccgaccacactcaggataggcaccaaaaccccccttcccctcgcaaaccaaggtccttattcataaaacacaaatgtaatcctagcactttgggaggctgagacaggtggatcatatgagatcaggagtttgagaccgtcctggcctacataacgaaactctgtctttactaaaaatattaaaattagctgggcgtggtggcacgcacctataatcccagctactagggaggcagaggcaggagaatcgtttgaacatgggaggcagaggttacagtgagccaaaattgtgccactgcactccagtctgggcaacagagtgagactctgtctcaaaaaacaaaaaaataaataaaaataaaacacaaacgcgagaacgtgcccaccagcacagatgcagggtaggatgacgccacaggaaatcagcacccaggaggtgaacagagcgcgaacatgagagcaatctacgtttctctttcctcactcctacgaggagctccagcagcagagccggagagcaccagctggcgtccaggctccactctctttcctcactcctacgaggagctccagcggcagagccggagaacactggagagcaccagccggcgtccgtgttccactctctttgacttttcacaaacccaacaggcaggcgaagagtctgcctctctgggtcccagaaccccacaggatgggcatgagccccaccccgcccagcccacagaggcgagtctgggtcccagaaccccacagaatgggcatgagccccaccccgcccagcccacaggggcgagtctgggtcccagaaccccacaggatgggcatgagcccccctaggggcaagagacgacaacaggtggacaagatgcgagccaccagcccactaggacctcggagctgccatggggtgggtctccctgaagaagagtcaagcagccttcctctccccagccccaccccacctctcatacagaagacactacagccccaggcctcccagcttctgacttccaggagcagaagtaagttcttccacagggcaggaggggccctggaaggatacgactgtcacctcctctgaaagtatttccaggaagcccactgtgctcatagccataggcaacgcagagagcaggaagatctcgggggtgcagagagggggtggcccataggtgacgcagacaactgaccctgacccctgggcccagcagagatctgcacgtgtgagggtcagctctgagctgggcgacgggccagccggctcaccttgcagccaggtgagctctaccccgctgggaagagagctgctgctgtctgactccctgccacatgaggactcaggactcactgggcaggtgagccatggtgcaggaacaaacccctttcatccaactctgccataagacaaaatgttagaatcacagtccctgtcactaagtagcacatctatttcaccaactcccacttttctgccaggtctggctcatacatcgttcagaccaagtacttgcctgggaaaaaaaactaaagtaaaaatagctcttagactccaaacgtggaagcattaaaatattcaaaagaactgaccctgcagatattgaaacaaggctttagtgctgacccaccaaagtggcggcgatcttttcggaacaaaactctcactaataggaaaactccaaattcaggcaaaatttgcatcaacttttcctacataaaaaaaagagaagcaacggtaaactacatttgcatttttagtaaaaactaaatgaaaatcaacttgaaataagaaaattaacattaaaatttttcacaaggccaggcaaggaggctcaggcctgtgatcccagcactttgggaggctgaggcgggcagatcacgaggtcaggagatcaagaccatcctggctaacatagtgaaaccccgtctctactaaaaatacaaaaaattagccgggcaatgtggtgtgcacctgtaatcccagcactttgggaggcggaggcgggcgaatcacgaggtcaggagttcgagaccagcctggccaacatggtaaaaccccgtctctactaaaatacaaaaaattagccaggcaatgtggtgcgcgcctataatcccagtgctttgggaggtggaggcgggcgaatcacaaggtcaggagttcaagaccagcctggtcaacatgtggaaaccccgtccctagtaaaagaaatacaaaaaattagctgggtgtggtggcaggcgcctgtaatcccaactactcgggaggctgaggcgggagaatcacttgaacccgggaggtgggggttgccatgagccaagaccaccccactgcactccagcctggtgacagagccagactccatctcaaaacaaaaaacaaaacaaaacaaaacaaaaactacggctgggcgtggtggctaatgcctgtaatcccaatactttgagaggccaaggcaggtggatcatgaggtcaagacattgacagcatcccgaccaacatggtgaaaccccgtctttactaaaaatagagaaaaatattagctgggtgtgatggcgcgtgcctgtagtcccagctacttggaaggctgaggcagcagaattgcttgaacacggaaggcggaggttgcagtgagccgagatcgcaccactatactccagcctggtgagagtgagactccgtctcaaaaaaacaaaacaaaacaaaaacaggcatcaaaatatgaaacaacccgtgttttaaaatacattaagttggggccaggcacggtggctcacacctgtaatcccagcactttgggaggctgaggcgggtggatcatctgaggtcaggagttcgagaccagcctggccaacatggtgaaacctcgtctctactaaaaatacaaaaattagccgggtgtggtggagcgcgcctgtaatcccagctattcgggaggctgaggcaggagaatcacttgaacccaggaggcagaggttatagtgagctgagactgtgccactatactccagcctggagacagagcaagactccatctcaaaaaaaaaaaataaataaataaataaaatacattaagttggaaattccaatgtaagcattgtggctacacaccagagtaactgctcccctgccactgccctgcgcgggcgagtcccagccctcccgcctctacctggttctactgacggctcaggcaggagttcaaggtcacaaggatgcacccagccagaccttcaggtaggaagtgtcacagaaccaaaactgatccttcagcaaataagtagcatgaaacagagagaagaaacgcaacttcagggacatcaccacccacaagcagcacatggccctcatcccaactctgattcaagtaaagccacagtgaaaatgtgcaggccacagtcaagaacgctgagcccagcccagcatcgcgacgctgaggaagtgttgcggggtgcccggctgcgtgtgagccacacacaacgaagcaccgagggtaaaactgagatttgctttaaaacacttgagagaaaaaacagtgggaagggccgggcgcggtggctcacgcctgtaatcccagcactttgggagaccgaggcgggtggatcacaaggtcaggagatcaaaaccatcctggctaacatcgtgaaaccctgtctctattaaaaatacaaaaattagccgggcatggcagtgggcgcctgtagtcccaactactagggaggctgaggcaggagaatggcatgaacccgggaggcagagcttgcagtgagccgagatcacgccactgcactccagcctgggcaacaaagcaagactccgtctcaaaaaaaaaaaaaaaagaaaagaaaaaaagaaaggaaaaagaaaaaacagtgggagagagtgggagagatgagtaagacaagagcagagcactgggggttcccgcagccaggcgacgtggacgttctctctaattttgtgtatgtttgaaaagttccaaaataagtttttaaaaatataattaggttttaaaataataatataacttttacaaaactgggaaaatatacaatccagcggtgcaaatgcggtgagagagaatctcatctggaaacccacaggcagccccacccctcaacaggaggcccaagacctgcctctgcagggggagagaaccccaagacctgcctcctcccacccccaggcaagggtcctcatttggggttgacctcccagaggagtgcagcaagcctgggcctcaggagtctgactgtgggtgacaagccacagacacagccatgtccacatcgcaccatggccaccgcaggcaacttagaatgctcgatactcaccctacttcggaattaggaatatcagatgcaccattcacaatgctatgtgctaaattaaagttccacatgttactacctcacaaatcaaactttcctgaattttagcaatgatatttcagtagttgctacccttcattttccagggatcttactggatgcactaaaaatgctattgtgagctgatcatggtctcacatgcctggggtcccagctactcaggaagctgaggcacaaggatcgcttgagcccaggacgtcgaggctgcagtgagctgagattgcgccactacactccagcctggatgacagagcaagaccctgtctcaaaataaacaaacaaaacatgctattctgaaaaggggccacagctcaccagctgctgagaagacacaaaaggccgagagcccaagtctgagctgaaggcacaggtgcagtgggcccaggtgcagtgggcgcaggtgcagtgggcacgagtgcaagtgcagtgagtgcaatgggtgcaggtgcagtgggtgcaggtgggcaccggtgcagtgagtgcaggtgcagtgggcaaaggtgcagtgggtgcagatgggcacaggtgcaggtgggcataggtgcagtaggtgcaggtgcagtgggtacaggtgggcacaggtgcagtgagtgcaggtgcagtgggcaaaggtgcagtgggtgcaggtgggcacaggtgcaggtgagcacaggtgcagtgggtacaggtgggcataggtgcagtgagtgcaggtgggcacaggtgcagtgagtgcaggtgcaggtgggcacaggtccagtgggtgcaggtgcagtgggtgcagatgggcacaggtgcaggtgagcacaggtgcagtgggtgcaggtgggcacaggtgcagaaggtgcaggtgcagtgggtacaggtgggcataggtgcagtgagtgcaggtgggcataggtgcagtgagtgcaggtgcaggtgggcgcaggtcgagtgggtgcaggtgcagtaggtgcaggtgagcacaggtgcagtgggtacaggtgggcacaagtgcagaaggtgcaggtgcagtgggtacagatgggcataggtgcagtgagtgcaggtgagcacaggtgcagtgagtgcaggtgcaggtgggcgcaggtccagtgggtgcaggtgcagtgggcacaggtacagtggacacaggtgggcacaggtgcagtgggtgcaggtacagtgggcacaggtgcagtgggtgcaggtacagtgggcgcaggtgcagtgggcacaggtgggcacaggtgcagtgggcgcaggtgggcacaggtgcggtgggtgcaggtgcggtgggcgcaggtgcagtgggcacaggtgggcacaggtgcagtgggcgcaggtgcagtgggcgcaggtgggcgcaggtgcagtgggtgcaggtgcagtgggtgcaggtgcggtgggcacagatgcagtgggcacaggtgcagtgagcaaggcaaagggggtgcccagaggagggcccgagtcctgcttcggattgggaggcacaagcagccgcaacactcagctgcccctcttggctccatctctgctcaccctcaacatgactccctccccacccaccccgtgtctctcctcacaggctcacatcacccaagatactcaaagcatctcccccatctgcataacccagcaaagcaaggactccatgacctgctgtgtacccaggccaggaacctgacctgccacaggcccagggctgcgtgcacactggctgaatgcattagttaatattttggtgacgctggttacttgccacctctgctgtaaataacagcagcgtcaaggatacagtggccacgagaggtagcagctgctgatgtgtggagaagcctccatagagaaatacgtgtgaaagatgcatcaagaaaacccaagctgtgatgctgttaagggctgaaatgtgtctgctgaagtcctaaacctgcaaacgtgaccttatttggaaatagggtctttgcaaatataatcaagttaagatgaggtcatagtggattagggcgggccctcacccaataggaccagcttccttaaaagaaaaggaaaaggccaggcctggcacggtggctcacgcctgtaatcccagcactttggaaggctgaggcgggcagatcatctgaggtcaggagttcgagaccagcctgaccaacatggagaaaccccatctctactaaaaatacgaaactagccgggcatggtggcgcatgcctgtaatcccagctactcaggaaggctgaggcaggagaatcgcttgaacccaggaggcagaggttgcgttgagccaagatcgcgccactgcagtccagcctgggcaacaagagcgaaactcagtctcaaaaaaaaaaagaaaagaaaagaaaaggaaagggccagatgtggtggctcatgcctgtaatcccaactcttggggaggcagaggcaggaggatcgcttgagcccagcatgggccacatagggagaccctgtccctacaaaaagtaaaaaaattagccaggtatgatggtgcatgcttgtagtcccagctacttgggaggctgaggcaagaggatccttgagtctgggagaaggaggctacagtgagctgtgcttgtgccactgtactccagcctggcccacagagtgagatcctgtctcaagaaaaaaaaatagaaaaagaaaaagaggccgggtgcagtggctcaggcttgtaatcccagctcttcaggaggccaaggtgggcggatcacctgaggtcaggagttcgagaccagcctgggcaacatggtgaaaccctgtacctaccaaaaatacaaaaaattagtcaggcgtggtggcacacgcctgtaatcccagctacttggaaggctgaggcaggagaatcgcttaaacctgggaggtggaggctgcagtgagctgaaatggtgccactacactccagcctgggcagcagagtgagactctgtctcaaaaaaaaaaaaaaaaggaagaagaagaaagaagaggaaaaaacctggacacccgcaggggagactgtgtgaagacagaggcagaggctggagcgaggcgtctataagccaagaggcaccagggactgtggtcaacacctgcagctgaagaggcaggaggaccctcccctggagccttgggaggaagagtggccccgtccaccccgatgctgggtgtcagcctccagccctgtgacagaataaggctctaccgttttcagccactcaggccatggtcccatgtaacgcagccccaggaactcgcccaaacagcaagctcacctacagagactgcacggcaccacgctctgagtggtggcactgggggtcttcacccaggactcacatggtcccatccgccagggaccctgccttttgagtctgtagttttgaggtacactgcaaggggccctttgtagagctggacaagggcgctggggtgagagccactggcgccatccacgctgcccctgccaggtgaggcatgccttgaccacggtcctgctggaaagcacgtggcaaagccacccagaaaccagatgcaaagcccagaagccctcggtgcagcccctgcatccaagtcacggtcccctccagctgggctgcgtaaggaggtccaaccctgggtcttcgtgaggaggagagcagcgcagtgccgccccgcagtcagttctgcagagggagggtgggccaggccagtgcggacccccagggcatgttctacagcaacagtggccacagctccagccaacacctgggcactcgccatctctcctgatagttatgtattcatgtcagcatgtcaagaaaagcatcactggctggtcgcggtggctcatgcctgtcatcccaacactttaggatgccgaggcggacagatcacaaggtcaggagttcgagaccagcctggccaacatggtgaaaccccgtgtctattaaaaaaaaatgcaaaaattagccgggcatggtggcagacacctgtaatcccagctactggggaggctgaggcaggagaatcgcttgaaactggaaggcagaggttgcaaggcagaggttgcagtgagccgagatcgcgccactgcactccagcctgggtgaaagaacgaaactccagctcaaaaaaaaaaaaaaaaaagaaggccaggcgcagtggctcaagcctgtaatcccagcactttgggaggccaaggtgggcggatcacaaggtcaggagttcaagaccgcctgaccaacatggtgaaaccccgtttctactacagaatacaaaaattagccaggcgtggtggtgtgcgcctgtaatcccagctactcaggaggctgaggcaggagaatcgcttgaacccgggagatggaggtggcagtgagctgagatcgcgccactgcactccagcctgggcgacagagtgagactctgtctgagaagagaagagcatcactgagacaccaactcatgacttcctggatgcgcttccttcttaagacaaggcaaaaattaggtgaagtacaaaatgaggttgttatcaataacattaagcgaacagagagcgcacccgggatgctaatggatgctgcctgccagctttgctccctccaggagcgcatcccgaagaagacgagccagccctcaccagggtgcaggtgtgtgtctcactcagacccttcctgaccctgaatctcaggctcacccggaggcgtctgtgatcacagctctgcttcctgtgagggctctgccatgggcactcgacatggccttacacagacacagggtcccacagacgatgggacctcctaccctcccttctcccaaggtctctagcaatttccacactgaagaaagcaaaaacagcaacagtgtcccaggggccagaccagaggtaaacggattaaaacaaccacttctcggcctccctgaatgttactgcaacgtctagtgaaatccagtgagcagccgtgaaaatggctttaactagatgggatatcagagttagtgccacctcgtaactccctgcctcactccgccaacaagtaagaaaagcaactgggacgctcggagcactgacagccgctttgtcagtcacgggacacgcatttcaccgtccagcagagggtgtctgctaatgatttccgaaaagttcttcaaaacactccgaagtacagaacaagtctacatacaaactaaaataaaagcaacgaaatactatagatgtatttccatatatcaccgtaggcagcgaaacataaccatttcctcaggcaaaaacatgcaaactcccagtgtatgacgttagcaacgtataacgaagaaaagaaagcaaaagtcataaaaacagtaaacaggcacacttttttttttgtttgagacgaagtctcgctctgtcacccaggctggagtgcagtggcacgatttcggctcactgcaagctctgcctcccaggttcacgccattctcccacctcagcctcctgagtagctgggactacaggcacccgccaccacacccagctaattttgtttttttgtatttttaatagagacggggttccactatgttagccaggatggtctcgatctcctgacctcatgatccgcctgcctcggcctcccaaagtgctgggattacaggcatgagacaccgcgcctggccaatgtaaacaggcacactttttaagaagtatattatatatatatattttttttttgagacagagttttgctcttgttgcccaagctggagtgcagtggtgcaatctcggctcacacaacctccacctccccagttcaagcgattctcctgcctcagcctcccgagtagctggattacaggcgcgccaccatgcccagctaattttgaatgtttggtagagaccgggtttctccatgttggtcaggctgatctcgaactcccgacctcaggtgatccgcccacctgggccttccaaagttctgggattacaggcgtgagccaccgcgcccagcctatttattatttttttagatggagcctcacactgttgcccaggctggagtgccacagcacgatctcggctcactgcaatctctgcttcccaggttcaagcgattctcctgcctcatcctcccgaagatctgggactacaggtgtctgcccccatgcatggctaatttttttttttttttagatggagtttcgctcttgttgcccaggctagagtgcaatggtgcgatctcagctcactgcaacctccgcctcccaggttcaaaagattctcctgcctcagcctcccaagtagctgggattacaggcatgcgccatcacgcccagctaatttttgtatttttagtagagacggggtttcaccatgttggccaagatggtctcaatctcttgacctcatgatccgcccgcctcagcctcccaaagtattacaggcgtgagccactgcgcccggccttttttttttttttcagtagagacagggcttcacgatgttggccaagacaaactcctaacctcaggatccacccacctcagcctccaaagtgctgggattacaggcctgagcccctgtgcctggccattattactattattattttttattttagagagggtcttgctgtgttgcccagggtggccttaaactcctgggctcaaacgctcctcctgcctcagcctcctgagcagctgggactacaagcaggcacgcttttttttttttttctgagacggagtttccctcttgttgcccaggctggagtgcaatggtgcgctctcagctcactgcaacctccacctcccaggttcaagtgattctcctgcctcagcctcccaagtagctgggattacaggtgtgtgccaccacgcacagctaatttttttgtgtatatatttttagtataaatggggtttcaccatgtcagccaggctagtctcaaactcctgacctcaggtgatctgcccacctcggcctcccaaagtgctgggattacaggtgtaagccaccatgtctggtccaggctcacttttaataaggtgatgctaaacagaaatacttaaagtacagagtaacattaacctgaaatgtttcattcactttggaaaaaaacaacagccactgtttaggaagcaccgaggcggttttaaatatcctgactcccttagtttcccttcagaaataaaaacctttgtgatatcactaacaattctcagagcacaaggctgtcccgcagcctgccccaagcacttactcaccagaaaaacccagccagtcactcagcacactgcgagaacttacacctttaacttcccctatctaagaagctttttgcgggaaaaattaccatctgtgcttttactcaatagtgagctcttaccattaacattttagaaacatgaacacagccctgatcaagcggaaccgatacactcccgaaacaggcagaaaatcctaaacacacttgcagcaccagccagcaaagctgcactcacagcgtcgggaaccggaggtggctgggagaaccgggaataaacgacgggacacacgtccagccttcctgagttcaagcgccctgaattcacccaccagcacacccatgggggagacgggcacttttgtatgtgacacgggcccccaatgagaaaagcctggggtgctctccctagagctgacacgtgtacacgcatgcaaaacccagccctgggactgatgggctctaggccccgacaaaggagcacaggaggcctattccatttcagtacaatgggttccgtgattggccaaggctgggctcagtcctacaccagactgacagcttcctcaccctcccacgcttgggtttaaagacatgtccacaggaagatgcaccatcagtcaacggctgctgttaggagaaacaggaacagcactgaccacacggcgagcacaggacacggccaacccggcaagcacgaaaacatgagagtgaagcctacagtgagtctcggaattccagaccacgggccaggtgctatggctcacacctgtcgtcccagcactttgggaggctgaggcaggatgaatgcttgagcccaggagtttgagaccagcctgggcaacacagcgagaccctgtctgtacaaaacatgttttaaaaatggaaacaaaaagtcgggagcggtggcacacacctgtcatcctagcactttgggaagccgagacgggtggatcacttaagctcaggagttcgagaccagcctgggcaacatggacaaaccccgtctgtactaaaacttaaaaaaaaaattagctgggcatggtggcgcgcacctgtgatcccagttactcaggaggctgaggcagcaggagaatcacttgaaaccgagaggtggagattgcagtgagccaaaactgcaccactgcactccagcctgagcgacagagcgagactccacctcaaaaatacatacataaaataaaaataaaaatgggaacaaaaggccaggcacagtggctcactgtcatcccggtactttgggggttccaggtgggcagatgggggtgcactcgcgctcaggagttcaagaccagcgtgggcaacatggcaaaacctggtctctactaaaaaaagtacaaaaattagcagggtgtggtggcacacgcctataatcctagctactcaggagactgaggcacaagaatcacttgagcccaggaagcagaggttgcagtgagccaagatcacgccactgcattccagccttagcgacagagtgagaccctgtctcaaaaaaataaataaataaataagataaaataaaaataaaacaaaaataaaaaaattggccgggtgtggtggtgcgtgcttgtagtcccaggtactcaggaggcagaggtgggaggatcaccttagcccaggtcgaggccgcagtgagccatgactgtgccactgcactccagcctgggcaacagaacgaggccccttctcaaaaaaaaattaaataattcagaccagaaaaaaggacaatatccacgtcacactgcatccctgaccacacacttcccagaacaagttttctcgttgtggtgtcttccaattccttttcctctgtcctgattcctgtcctgacctttgtcctctaggaaccttgtgtgtgtgtgtgtgtgtgtgtgtgtgtgttctttgggactgctccgttttctgtttgtaaaaggaaatgtaaaccgttgaatgggctccccacaggactaacgtaaacgaccagattacacttgagaagtggagattttgagtgcagagaggaggctgtaggcgaatcaaggcttctttagagaccagaggctcagggcagggtcgctggccaaagtcctctgtttccttgaatgggtaacaagcagacacgtcccacctaagcatcagggccaccttcgaggttgagcagccggcctccctgaagcatgggaaattccgagtcttgtgggtctgcagattccacactgaaatgggaggaggaagaaatggggctggacctggacaaacaagtgccttcttcagccagtctgtcctccacccctaaaggagctgaataatctctacttctttcgaaaatacctaagctggctttgaacttgccaaataaaaggatactgccattcaccagattcaataatttaaatggcatggaaagagaacacccattttattcaaatagggccacaccaagacaagaaagactacagaccatgttgtcttgaaagctaatttagcaaatatcagaaaaactcacttggcggttgccacaaaagccctgaaccacgccctttttcctgaaagctcagggtctgcaggacaactcagaggttctaatcccacccaaaatttcacgtggccaaggaacacttaccgccttcccccacccccgttcttctgggtgctctgagaggtgatgtttccatcactgcacccccatctcaccgtcatcaaaccctccctcccccatcttcccatcactgcacccccatctcaccgtcatcaaaccctccctcccccatcttcccatcactgcacccccatctcaccgtcatcaaaccctccctcccccatcttcccatcactgcacccccgtctcaccgtcatcaaaccctccctcccccatcttcccatcactgcacccccgtctcaccgtcatcaaaccctccctcccccatcttcccatcactgcacccccgtctcaccgtcatcaaaccctccctcccccatcttcccatcactgcacccccgtctcaccgtcatcaaaccctccctcccccatcttcccatcactgcacccccgtctcaccgtcatcaaaccctccctcccccatcttcccatcactgcacccccatctcaccatcatcaaacccttcctggctgggtgcagtagctcatgcctgtaatcccagcactttgggagaccgaggcaggcggatcacttgaggtcaggagttcaagaccagcctggccaacatgatgaaaccccatctctactaaaaatacaaaaattagccgggcgtggtggcggatgcccataatcccagcttctagggaggccaaggcaggagattcgcttgaacccgggaggcagaggttgtaatgagccgagatctcgtcactgcactccagcctgggggacagaacaagactccgtctcaaaaaaaaaaaaaaaaaccctccctcccgcccaccatctcactaccatcaaacccctccctcccggcttcccagggccagttgtccccatgctgcacaaacagccctgggcactttgtgtcaacaactctgttttctggttctatccctgcacttgctgttcctccaaccagaacagccttgctccacttctcagcctctgcaaagcggctggctatggccaatgagtggattatgagtgtgtttctagaaagcctgtgtgtctggatgtgcccctccacagcccagaaatcaacaaccaggccttcgagtttcttcataactcagaagcttctaatctctgtgactttttgtgggattctttcagggaagtcagttgggaaagcggcgaatcaacactgcgacaggtaatgcttagcttgggccgacttctcgttcttctgcccagttaagagccatagttttgctccccatgccccagcagataagcaaagcctctgtccatccggcgggtgacccacactaagaagacgacttgcccagagtaacgtgggccacgcggtccaggtgtgtccacctctcacaaaggcagctgtcaacaccgggagttcctaagccctctgcacgtagcccaaggcacagcagtgcccctctccacatctccacagaggagcaccgacgcaggcctcgtgtgcagcgatatgccagcgaatgggaaggctttctgtgcaagaggcttcattttcttcattttcttcagagtggttggaagagatgatgtgatgcacttttgtaaacgaaaatgtcttacaaacaaagtatctgtgtgtcccatgcaagcagcaatgctgcccgactttcagataaatgaagacatttttagaaactgattgttcacacacatatgtggctcttttccattttgggggaaactgagaaggactgagtcgctagtaagtcagagatgctcaaagagaaaccaagaggagcccgggggcgacacctgggccgacaatgacaggcccagagaagaaatgctttggctgggcacggtggctcatgcctgtaatcccagcactttgggaggccgaggcgggtgaatcatgaggtcaggagatcgagaccatcctggctaacatggtgaaaccccatctctacttaaaaaaaaaaaaaaaattagccgggcatgttggcagacgcctgtagtcccagctactccggaggctgaggcaggagaatggggtgaacccggaaggtggagcttgcagtgagccgacatcgcgccgctgcactccagcctgcgcgacagagcgagactccctctcaaaaaaagaaatgcttcacggatgacttttccaaaaagacagcgagtgtccttgggaaggcattatgtgtgctgaaccaagtcttcagaaggtacaacgtgaaactcaactgctcctcatgcctacccccacagctgaccagctcccaaaagctgcctcctacgtacagtggccctgccctccggccagcaatccactctccgggaagcagggtttggaatatgactcgctccaccaggaccggatgactgccaggtctggaaccgtgcgggtggatctccgagtggactcccttccctcgagtcacctttgggctccggtgccactccccacagcagtccccacagcagtccacacagcagtccaggcaccctcctcccagccttgggccgtttcttgccagcctctgccagccaccacactgggtcacatcagtggtttctgcgtgcccccaacccacctccgtgggaactttgtcaccaacctggcccaaagtctggtccacagcaggccctcagtaacaccaaagagctgtcatgaataggaaaccccgagtgtctccggtaagacgcaaaagcccatctgtcaaaacacaaaagatggccgggcgcggtggctcacgcctgtaatcccagcactttgggaggccgaggcgggtggatcatgaggtcaggagatcgagaccatcctggctaacaaggtgaaaccccgtctctactaaaaatacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaacaaaaaaaaaaaaccacaaaagatctgcaaatgcttttgaaaaatacactaatgtttctcaactttctattgtaaaatagctatggtagcaaatttttaatccagataatgatgtttagaagcatttaataattttaaattgtaaattagagtaaaacggcactgctgatactcaactatgcaacagaaccattcaacagaacactttgcataaatcatacttaggtcaaatttcactggtttcatttgtttttatgctttaacaggacaatgttttatttgtttatttattacttaattttattgttttagagacaaggcctcgctctgttgcccaggctggagtccagtggcacaatcatagttcattacagcctcaaactcctggcctcaagcggcccgcccgcctcagcctcccaaagcactgggattacaggcgtgagccaccacgcccagcctcagaaccacttttaggttgttaaaaaacatcctttctcttttccatctataaacaacaccattggggccctttgtcatcaccagcaaaccagaacaccaagcctgggtctgtatatgtgaggcactcaaagggtctaagtgataacagaaaagcaggaaaatccctcccatggaccccatggcctaagaccccagcactccgcacaagttcacagctacgccgcagccgcggcagacggcaagaggaccacaatcaggataaggcggcggcctctcaaagccctgaataagtctgtggccttaatagagattttgaatcaaacatttattcttaggagtcaggccattcaagcaaacttagcagcaacaagatgaatttttcccccaggggaggggacagattcaaagggtatttttttttttaaatctgctagaaaaaccagtagagggaagtatcaaccatcactcaaggtcactcatgagacttccaggtaaaacatgcaaagcccagggagaagcagcagcctgagtttttacaagaacggtacttaggcaagaacacgaagtccccaggacagggaacctaccacggcagacgccgtgacactgggtgtgcggatgggaaggggcaaggacttctagacctttcctctcactttaactcagcagtggagcgggtgcctgggcaccagtcacggcagtgggaggaaccggctccagttctcaggctgtggagccgtctaggcaccgtgcacgaagtgggtctccagggctctgagaggccgggctaagacctctgatggagaacagagcactggagctgcaccgctgtcccagaaacacaggccacagggacagagtggcccaatttcccttaatttaaaaaccccacgtcagggcagtgttggaaagttcactctgctaaaatttaattcagtgtttgtaaatagtacatcgtctgacaataacaactgtgtaccccccacggcatttcctctaaatccttggagcagtttcaccgttcacagggtttacctcctgacctctgtgaccaccaggggctggggagggacggaggacgcagggcactgggtcagcctggccctggtggaactgacctgggggcccttaggtaacagtccacccaacccgaacatccgaaacaggagtggaactcaggtctgagcacagaacgactcatcctcacacaaaacagctaaacccgaacagaaatcacctcatctaagcaaaagaaaactctcacgttcaggataatgctgtcagtgagaggcttaattaaatgcttgtccccaggctggcctgaaggcaaggcggaatttcggatttctaaacacctcaaagtgagtgcattccacgccccaaggagaaatctgacagtaactccccagccctcttccttcagttacggagaagatgtctagctttttaggggacacagtaagttcccacctaaatttgcagtaacttgtgcccaagtactcccctcactcctcagtcctttctgcagtggtaaccaggctgaggtgcccaaaagtgccagttggaaacacgtaaaacacaccgagcagaaaggttctactctgataaatactgtcgcttgcttcattattcatgtgaaaaaccccttctatacatttccttttgatgaacaaactattttccactcttgtagagtgaaatagtgccttgcagaggcagcgtgagtgccagcagcagagatgtatccagtctgttacccaaacgggaagttagctctgataatagagccaatatgaaagattctacaatcgatacaattaaaatgcccgtgagttctcggcgcacaggtgtctgcgcccaggccgcgcgctaaacacgtttctaattagcatttctttaaacaatgctgatcacaatcttgccaccgtaatccactccaaatgcatcgttgagattgcagcacggaaagcgagagaggaaattcgctgcgaatctcaaactttcttttgtttatatttcttcgctgtcagaaaatatccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattccccgtttgccttagggattgagttgtcagacaccggctcgcgctcccccgcgaaactgacatgtctatttacagagaaacaaagacgcggctcgcagcggaccccgcttcctccgcgcgccccgtccgccccgcgcgccccgagccctccgcgccccgagccgccccgccccgaggcccctgcgccccggttcggccggcgattaagatggagaccaggccggcgcccggcgtccggggagacaatgaccccccggcctcagggcgccgggacccgcccgcgcccacctcccgcagttccgactcttggcaaactcggcgcgggcggctccgggtgcggctgggctgtgccggcggggggcgcgggcggggggcgccaagacgcccccgggctgcctcggggccaggcgttgacgcagcagaaattaccagctggaaaattcccctctcggaggtgccggggagggagcgcggcggcggcgggaggtgccgggggccgaggggccggggcagcccagccgcctccgcgctcagccccgcggggaacccgcgccgcccccgcgcgccccgccccgcgccgccggcctggggggcacccgcgggggccgggccggggtctccgccgccgcccccggagcccgcgccgcagctgggagcgccgatggcccccgggagggcgcccccgcggggcggggcgtggcggggcggccggcggcgggggcgcgcccgggctcgcagcggccccggctcccggctcccggctccgggcccggcccccgccgcgatgcgcccgcccggccgcgcggacaatgagccggcgccgcttacctgtgaccccatggggcgcgggcgagggcgggcgccgcggccgccgggccggcgccggtgatcgccgccgccgccgggagggcgctgcgtccgggcgggtccgagctgcgcgctcgccggggctgctcggtccgtccgtccgtccgtcggtccgtcaggccggcgcgcgcccccgcgcccgctccaaccccgcggcccccgccgcccgcgcgcgcgcgccccgcccgcggaccctgaccccgccccccggcgcgcgcccggccgccgctgattggcccgcgccgcgccccggccgcggccaccgccccgggccccgcccacgccggcccggccgccggccccgcccctcgctcggctcccggcgccgcgccgcggggtcgcagggggccgcgccgggggtccgttctcccccccgcgggcagccggacagcggaagtgcgggctggagctcgctgggcattgtgggaagccccctcccctgggctggcggggggctggggcggcgcggcgcgggggtccccctggcccccgctgcgcccttgccccgcgagcgcggagcagcctggaaacaccccacgggagcggcgaccccggcgagggcacccgctcccttcccgggccgcgcaccgggcgctgcccacgcgcaggttcctcgggggcgcgcgggtgcccaggtcaccggccgtccccgcgcctgacgcgcggttgcactgcgcgcgtctcgcaaacttggcgactcccccagcccggccgggcatcaacgcgggccgctcgcggtgcggaaaaggcgcccccaaggaaggccgcccggggtgcggggtctggaagggcctgggcaccgcgcgcgcctaccctcgggggcctcggcgcacccggagatcggcgcacctcgggcgcaggcctcgtgggggtgcccgccagtggggctcgcttttggctgactaggggcaccggcggccgcgcgtgggtccctcccgtcgtgttgtctgcgggggacgaatggctccgggagggggcgggaaccagcggcccgggcctcgccccagcccgtgtgcagccccgatccgaacggcctgggacgcgtctccaccactcggcgcccggactctgcgcgtcgcttctcgcctccgccgtcctcagccctcgggcgggtagagtgggaagcgcggccccgcattcctggccggcctgcgcaggggtaaaggccacctcgcttcctctccccgggcgcggcgggaagggaggtgagcctgtggccggcagccgcgcgagggagtcgagcccggcccggccaaccaatggggaggcgcccgggccgtccagcctgcctccctgcgggcccagcgcagcggattcctcgggaggtgggaggcggcggccctatgggtgctttcaaatctggatgtgtgaggcgcattcaggagcggcagtgggaggcggctgagggctctccatgagtgagcaaaggcgaagcgaggtgtggctgccgggaccaacgcctgggacactcccttactgccgtcgcgggcgcctggaaatggctgtgcggacaccccgttcccatcccctcgccaaggtcgccgggatggcactgcggcccaggaagccccgtcgccggcctacctcgcgcggcaccctctcggtggcactgcctgctctggtctgaaactgtagccccagcctcaccgaccttcgggaagtgggggctgagcacaaccaccctgagaagaggcggcttccaggagggtctggcgggtcacgtgcatcccccttggagaaaacagcactgcctgcaggagcccccacctgcccacccagagcccagttgtaccccacggaggaaaggaggcctggggagacaggagagctcgggcccaccgagccaaagcaaggaggaccagagccctgatgcctgccccaagggcctcccgcagagcctgcccatgctctcttgcgcaaaagagaaccccagtctctcccaagatgtctggacctccctagacagcctccaaggagagcagtgttgatggtttgccatgtccgttgtccatgcagggatggagagcagcagcagctgcctggcggaacacacagtggcactcagtcatcgcttaggaggcctgcccataagaaccaaaccttgatctcaccacgacccaggccaaccccacctgccaggttagggctgcctgtcttggtagaaacttgctgagggccgggcgcggtgtctcacgcctgtaatcccagcactttgggaggccgaggcaggcggatcacgaggtcaggagatcgagaccatcctggctaacacggtgaaaccccgtctctactaaaaatacaaaaaattagccaggcgtggtggcaggtgcctgtagtcccagctactcgggaggctgaggcaggagaatggcgtcaacccgggaggtggagcttgcagtgagccaagttcgtgccgctgcactccagcctgggcgacagagcaagactctgtctcaaaaaagaaaaaaaaagaaacgtgctgagttctagaatgaacggggcggatgaggctctgggccccctctcacctgggagccccactcctccccgcttccccctcggcaacactgccagtgacgggacagagactcctgacttttctgctccaagaaccaacagaaggtcaagcagcctggagacgaagacagtatgtcaaaaaggaagaaccaagaccggtctcagagacagcgccctgattaagtcctacagaccgttattccaagagctgataaaccccattactatttaaaagaaaaacaaacaaaaaccagcagcagcagctgcagcctctcagccgaactgggaggacgaggagggtggagtagttggactcctacagccacgtggagtgtctgctccgacgggcatgctggccccgtggcccaggaacctcaggtttgttggagcccagcatctactgagctgctgctgggattagacatgagacggggggatgccaggctgggccgcggtgccccctcttcctagggccccgggacacttgtgcaggtgacgcacaccaggcctgggggccacagatgcaaggagggatctgccgcctgacagccggctgggaggcagctctgggaacagagaatgtgaagtgtggcctcagcagcattgggatcagggctgggaggccagcacatgggtgtctgggagggtccagagggtggggcccctgagggtgacatgatgaactggacatggtccctgacctcgccaagtgggtgaacaagacaggtgaacaaaaggtcaggtctctgtagggcacacttgtccacgctgcattacgtggtcattcctgaaagtcacccccagccatctgggtgagcacgttgggagcctgtccaagggaccctgaggcctatgagggatgagcggcagcaggccaggagttctggaggacggggggctcagggcaaggtgcagaggctgggcagccccacggatgtacctgctgagggacgtgccccccacaaacccctgggaaaactcaaccagagacacaaatggagagccatctggctggcagggccccccgagggtcctggcacagcctcgcgcttatggcctctccgcagacctgtgttcacagactccctgcaccacttaccctgccagccggccacctgccctccaccctcactgtgtggcttctaggggatggggatctgggaggggacccagccccattccaggtgctctgacaccaccaagagagtagggatctgcctctcatcctcaggaaggatggcctgggaggagctttgggaaagaaaattcccgaggaacaagataccccttcctgtctgtgtccccacccccccccaagcagctccccaacctcgccagggcctttactgccaccccctcttctcccaaggaggcatttccttgtccacccccagctgggatttctgtggttgtctttgtctcagtcactggtcagggaacctgcctgtttattcaccagccagtggtgttgctcagtcgtccccatggcaacagccctgggagtcctgccccctcccagggaactgcccagaacctgtccctgccctctccaggcctctgctgggagcccagacagagggagaggcagagggcagggcggggagagaggcccgccaccagcctgaggatgctggggctgtccagggagccgcccaccacacgtcatcctgggtcctgcgggtggactggaggccggccgtgggctgcaggagagccccacccacgggctgggggaggtggccttgtcgaggctggatagaggtgggcctcctctcgggcttggcttggccaggtccagtgccagctggccctgccctcccacccaggcctccccaggaccaccctccagagctgctctggggccaggggctacctgccaaccccacggctgccccaccccaactgtcctccgggcctgcgcccctgccaagccccaactgccgctccagctgccacagccaactgtcgaccggtctccattccaagcgcctgctcacccccaatcgtccttccaaaatgctgctgccaactgccagccccctcccttcctgagccctggctcccaccaccactccaggccaccacaccagggatctgcattccagaccttccctgggacagaggccaggccacacctgccgtgtccctaatgggatgggatggggcgggggaggcactgcactgaaggtctgagacctgaggccccagcagacagaaggcaaggggcagggagagcgcgggcagggcaggggagagggcaggggcagggagagcgcgggcagggcaggggagagggcaggggcagggagagcgcgggcagggcaggggagagggcaggggcagggagagcgcgggcagggcaggggagagggcaggggcagggagagcgtgggcagggcaggggcaggggagagcgcgggcagggcaggggagagggcaggggcagggagagcgcgggcagggcaggggcaggggagaaggcaggggcagggagagcgcaggcagggcaggggagagggcaggggcagggagagcgcgggcagggcaggggagagggcaggggcagggagagcgtgggcagggcaggggcaggggagagcgtgggcagggcaggggcagggagagggcaggggcagggagagcgcgggcagggcaggggcaggggagaaggcaggggcagggagagcgcaggcagggcaggggagagggcaggggagagggcaggggcagggagagcgagggcaggggagggggcagggagagcgcgggcagagcaggggcagggagagcgcgggcagggcaggggagcgggcaggggcagggagagcgcgggcagggcaggggcagggagagtgcgggcagggcagggagagcgcgggcagggcaggggcaggggcaggggagaaggcagggcagcccatcctcagtgccaggggccacgtcaggcccagcgcaggggtgggaaggcaaccagagcgcagctggagcaggccctgggagctgcagggcggagctggaccttccctcagagggtctgtgaacagcttggcctaaccacagaccccgggagggtcctcccagccatgttggggggaacgggcccctccctaccagccttgcacagctcagggtggaaccagctcccaggcctcagctgtcccaggccatcctggactccctcctgcttcaccacctggcacccggggccggcctgagtccctttaagttccaacgtgtggcttctcagtcccagccctggccttgctgccccttccctccttggagctttctctctgcattcatcccagtggtccctgatccccacctccaacataggacccccctccatatcccccagcccgctagaccgtatccctcaaacacagcgggtgcctgcaagttggctcaccaggcctaggggaggcacggctgcccttgcgggtcagacctggggctgtaattccatcccaggctctggaccagccggtcagcaccaggaggtgatgggggccggggcctcagtcccggctgaagggacacagctgctccccaggggcccctggcctctgagggctcgcgttgcagaggcgggtgatggctctgcagatagccactgcaggtgaaatggacacctggctctccctggtgtcccctccaggagctgtcactgggcagtccgccttccaggatgggacatagtggagcaggcacggggggccatgtcagcctgtcagtcgggctggccctggaggaaggtttgcacctatggtgtaccaggaatctccctacttggggaacagtgaggggaaggactctccagggtcacctggtcccacctccggtgctggggcctgggaaggagagagaagggaggtggctgtggcccgtccccttccaccagaggggggctgctggggttcccttggtggatatggagaggccccagccctgcacaaggccagcctgttgcctcagcctcattcactcactcactcacttgcagggtagcattcacggatcatggcacctaccgcgtgccaggacgtgctaggtctggagagccagaaaaaaccccttgtattgcaagagtggagagtcggtgacaggtcagcaaattcataaacgagctcttctgagataaaaaggaactgggaatgggccccttggggacatggctggtgctggggcagagcaggaaaaggcaagctgagctcctggccatggtgggatgacagggggcaggagggccagagaggagaacagcagaatcatatagtgctggcttatgaccccaagctggagcgcgtgctgatataaaaaataagaacaattaaatgcaagaaagacaccaacctcccctacaaaagaattcccagtaatacctgtaggttccgagagcagagattacccctatgcacacaccatgagtgaggactgggtctagggactcctttccaaagagcggagtcaagacaggcaaagaggaacttggccgaggaggcgactggcaggcaccaccttggccaggtgaccaggtgagcgtcgccaggtgatcgcacggatgccccacagctctgataagaggtgactcaaagagcaccccacctctgtgaaatccttcccaaacccaaaacctcagtctactgctgagaaagtacatcagacaaacccaaactgaggggctttcttttgttgtggttgcttttgtttttgagacggagtctcgctctgtcgcccaggctggagtgcagtggcaagatctcggctcactgcaacctccacctcctgggttcaagtgattctcctgcctcagcctcccaagtagctgggattacagttacctgccaccacacctggctgttttttgtatttttagtagaaacggatttttagtaacaagaccatgttggccaggccgtttttgaactcctgacctcaagtgatctgcccgcctcggcctcccaaagtgctgggattacaggcatgagccactgtgcctggacacaaactgagggactttctacaaaaacaccttgtcggtgatcctcaaaggtcaccaagaacaaggaaatctgagaaactgtcagacaggagagcccgaggagacgggacagctctaaacattgtggcacctgatagggccctggagccgaagaaggccatcaatggcaggactggtagacttcaaataaagtccgttctgcgggggagataaacggaccccaacgtgggcttcctaaggcaacccagcaacacaggatggcgacgtcagggaagacagaggcttcgtgacaggtgcataggactctgtgctttgcagtgtcacacattctactggccaggctggagtgcagtggcacgatctcgattcactgcaacctccgcctcccgggttcaagcgattctcctgcctcagcctcctgagtagctgggattacaggcgcccgccaccacgcccagctaatttttgtatttttagtagagacgaggtttcaccatcttggccgtgctggtcctgaactcctgacctcttgatccacccgccttggcctcccaaaatgctgggattacaggtgtgagccgctgtgctcggccaatttttttatttttagtagacacagggtttcaccatgttggccaggttggtctcaaactcctgacctcaagtgatccaccacctcggcctcccacagtgctggcatgacaggtgtgacccaccgcacccctcctgcaatgtcgcccattttctgaaatctaaaattattccaaaataaagtttgttttttaaaaggggaaaatgcaaaaccaaacaatcaaagaaaaccaccttcttttgaccctggcgttgggagttaagcagcctctccaggcctgtctcaggcaagatgctcatttttggttttagaattcgggggttcagggtgctcctggctctgcccagcttggaagcacacacaggccacagggaccacagaacctccaagctgagtcagggtacgccccgtggaaggacggttggtccccgcgttcacacctgcgtgttacgaactgtgagccctcacactgcggaggagacctaccagaacgccgtcctgagagactttgacagagctcagcctggcatcggcctgcaggagcctcatccctaaaggtgattccagctctgtgttggtctctgctcaaggtaacaaagtgctgccaaaatgcaaagtgcaaactctatcccagtgcaaactttccacagctaaagcactttccctgttttccactcagtccttctgtgattttccatttccccagcgcctcttgggttaccccttcgttacttccccataccccttttttgctccttttctgttctccctttaaaaacctgggttggcccggtgcggtggctcacgcttgtaatcccagcactttggaaggccgaggcgggcggatcacgaggtcaggagtttgagactagcctggccaacatggtgaaaccctgtctccactaaaaaatacaaaaattagccaggtgtggtggtgggtgcctgcagtcccagctactcaggaggctgaggcaggagaatggtgtgaacctgggaggcagagctcgcaatgagccgagattgcaactgcactccagcctgggggacagagcaagactccgtctcaaaaaaaaaaaaaaaaatactgcagtctgcccccacaccgcaatctgagtaaaacctgtctttccgccttcaggtgtctgggattgggtctcattccgggtcccatgcctctgcctgagtctcagccgcgtgtctgtgctcctgccagcgtatgcttgctcatgtgtgtctgtggatggtgactgtgtctgcctgtgtgcacccatgtgtagtgggtctgtgtgcttgcttgctggtggctaaccatgtctgtgagcgtgtcatgccaactgcattgcactttctgatgtcatctgccagccacgtccagttcaggacattgggcaaaaaatggtcctgcccttcaggggcccgccctaccaagggtgagccgtgaaccaagtctcaggatcgaaggcaaggtgcccctctggagggaggtggggctctgggaagcttgggggccgtggccatggagatgcggggggatggggagtgcccagcctgagctggacagggttgggccaagccctgagcacgtgcacgaggagtacagatgaggctcagaggccttgctgggaccatgggaatgagccagtttccaacaacttgatgtcaagccagggcttctgggcttttccttgggctgaagatgctattaggactatgtttatttatttatttatttatttatttttttgagacggagtttcgctcttattgccccggccaatggcacaatctcggctcaccacaacctccgcctcccagcttcaagcgattctcctgcctcaacctcccaagtagctggaattacaggcgcccctcaccgcacccagctaaatttttttgtatttttagtagagatgaggtttcaccatgttggccaggctggtcttaaactcctgaactcaggtgatctgcccgccttggcctcccaaagtgctgggattacaggcgtgagccaccacatccagggtatttatttatttacttattttattttttgagatggagtctcgctctgttgccaggctggagtgtagtggcgcgatctcggctcattgcaacctccacctcccgggttcaagcaattctcctgcctcagcctcccgagtagctggaactatagacgtccaccaccacacccagataatttttgtatttttagtagagacagggtttcaccatgttggccaggatggtctcaatctcttgacctcatgatctgactgccttggcctcccaaagtgctgggattacaggtgtgagccactgcatccagccccttatttattttattttattttatttatttatttatttttttgagatggagtctcgctctgtcgtccaggctggagtgcagtggcacgatctcgactcactgcaagctccacctctcgggttcacaccattctcctgcctcagcctcccgagtagctgggactacaggcgcccgccacaacgcctggctaattttttgtatttttggtagagacagggtttcaccatgttagccaggatggtctcgatctcctgaccccgtgatccaccctccttggcctcgcaaagtgctgggattacaagtgtgagccaccgtgcccggcctattttttgagacaaagtctcactctgttgcccaggctggagtgcagtggcgtgacctcagctcactgtaacctccacctcctgggttcaagtgattctcatgcctcagcctcctgagtagctgggattacaggcacacatcaccatccctggcttatttttgtatttttggtagagacagggtttcaacatattggccaagctggtcttgaacctctgacctcaggtgacctgcctgcctcagcctcccaaagtactgggattacaggtgtgagccaccgcgcccggccgctattaggactttagaacgagagacagacttgatctaataatgattagtcagataaatttttaggacgtagggccgatatgccctgggattgtgcagaagtaggagatgggagagaagtcaaaggagggccaacatctcttcacagccagtgtgggtgatggcagatggttcatggtacaggaaacagaggggtgtggacatggtacccaggctggaggagagaggccagggctgcaggtgcgtcctggggggaagaggctggggaagcccccggaggaagccagagggagcagagccgtgacccccggggtgcacaggggctggggtcggggaggccgtgcagcggtgaggggacctcagagcactgcttcctcttccctgtttggggtttcagaggtcccttgtgcaggggctagggcagagccccatccttaggacacctaggccccaagtggggcttccacaagctgcttccggaggatggagatgtagcacccagtccagattatagcttgacccagggctctctccctaccttggctggggtttgggacggcagaatctgtgctctgggcttctgggtccccatcaaaatggaacaaagtgacctgcagccccagtcaggtaagactagcccattcttctcctgcacagttctggctaaagcctccacccccaagcaggtgatattccctccccagatatcccacacagctcggactctggggtccctttcagattagcacagtctgatgggagaagaaaacacccgaattgaaaatagaacgaacgcctgtaatcccagcactttgtgaggttgagcacaggagttcgagacaagcctgggcaagatggtaagtcccggtctttacaaaaaatataaaaattagctgggtgtggtggcacatgcctgtggtcccagcttcttgggaggctgaggtgggaggatcacttgaacccaggtggttgagtttgcagtgaggtgagattgcgccattgcactccagcctgggtgacagagcaagaccctgtctccaaaaaacaaaaaaaagcagaacaccacctctctctccttgctgcccatccacctgctcggatggccttggctccacctctgatctgtacctgtgcacgcctcatgaaacatgaatgccaggcctgcacaacctgcttctgttgagagaggtggccggctgagccgctgttcgtggcccgcttggccgcagcctccgtctctcccaccagtccggctgcaccacccacactgctgcccagcgtcttccccactctgggctttgcacctgcccttccctcagcctggaacagccctcctgcccgcctggtgattcccagcatccgggaagactcacctccagccccagctccaggccatcatgatatagccctcccctcctgcctgaggatcccacaggcccagaccccagccctgcctgcactttctctctatccttccccttccccttaaaaatatcccggggcctctggaagtggaaggggtgggatggaggaaagagagcaggaggcatcctggctgcccagccgagggctgattccccaggtcccatgccagtgccaaccagcctggctccagcacggtgagccccacatctgcagccccacctgtgtggcttgtgtgtgcccctgagtcctgagggctctgaatctgtcctggctagaactggagttaccacccgctgtggggcggggcgagtctcccgctgctctgagcaccaggctgcaccagggaacccacctcatggagcaaagctgcagaaacactgcctttctcgtgggcgttgttaccctaagtgggtcggcaactgcaaggtggacggtggggcgggcgccgagggccgctccctggctgtgggctgtgctcgcacgtcttggatgccctgtgggtacttcctttctgttgggatttgggctcaggtttatcgctggctgcttctgggaaccctgggggctaaaggaccctgcaagacggctgggttggaggaaaggggcttgcctggtcctgggagctgggcagatacgtgggtggtgagcaaaaattgggagggcttctcatctgggccccccgcccctgagggaccatcatggtacagaatcagggagcatcaaagggaaaacctaggatgagggactggagggggactggggacttggccaaggcctgggtgagggggtgccctgcccaggggtggggctgcaggaaggagcggccattccacctgagttggccgcccctgcctcatagcccccagacccagggtgctcagagctcccctcttctttcggagccttgcgggaggccctgctgctcaggggctggtggacaccaccaagagttgggttctgtagcccccactgccacaggctgggcgggctctggcccctcctcccttggggggtcctggtgccggggtggttttgaaaaccagagactggaggccttatcagaccacaggttttcctgaggaaggaagggtgggtgtgggcctccaggatgggcgcctcctctgggtgtgcccagcctggtggagggcacacatgcactgcccatccctcctgggggaccccagtccaaggccctgccccaccagagacaagcagactgcaaaggctggacccagtagcgtgtgggtccagggctcaggcccagggtggggtgtgaactccctgaaatcacagcagatgccagcatcctccgggatagtgtgcctggctcccccagccgaggctcagaggaatttgcagccagttcacgggcagttccactccgagggatatgtccagtgggaatctatacttgggcaccaaaaaacaagcaagaatgttccaaacgacccttttcataatagccccaacctggaaaacccaaatgcccatcagtgctgggtgtggcctgtcatccaggggacagtgactgtagccaggaggagccaccttcaacgccaggcaccacctggcttccaccatggcccctgcttcagacaacgggaagcagaggccagaagcacaggcagagctggtgcccagcacggattaggttcgggaacaggcaggaccagtgcaggtggatggggtccatgaatgatggcctctggggcattggccagcagtgccttaggggccacctgggtttggcaatgtcctgttttcttgatccaggtgctggtgacaagaggcattcagtctatgggaattcaggaagccacatacttaggatgagtatgtttttctgcatgtatgtgatacttctgtgatgcttttctgcctgtatgtgaaacttcaataaaaagtttcacacacaagccaggcgcggtggctcacgcctgtaatcccagcacttcgggaggccgaggtgggtggatcaccagggtcaggagaccaaaaccattctggctaacacggtgaaaccccgtctctaccaaaatataaaaaaattagccgggtgtggtggcgggcgcttgtagtcccagctactggggaggctgaggcaggagaatggcataaacccaggaggcggagcttgcagtgagacgagatcgcgccactgcactccagcctgggcaacagagcgagactccgtctcaaaaaaaaaaaaaaaagtttcacacacaggcctggcgcggtggctcacaccagtaatcccagcactttgggaggcagaggtgggcggatcacaaggtcaggagttcaagaccagcctgaccaacatggtgaaactctgtctctactaaaaatacaaaaattagccgggcgtggtggcgcacatctgtagtcccagctacttgggaggctgaggcaggagaattgcttgaacccagaaggtggaggttgcagtgagctgagattgtgccactgcactccagcctgggcgacagagtgagaggcgtctcaaaaaaaaaaaaaaaaaaaaagttacacacacaagcagaaaccctcccctgacccctccagagggaggagcattcattccctgaggcccctgccttcctcctgccctgtcccatctgggcccctaagatgaccttgctccctccagggaagtcgcagggcggactgggctgaaagccagggagagactgccgggtcatggccccaacccttcgtggagggaacgcagaggaggcggcaggagagagcagcccctgagggaggtgcgggtggggctgggctcagagcagggcagccaggctgacgccccggggcccgctctgcctttcttggaagagtctggaggagccatgtggggtgggggtgtcccacagccgtgcaggtggggctgcggatgtgggggctcaccctgctggagccgggccggcgggccggggagcactggctcgggacctggggaacccgccctccgctggacagccaggatgcctcctgctctcctccctccatcccaacccttcacttccagaggccccgggctatttttaacttggcttagcagccggagccgaaggtggacccagccctgcagggagtggggaggagggaggagctgcagctgccgtcccgcccccacccctcccagggttcaggctttctagttgggtgggttgggggtgctggtcattcttgaccttagaggagaaacatcattcattccactctgcaaatatagtcacactcagaggccacacagatactccaagattcagacacaagcctgagacacaaactcaaaaacacacctgggggtacacccaggctcactctgtcacacacacaccgagacacacacacacacacaaacactgacacacacagacacacacacgcagagacacacacagacactgacacacacacagagacacacagacactgacacacacagacacacacatagacactaacacagacacagagacacacacatgcagagacacacacacagacactgacacacacagacacacagacactgacacacacacatgcagagacacacagacacacactgacacacagagacacacacacagacgctgacacacacagacactaacacacatagacactgacacacacaagcagagacacacacacagacacacacactgacacagagacacacactgacatacacagagacacacacacactctgcctagggacagctgaggagtgtgtgagactcaaggaccctcaggacacaagggcagatgtgtgtggacgctgtgggcagacctcaccagatgcctggagactcaaacaccctgaaggcgagccccaccccttcatggacacacacaggcacagatgcccagagaccaccagctgtggggcttgtggggagggtcggaccctccggtcacacccggaggccgaggtgggggaagcttgggggtggagctgcccatgctgcctgctctgccccttcccccagcaccagcccaatgtccctgaatccccctgaagtggacggacaagctccaggggtctccacacccttcccaccaaagggcgggcttgtgaagggcgggcttgtggcctcccctttcccccatgctcgcccccacactctcagggcaggaagccccaggagaggatggctgcaggggaggcagcggagagctgacctcagaatgtgctcagcccggccccttcctttccctgctccccacttcccctctcctcccccagcctttgttccgtggagcaactgccccctgacccccgctgagggaattggagtcagtcctggaaaaaaaccccaggtgctggctggggccactgcctccggatccagcgagaggagggagctgggggctgggagaattggggctcaggtgccagggtgaggggcaggggctagcttccacctcacaccccacctccaccccaggaggcccagggcagctcctagaggaatgcggagggcaggggaggggacaggacatcctctcggcaggacacaggacgcccagtccggaggttcccagccccgggcaaggccacgggggaaagggtcactggggcctggggctcaccagttccaccctcagccagcagtgtccacagacagtccaggtcacctccagtgggggctggaggtgttggcggatgaggcctgtcatggccggagtggaatggccgcccccgcccccaggggccccacgtgtgtgggaggcaccggcaggcctgggtttgtcctcagctctgcaaatcttggggtcgccacctccaggagaggcctcaggctggccctggccctcccaggcccaggacaggaagcccagggacagtcgatggggtgacagccatggggaccccagctcctgggggctgagcagcagtagaacccgacctctgctcactgccctggaagatgagggaccctggaggggcctgaaggcactagaaggagaaagacctcctgcgctcacctcaccggttcagccaggacccaggagaccctgccggtctgggaggcctggagggttccacccctgctcccacatgatctcctggctgcaacttcttgcccaacacgccagctggctggtcatctgtgagcgcttctgccagagtctgtcccaatcacctgagcagcaaatgatgctaaatgtcatctaaaagcagcctttcaaacgaatgaccaaaggccgggcgcggcggctcacaccttaattcccgcacttcgggaggccgaagtgggtggatcacctgaggtcaggagttcgagaccagcctgcccaacatggtgaaacccccgtctcaactataaatacaaaaaaaaattagccggtgtggtgccgcgcacctgtaatcccagctactcaggaggctgaggcaggagaattgcttgaacccgggaggcggagcttgcagtgagccgagatcacaccactgcactccagcctgggtggcagagcaaggctccgtctcaaaaaaaaaaaaaaaaaaaaagaatgacctcaacacagaccttgagtgtcaatttgcctctgtttccctaggagttaaaattaccagaggggatcgtgggcacagtcaccatttgacccaggatttctgctccccgcatccaaacaacaggaatgcttgccccgaagtgaggtgctccagatgacacctctgccagggacgccgtctccttcctccgccacctctcccgttgtgttttttgaggttcgactcaaaatctttacatgtttttaaaaattgagttttgccgggcgcggtggctcacgcctgtcatcccagcactttgggaggccgaggcaggcggatcacaaggtcaggaggtcgagaccatcctggctaacatggtgaaaccccgtctctactaaaaatacaaaaaattagccgggcgtggtggtgggcgcctgtagtcccagctactagggaggctgaggcaggagaatggcgggaacccgggaggcagagcttgcggtgagtcgagatcgcgccactgcactccagcctgggcggcagagcgagactccgtctcaaaaataaaaataaaaataaaaataaataaaataaaaataaaaattgagttttattgaagcataattttacatacaacgatatttaccaattttaagcatcctacttgaagagcctggacaaagggaaagcaggaaaccacctccgctgccgccgggtcccctgccccgccaaccaaccacgcatctgccacctccgctgccgccgggtcccctgccccgccgaccgaccacgcatctgccacctccgctgccgccgggtcccctgccccgccgaccgaccacgcatctgctttctgtaaggatagtttggcctttgctaggatttcacgtaaaggaggccctaagcacgtggtcttttgtgtgtggcttctctcacttagcatcctgtttttgggattcaccccgtagcggcggccttgtcttcccaccgtagggatgagccactgttcgcttatccactcgccagctgatggatacttggttttctcagctttgcgaacgctgctgctacaaaggtttgaggcgagtcttcctgcggacgtgtttcatctcttctgggtaaatacctgggcgcgggatgctgagtcacgctacgtctcctttcctgaatctctttttttttttttctttgagacggagtctctctctgtcgcccaggctggagtgcagtggcgcgatctgggctcactgcaacctcctcctcccgggttcaagcaattctcctgcctcagcctcccgagtagctgggactacaggcgcccgccaccacgcccggctaattttttgtatttttagtagagatggggtttcaccgtgttagccaggatggtctcgatctcctgacctcgtgatccgcccgcctcggcctcccaaagtgctgggattacaggcgtgagccaccgcacccggcctgaatctctttatatgttttggtcaccccatgactgcatccctaagagcaaggaccttgcctgtgctgcttgctgcagtgaccagagctcaacacgactgctcgcctggaggatcttctgaacagacactcacccactgggtgaatgggtggatggcagcggtgccaggacagtgggtcctggtgatgccaatggggaggtgacgatgggctggaggcaccacagaagatgccaacggtgactgcggtaaatgaggtggcagcgaccgcggccgtcagcagtgatgcagccgtgggtggatggtcgtaatggggaagacctcacatagcctggagacgcctgcttcagccctccttgaaactgaactcacctggggagatgtcatgtggcccctccacttccccctacttcaggcacccatgctcactcacaccttggagccagctgtcaccaaaacccacgcactctgaaatgactacttgcagtttccccctctgtggtgcaactgcccccctccccggctgttacacctcaccaagcgcttcgctccaggacaaccctcctttctccaaaacaggcggccttcccctttctttggcttccttcttatccagttcagattttgtggtccactcttagtcactctctcgaaaatgtgggaagtcttcaaatgtccctccttttgtggcacccttctgagaacttcagccttgccagcacctaaaccactgcccattgtagggaaaatcaagccaggaagatgggggccacccaaaacccatgtctggacgttctgctgcacccggtcctggggagtccacacctggcaaacggagacgtctatccactcagtccccacccgctgcacgccgtggtctttcccaagcactccggacttagtctctggatggtttgtatgttaagctgttccctgctctccagccttcccaccagcatttaccacccattacctcgctgacatgcagacaggagctgagaaatgtttagctgagaaattttcaggagcttcttagaagtggcttcctttcagccgggcacggtggcgcacgcctgtaatcccagcactttgggaggctgaggtgggcggatcacgaggtcaagagattgagaccagcctggccaacatggtgaaaccccatctctactaaaaatacgaaaattaggccgggcacggtagctcacacctgtaatctcagaactttgggaggccgaggtgggcggatcacaaggtcaggagttcaagaccagcctgaccaacatgctgaaatcccgtctctactaaagatataaaaattagctgggtgtggtggcgtgtgcctgtaatcctagctactggggaggctgaggcaggagaatcatttgaaccctggaggtggaggttgtggtaagccgagatcgcgccactgcattccagcctgggtgacagggcgagactacatctcaaaaaaaaaaaaaaaaaaaatacaaaaattacccgggcgtggtggcacacgcctgtattcccagccactcaggaggctgaggcaggagaagcacttaaacgagggagacagaggttgcagtgagccgagatggcgcccctgcactccagcctggtgacagagcgagactccgtctcaaaaaaaaaaaaaaaaaaaaaaattggcttcctttccaactccttgcaccagtttgcaaagccctacccatctccccactccccatccctagcctcattcctcctggtccctaaggtcccagccactctggcctctgttcttattccttcagcactagggcctctcccagggtcagccccaactccacagcctaattcacagggtgaattcctacccatctctctggtctcagctcctgatccacctcccctccaggatggcagctgctggtgtttgcttcctgcaaaacccttcttggccgggcgcagtgactcatttctataatcccagcactttgggaggctgaggtgggcagatcacctgaggtcaggagttcgagactagcctgaccaacatggtaaaaccctgtctttactaaaaatacaaaaattaggctgggtgtggtggctcacacttgtaatcccagcactttgggaggccaaggtgggtggatcacctgacgtcaggagtttgagaccagcctgggcaaccatggccaacatggtgaaaccccgtctctaccaaaaatacaaaaattaggccaggcatattggctcatggctgtaatcccaacactttgggaggctgaggtgggagaatcacctgaggtcaggagttggtggcacgagtctgtaatctcagctactcgggaggctgaagcaggaggattgcttgaacccaggaggcagaggttgcagtgagcggagatcgcgccactgcactccagcctgggcaacagaacaaactctgtctcaaaataaataaataaataaaattaaaacataaaataggccaggctcagtggctcatgcctgtaatcccagcacttttggaggccgaggtgggtggatcacctgaggtcaggagtttgagaccatcctggccaacatggtgaaaccccgtgtctactaaacatacaaaaattacccgggcatggtgaggggcgcctgtagtcccagctacttgggaggctgaggcaggagaatggcttgaaaccgggaggcggagcttgcagtgagccgagatggcgccactgcacaccagtctgggcgacagagcgagattccgtctcaaataaataaataaataataaaaataaaataaaataaaacccctctttgggttaaatccctacttgctcacagcaaataccctgagggcaaggatgggaccggccagtgcttcgtccagcccagcaggcccgtgacatacgtccgccgaatgaatgattcccgttagggatggtaaagggggaaggtggggagatcaggtcatcaccagatgcagagaatgactgaggtagggagaactgccttcatcctgccctcctggtatccatggtgggagaccacccaggcccagaaggacatcagctggtggaaggggaagcccacctggaatgtgacaggctccagccgccttcaccctcctggtcccggcctccactcaggtgagccaccctcaccctcctgctccccgtctccactcaggtcatccaccctcaccctcctggtccctgtctccactcaggtcatccaacctcaccctcctggtcccggcctccactcaggtcagccaccctcaccctcctggtccctgtctccactcaggtcatccaccctcaccctcctggtccctgtctccactcaggtcatccaccctcaccctcctggtccctgtctccactcaggtcagccaccctcaccctccactcaggtcagcactgcctgggactttccagggggctgagcggctgaccaggagcctttgctggggcggcctgggcacccgggcacttcctgcaaggcctccctccttgcagccccagctcctggcctgctccttcctcctccgccccaggggctttccacaaagcctgaggcctgctatttttagctgagggagagggcccagttcctggccccactgccgccctgaaggagcctgggctaaactggggctggggttgggtctaggggttgggggagaggctgcagtccccagcccaggcacacctggagtgcagaggggacgctgcaggctgggctcccagcccagttggtggaccaggcgcttaccctggggaggtggggcttagggcctgggtgggctgccgcccacttcctgtggccgcaccccagtacttcaaaggctgctggccgccctgtggtcagtccaggctcccacgcagctggaggggctgggcgggcacacgcacccctggcagctggccccccctcccctcagggcagcttcaaagcagcaggggtgggcagcccccgtgattagcacggatcccagggctgggacgggagacacaaggcggtaatggaggccctggcagagcccctcctctgctcctatgctgcccgtcccactgccttcctgggttggctcagggcaaaggcccaggtaccttcctggcccccagatcctgtcttgaggcaggggccacctttaggggtacctgcgtctctgcttggtgcctgtgggtttcggtggcctggccacggagtcagtcccagtcagagaagcgacaggaaccgtggtgggggcacccctgcgggacccctcgggacagcctctctttcttactcctttcctctcttccttcctccccactttccaactggaaggggggcgggaggggaggggccataaaggagaaggggctccttgtccaggcctcgggctgtggtgggcttgacctggcgccagctccccagggacggcctgggcggaggtattgggggcggggacctagaagcagccgccccagagtccggcagacgctgagaacagagagtgcctggggggcggggggcagctttcagggtcccctggggtcagctctgggacagttgccgtttttaatctgcacaagtgatttagaaggagccgccagggctgcaacctagatccactcagacccagctcgggaagtgcggggaggcgcggcccaagaactgtgccctccccccagctgtggccacagggcagcggggaccctggatgaagcttccaccacccagctgtggccacagggcagtgggggccccggacgaagcttcctccccgagctgtggccgcagggcagtggggaccccggacgaagcttcctcctctcctgccagccagaacccgggttcatggtgaccttgcatgcccgaagtctgtccatcctgtcccggactggctctcctctcccctcccctcccctcctcctctactctcaggcatccagggaccgccgcccagcccagcttcagggccggaggctcccccagatctagggccttgaaggagccccggtccctgagctcacagcacagacgcccggaccctggcagatgccggctttcagcccacccacccggcagctgggagccacccaccccaggaaggaagggctgggggtgggctgcgcatccagctcgccggggtccccaccaaggaccttgacttggctgccagcgaccaccccacccctgctgacacaagctgggcgcgcctccctcggtctttgggcgcagggagggagggctgggtctccagtccttctgaccactccgctgcctgcttgcggcccgtccccaccacccaccacccgagctgcaggtgcggtggagacggggaggggagaaggtgcaggggcacacgggccgtcgccctgagggattttcgatggttccacgacttgggggagccaggaaaaaggggcaacttctgtggcctcccgtggacttgggacccctggtggagtcggaatcctcacgagagactcctgtggggaaacacatcctaggccctctgggctgggcccctggtccacctgggacgcaggctggagaggccaaatgcaggggccaggaagcaccaaactggctcttaggccaagagccaagggacccccaccctttccatgtgtcccccaatccaggcccagcgtcatcccccctcctcacccacacccggggctgactgtccgagatacaggctgtgttttccatctggtcaccacgcgcccccccaggtgagggtctccgaggggcaacgcgtgaaaagccggagcggatcgcctcacggggcggaatggctgctggtgccggcctggtcagaggccgggatcggtatttgctgaatatacaacacagagggaccaataaaaatacagagaaaagcacggagccgccggcgtggcagaagagcctgcggagaagctccctcaaagactggcaggcgacacaaccacaacctgtggaaaagcaactggggcaaagctcttggctttaagaatacccccttggggccgggcgcggtggctcacgcctgtaataccaacactttgggaggccaaggtgggcagatcacgaggtcaggagctcgagaccatcctggctaacacggtgaaaccccgtctgtactaacaatacaaaaaatcagccgggcgtggtggcgggcgcctgtagtcccagctacttgggaggctgaggcaggagaatggcgtgaacccgggaggcggagcttgcagtgagctgagaacatgccactgcactccagcctgggcgacagagcgagactccgtctcaaaaaaaaaaagaaaagaaaagaagaaaagaaaagcccctagaggccagggtccttgaacaaaagtgcgcgatgccctgtgtctgcagcggggagaggtctggagcccgtgtgtccgacagcagaagtggacacagtggtgccagggcaggaaccctgggggcatttgcaggcctgtgctgcgagactgcagtggcgctcaggacacacctcggagaagagcaagcctgctgcagagtgacatgaacaccaggtctgtttctgtacgagccagtgacagaagacccctagataagactctctgtacgtatatgtttgtaggcaaatggaaggtgagaaagacacggtcccgactagcaagtctggatgtctacgaggagtgtgggaagaacggttaatcgcttcacatccctgcgtcactgtgtatgatgagaatgttacatttcgaataacaaaaatgagcacttatatcaaaaactggttattgcagtgagagaaaggaccctgctctagggtcttccaagccggggtgagcctgggccttgaacatacccttcaaagtgtgtgtatggggcccaggggacgatctaccatttctgcactggagtctgcagaaatggtgcagactgccccagaagaattcagcctacatcacacaggccagcaggacttttttttttttttagtgcagcagtgcgatcatagctgactgcagccttgaactcctggcctgaagcaatcctcccgcttcagtcacccaagtggttggaactgtaggctcgacccaccaggcctggcccctgcagggctcttgaccccaacccagactttaccttgatgtggggagctgtccccactccctcccctgacaatgcagggcactgtgtcaaggattctggagagaccctggctcattcccacaggagacggggaacaggcctggggaggagccaaatgccagtgtcggggggccggaggctgcagtggcagtgcttgtaggcagggaggacagtgagccctccacatatacatagcatggcccccaggggtgtgtactgggatgggtgttggggggtactctggggagggctgctcactggtgtccttcatcccgggcaggagagaggcccagagcacaggccctgcagggagccaggacggagaaggctccagtgtacgccactcccccaccaaccccaccgtccttgagggctctgagcaattaattctctgtgactccagatgttcagcagctgtcttggccatttccgccccttctcctgaccctgcgtcctccaggaagcatcccctcctgtccttgggctccaagccacccccaccttccctgcaccccatttcctgagcagaggcgtttgtgcagactcagctcccgcacccaccagggtagcctcagttttcccaaggcctgggcactgctccctgagtccagggctgctggggtcggctcactccctgacggatgccctctgccaggggctctgatcctggttcctgcccctccggcctctgggactggttttctctctctcctctccttccttctccaaggttggctctgcaggctccactggcataaatcaagggcctccagggagggttcagtgcaggagggttggcaggactggccagggggagagccctgccccagtgcaggagggcccaatgcaggagggtgggaaccaaggggtggagggctcagagactggcaggccctgtgggggtgggtgcacgctcagatgtcggcgtggagggcaccggggtggaggtgggggttgcctccacaaacagatcagcagggacacagcccccacctccaccttgtggacacttccctgagctgatggcggtggaggcacaagaggtcatggctgctgcagctggtcgtctgggggctcttctggagaggggacagctcccttcctgtcacatgctttcctgtctcaacagagccgggggttctggggcacttggactcccgtgggctggtgggatcaggggctgggccagacacaggatgaggcatggaacccctgggggccagcggctccagcccgctgacctctgcccctcagaatccggtcccaggctctcccctcctcctctcaagaacttcctgctctgtgtgtgtgtgtgggtgggttgttgtgggggaagctaagggcaggtgggcctggctaaagaaaagcctgcatttccaaacaagtcccagagcagatcaagctgggagactgcccccaggaggacgaggctcctccaagcaggatctgctcaggggaatcaaaataaggtttagtgcgtccaacatcctgcgtggacagtcctccaggactcctgccgctgccaggatctgaactgaggtggcagggacacctcctgtcagaacttcggctctgctgctgggttcactcctgtggtctcacacaaaatgggccggtagcctttgggcccacagccccaacctgcctagagtaggcagccgctgagtttatgaaagaggctcctgggaaaggaatcatctcccaccctctgcagaagtttccatccccacccctatccaccaggctcctttccccacagggtcaggggtggacacttgagcaggaccagaaccaccaatccccaggggaagccttgcccatcccttggctgcaggggcagtaccctgtgtgtttcctcctggggcagggctcctgttgctgcccaggacccagtggaaaggatggtgtgacaggtgcaccagtggaccctgagacaccctctttgtcctcaggctttgaccaatgagcacagtagccaatcggagatcaaagctggataaccaggaaaatctggatctcaactgtgtgtgtgcctgggggtaggactgccagatttagcaaaacaaaaacaaatttaaaaacagggtatatctagaccgggtgcggtggctcctgcctgtaatcccagcactttgggaggccaaagcgggtgatccacctgaggtcaggagttagaggccagcctgaccaacgtggtgaaaccccatctctactaaaagtacaaaaagttagccgggcatggtggcgggcacctgtaatcccagctacttgggaggctgaggcaggagaattgcttgaacacccaggaggcagaggttgcagtgagctgagattgcaccattgcactccagcctgggcgacaagagtgagactccgtctcaaaaacaaacaaacaaacaaacagaaaaaacaggatatccagttaaatttgaatttcagataaacaattttaaaataatgtctcaagcagaagttggaacatacttatacccaaaaagtatttgtttatttgtaattccaatttaactggcatattattctgtattttatctggcaacctagaatgggggtaatagccccccaaatcgctccctttgttaattggtccctgtcttctgtcccccaacccctaaaggcagcagctgactcccccaactaggggcggggcctgttagggtcaggcagtgcctctaacccagacgctgagcaggagagcagagagggggtgcttcagcctgaaactaccccttccccagaaggctggggtcccaggcgggcctggcacctgggctcagaggctctggctggatttgccaaactccctgattgtagcatgtttgtttctggtctggggagctgttgagtacctggagctgccctcttccctggggctcctcctggcaggcggcttccgaccctgccctcaggtgggctggccctttccagggcaggagaaaagatacctctccagaaaagagggaggcgcagcctgggagtgggggctcgacccaggagcgagaaagaggaaccccagccaggcaggacccgccccagaaggtcactgctgttgctggcagccagtgaaaagaggatccagaaaaggagagggcttgtttctggtcagcaccgaagaaggaaggtgtggagaggaggggccgggccgagagcaaataccgcctttttggtgcagcagcagccctgtctctgaccccggccgtcctggggagatgaggtttaaaccagcagaccctgaagggaaacttgcaggacccacagcaagcctggtacaggcggaggaggccttgctgtccctttttggcccgtggggctgtccatcttaaatttaaggaagagggaggcggggtgcagggactcacacctgtaatcccaacactgtgggaggtggaggcggggtgcagggactcacacctgtaatcccaacactgtgggaggtggaggcgggaggatcgcttgagcccaggggttcaagaccagcctaggcagcatagtgagaccccatctcaatttaataaataaataaggaagaaagagggagacagtagctgctcaaatcatgggtgggaaagctgggcctgggagcgtttagctggtggggtcttggcgaaggcgggggacgggcagaaccttgggttcatcatctctgggaaccctttgtgcacccatcacctagcaacaggatgcagccttccctccgccctggaaggccaggtcacaaaggccatcagggcttgtccgggagccggtatcccctaagactgccctgtgcctctcgcggcgatcccggcccagcggctgggcgttagggccaccgctcatgtgcgtcatctgcttcgtgaaggcgctggtgcgcgtgttcaagatctacctgaccgccagctacacctacccattccgcggctggcccgtggccttccgctgggatgacgtgcgcgccgtgggccggagcagcagccaccgggcgctgacctgcgcggcagccgcggcgggcgtgtggttgctgcgggacgagacgctgggcggggatgcgctggggcggcctccacgtggggcgcgcagccaggcgcagtgcctcttgcagcagctccgcgagctgcccggccagctcgctagctacgcgctggcccactcgctgggccgctggctcgtgtaccccggctccgtgtccctgatgacgcgcgcgctgctgccgctgctgcagcagggccaagagcgcctcgtggagcgctaccacggccggcgcgccaagctggtggcctgtgacggcaacgagatcgacactatgttcatggaccgccgccagcacccgggcagccacgtgcacgggccgcgcctcgtcatctgctgcgaaggcaacgcgggcttctacgagatgggctgtctgtctgcaccgctcgaggccggctactccgtgctgggctggaaccaccccggcttcggcagcagcactggcgtgcccttccctcagcacgacgccaacgccatggacgtggtggtcgagtacgcactgcaccgcctgcacttcccgcccgcgcacctggtggtctacggctggtctgttggcggcttcacggccacctgggccaccatgacctacccggagctgggtgcactggtgctggacgccaccttcgacgaccttgtgccgctggcgctgaaggtcatgccccacagttggaaggggctggtggtgcgcaccgtgcgcgagcacttcaacctcaacgtggccgagcagctgtgctgctacccggggccggtgctgctgctccgacgcacgcaggatgacgtggtcagcacttcgggccgcctgcgccccctgtcacctggtgacgtggagggcaaccggggcaatgagctgctgctgcgcctgctggagcaccgctaccccgtcgtgatggcgcgagagggccgcgccgtcgtcacccgctggctgcgcgctggcagcttggcgcaggaggccgccttctatgcacgctaccgcgtggacgaggactggtgcctggcgctgctgcgctcctaccgtgcacgctgcgaagaggagctggagggcgaggaggccctggggccacacggacccgccttcccatggctggtgggccagggcctgagctcgcggcggcgccggcgcctcgcactgttcctggctcggaagcacctcaagaacgtggaggcgactcacttcagccctctggagcctgaggagtttcagttgccctggcggctgtaacctatatgccccagtgggggatcacgcacttgaactcctggccttcttggttcacctccccataccgccaaccattgcagggggccggcgccgacgcggggcggggcgggggggggcgcgcggggtgctcctgatctgctgtctgggggagggtaggcagaacacggggacttggtgctctccttccttcacaggggcgttctgaccgtcctcccattcttcctagctctgtcccctcctttctctcttcctcctacaaatacttttggctgcccccacccagctcctaagggaatgaaaggttaacctgacccggtttatggcaatactgtgtgatgggtgccttgatcaccacaaaaggatgatgggaacggggctgtggggtcccagggaggagcccttcacctggcctgggttacaggatggctcctgggaagacaatgccagctgtgcgctgaaagtctgtgcaagctgctcccgtgaaaaggaggacattggcatggcagggctgtgggcaggtcttagtggctggacattcccaggagttagcactggctatcattctgtagggctccctcccacctccaaactcctggcttctacaccagggcattcacagacagattgcagactcacatggtggcatgtgaggctacagatacacttgcacaggccagaggatactactgcgtgtcccctggagccaggcctgggctggactttgttcctggcttagggatgcaacacagaatgggacaaggcctctgctcacaatggtctgtaatgtcacatctctgtggtctgccctgaactgcctgaagcagggactattgtccctacatgtccctagtccccgggctggcctggttgggttgagcaagaatctctggaaagaatgaaaggcagcaaatggagaaaacattactgagagcacgagagcaggctaaggccgtggtggtaagggactcgggcctgtgcaagagtaccaggaagacacctgtgggaggaggtggccgggtgaaggaaggggcagtgggaggagcttccatgcctagggaccagtaccaccccaggctggaagcccagagtggagtcctaggacatcagatcctaaagggcttgaataccgtttaaggcttttcttccgggagcaagtaggagccaaagaagggaagttgcgggacttgttttcgtggggccagttgcctggtggttacgcgcctctcctctgaagtcaggcatcctgttccagagtatcctggttgcgcttcaacttgcggagtgacctggggcaagtgactttaacctcagcttcctcatctgtggagtggggagggcgcagcgctggtcgccctgaacaggaagtgagacaacctcggggtgcacacgcgcaggcccgagccgcagggtccacgcccgaggcgaggcggcagcggcgcctgcagggcgaggggacgaatcgcgatctttttcagagtaacccgcgtacaataaaaagtccccatgaaaaggacaaactagccaggcgtgaggggcggtggctcacgcctgtaatcccagcactttaggaggccgaggcgggtggatcacctaaggtcaggagttctagaccagcctggccaaggtggcgaaacccccgtctctactacaaatacgaaaattagccggacgtgttggcgcgcgcctgtaattccagctactcgggaggctgaggctggagaatcgcttgaacccggagggcagagattggagtgagctgagatcgcgccatggcactccagcctgggcaacaagagtgaaactccgtctcaaaaacaaacaaaaaaggaccaactaaaaaaagaatataaatacaataaataacaggacttacgggggcaggctgacccctaaagtaaggggtcgggctggaaaggatctcaaggggtcagagtttgagccgccgaggcgcgcgagccccagcactcctaggcagctgcatccgccccggaagatcccctggggccctgcgctggctttccacagcgccatgttggacggtcctcccacttcccaccttcccagtcctcccgctactctgaccgttctacctgtgattctcgctggtggagtcaacctggaatggattcccgccgaaccacgcctccctttcctggttcgcccgcagtttcggcctatcaggttgagtcgggtaaaccaggacgggccaagcggcactctcattggatatcactggtgggggcgggaagaaggcggagcacgtgcccgggcggaagtagccgtcgcatcgcggattacgaaacgccgcggagctgaggcagttccgctggctagtgtgtacgcggcgagcttctcccggcgccgcccgctcggctcccatagcgcccgcgacagcggtccggacgccgcccgaacatggactccgccggccaaggtacctgccgggcccggccccttcgccgcagatgggcccaggctgcccgttgttctccgtctcccggggtcgcgtctgcgactctctgtcctctcggtctcggttcacccaccccgcggcccctcttcagctcccggggccactgacctcgaagcttatgatggtcgtggtgtgttttttgcccgcggcccagaccgcttcctgggctctctccagccgccctcctggtctcccctgggaccgttccgaggtgtggttccctggcgcccgccgttgctcccgtagtttgggttctgtcgctcccagcaggtctcgcttatgccgcccaccccgtgccctgctcttgcttgctctgccaccccccggtccctgcgcggggccctcgggttcacgctgtctggccctggacccagtccgaggtgttgagggcggctcccgagcagagaaggggtcttcgcgttcagcagagctccccttgggcagcaactctgctcggagctcagcctgcttaggggttgcctcatggagagggggtggagtgagtcaggggcacacccagcataccaggcctgtttccagaacagtctccccagagcagtatgagatggccactgaggggcgtggagcgagcccaggagattaaaatcttgagaagatgataaaagtctgccttgcattttggggctctagagagggatgctaaatttctttctttctttctttctttctttatttttttgagacggagtcttgctctgacgccaggctggagtgcagtggcgcgatctcagctcattgcaacctcgacctcccgggttcaagcgattctgctgcctcagcctcctgagtagctgggactacaggcacgcgccaccaggcccagctaatttttgtatttttagtagaggcagggtttcaccatgttgcccaggatggtctcgatctcttgaccttgtgatccgcccgcctcagcctcccaaagtgctgggattacaggcgtgagccactgtgcccggctacatattaagctttataattcctaggtgctgcattattctggagggtgttttttgtttgtttgtttttgtttttttgagatggagtctcactctgtcgcccaggctggagcgcagtggctagatctcggctcactgcaagctccgcctcccgggttcactgccattctcctgcttcagcctcccaactagctgggactacaggcgcccgccatcatgcccggctaattttttgtatctttagtagagacggggtttcactgttagccatgacggtcttgataccctgacctcgtgatctgcttacctcggcctcccaaagtgctgggattacaggcgtgagccaccgcgcctggccttttttttttttttttttaattttttttttggggacagcgtctccctctgtctcccaggctggagtgcagtggtgcaatcatagcttactgcaatcttcaactcctgggctcaagcgatcttcctgcgtcagcctcccaggtagctgggactataagactacaggcgcaccatgccaggttaattggtctttctacttttttttttttttttgagacggattttcgctcttgttgcccacgctgcagtacaatggcgcgatcatggcttcccgcaacctctgccttctgggttcaagcgattctcctgcctcagcctcccgtgtagctggcattacaggcgtgcgccaccatgcccggctaattttgtatttttagtagagatggaggtttctccatgttggtcaagctggtctcgaacttctgacctcaggtgatctgcccgccttggcctccaaaagtgctgggattacaggtgtgagccattgtgcccagcctcatttgtctttttttaaatagaacagaaaggctgggctcggtggcttacgcctgtaattctaacacattgggaggccgaggccagtggatcacttgaggtcaggagtttgagaccagcctaaccaacgtgccaaaaccccgtctctactaaaaataaaaaaattaaccgggcatggtggtgtgctcctgtagtcccagctacttgggaggctgaggcaggagaatcgattgaacccaggaggtggaggttgcagtgagcggagatcgtgccactgcactccagcctgggtgacagagtaagactcgtctaaaaaaaaaaaaaagagaatcagtggataaaaaagtggatacgcttcgtttagtaagcgtttgtggagcgccaaggaagtgcacacggctccagtcctatgggacatttgaagggagtgagatgcagccagcttttaagaagagtatctttgttaagtgcatttaatctggtgtctttgtgttgtcttttaaaaggcatagtttttttttctttttcttttcttttgttttttttttttgagacagtctcaaaaaaaagagacggggtttcaccatattggccaggctggtcttgaactcctgacctcaggtgatccgcccgcctcagcctcccaaagtgctgggattaccggcatgagccaccccgcccgaccagtttttctttttttttttaaagaatttttttttggccgcgcgtggtggctcaacgcctgtaatctcccgggttcaagtgattctcctgcctcagcctcccaagtagctgggaactacaggcgcgtgccaccacgctaactaattttgtatttttagtagagacggggtttcaccattttggtcaagctggtctcgaactcctgacctcatgtgatccacctgcctcggcctccaaaagtgctgggattataggcatgagccactgcgcctggcagtaagcctgtttcttttcagaatgttttggtcaacagggaaagtgttacaatagtcatgtgcttggatttggagagaatcgaaatagactgtttttctttatgtgaaatcttgtagacttttagggtagtcaggaagatgcatttgacatgaagaaaaaacagtggctgcaggaatttgaatgtgatctgggtgtagttgaggtgtgtggtggcagcacaccgctctgcacctctctgcctgctggcggccttctggcagtgggatgagaatcgggaggtaagtaaagggaattttgttttgctgcctccctgaaggagctgaatgagcagcatgtgctcctagtacgtaattttagcatgtgctctgtcagatgtgttgagaggaaagtgatgcttattgtgtatattaaccatattaggttcctttttttaaaaaaagtggaaatttgtcagggtatggtggctcacacctgtaatcccaacactttgggaggccaaggcgggcggatcacccgaggtcgggaattggagaccagcctggccgacatgacgaaaccccgtctctactgaaaatacaaaaatagccagcgtggtggcgtgcgcctgtaatcccagctactcgaaggctgagacaggagaatcacttgaacccgggagacggaggttgcagtgagctgagatcgcaccattgcactccagcttgggaggcagagtgagactccatcaaaaaaaaaaggtggaaggtctgttagattgagctgctttctctgtagcaagggtttcctgcctctgacgatagtattctcactgggaagccagaattcgggtttgcctgccttgggccggcatttgtcgtgccctgaagcagcacaagtggcattggcttttcagctcaggtggtctgaggtgtggctgccctcgtctactgcccatgctgtcctcacagacctttcagagaagaggtgttagtctccagggtctcacccactcccacctgtgcttttgtcctgctagagacctctaccgtatttacttggaactaacttatttgacactttgtggcctcattttgtctctggcagatatcaacctgaattctcctaacaaaggtctgctgtctgactccatgacggatgttcctgtcgacacaggtgtggctgcccggactcctgctgttgagggtctgacagaggctgaggaggaggagctcagggctgagcttaccaaggtgctgtggcttggctgtctgtcctggggtgaattggagttaaggccctcttggattagtgagaggccagggtactggccacgctcgggaggaattgccctgggtggtcacctaccctgctctgtgttccgactgataacggggttctctttgtatgtgcccagctccatgcactggactcagagccacctggcagtggagacagggcatgactcccttcccatacctctgtgcctggcccttcctaagtgctccctgaggagtgttcacacatgaaccgcctctgagcagccatctgctgggagtgtctctgttggaattaacacttgataatcatttttaagaccccatgaatctttcttgtcctggatcttaagttttcttttaaacatatttattttggctggatgcagtggctcatgcctgtaattccagcgccttaggaggacagggtggtaaggtgggaagatcacttgagcccaggagtttgagagcagcctgggcaacacagtgagaccttgtctctacccccaaaaattagccaggtgtggtggcatgtgcctgtagtcccagctactcaggaggctgaggtgagaggattgcttgaggccaggaggtcaaggcttcagtgagctgtgattgcatcctgcacagcagcctgggtgacagggcgagaccctgtctcaaaaacaaaacaaaaacttcttttctaaaaagtatttatgtgatcttctttaagtgagagtcccttaagagtaatgtaggaattaagaacaaaagcctccaaccataatttttagtcaaaccaactgccaagagttttcttttcaccctgtgatgtggtttaattccagaatctgggtccaggcctaggtctgagtaaggttggttgtgccgctgagtctgaggaccaggtttcagatcctgaggacatcacacagctatttctagcctagaagattaaaggagagtagcaggaagtccaaggacactttgctttccatttaacttcagaatatgtgagtttagaaactaaatccacaaggtttttttcagagttgaattacaataaggtgaagtttttttttttttttttttttttttgagtcggagtctctgccgcccaggctggagtgcagtggcgcaatctcggctcactgcaacctccaacacccgggttcacgccattctcctgcctcagcctcctgagtagctgggactacaggcgcccaccaccacgcccggctaatttttttgtgtttttagtcgagatggggtttgttttttttttttggagacagagtctcgccctgtcgcccaggctggagtgcaatggtgtgatctcggctcgctgcaatctccgcctcccaggttcaagcgattctcctgcctcagcctcccgaatatctgggattacaggcgcgtgcctccctgcccatctaattttcgtatttttagtagagacagagtttcaccatgttggccaggctgatctcaaactcctgatcttgtgatccacccaccttggcctcccagagtgctgggattacaggtgtgagccactgtgcccggcccctacaaggtgaagttctgtattgcttttttttgttgtttttcttgagacagagtcttgctctgtcgcccaggctagagtgcagtggcgtgatctcagctcactggagcctctgcctccctggttcaagtgattttcatgcctcagcctcccaagtaggtgggattacagacgcctgccaccacacctggctaatttttgtatttttagtagagacagagtttcaccatgttggccaggctggtcccgaactccgagtctcaagagctccacctggctcagcctcccgaagtgctaggattacaaatgcgagccgctgtacccagccaagaaagagaatttttttttttttaaggacggagtctcactctgtcgcccaggctggagtgcagtggcgtgatctgggctcactgcagcctccacctcctgagttgaagtgattctcttgcctcagcctcccgagtagctgggattacaggcgcacagcaccatgcctggctaatttttgtatttttagtagagacggagtttcaccacgttggccaggttggtctcgaactccagacctcaggtaatctgcctgcctcagcctcccatagtgctgggattacacgcaagaaagagtttttttttttttttgagactttttgctcttgttgcccaggctggagtggaatggtgcgatcttggctcactgcagcctctgcctcccaggttcaagtgattctcctgtctcagcctcccgagtacctggggttacaggtgcatgccaccacgcctggctaatttttgtatttttggtagagacggcctttcatcatattggtcaggctggtctcggactcctgacctcaggtgatctgcccgcctcggcctcccaaagtgctgggattacaggcatgagctatcgtacccggccaagaaagagaatttttaaagagaagctagtcatatatgagctgaagatactgagaactcattctaaagtggtaaagctttgaatgatgcccctttcagaggtcatgttctttttttttttttttttttttaaagacctgagaaagttcaagtcttcatgatcaggaatctttctgttgctcagttctaactacgttaagcacaaaagataatttaccttttggttcgtgtaactgactcttgccaaggtttggaactgacctcaggaacacaagtgttttcttaagggtgtttttttctgtcacctgtgtcactgtccatctgcctcctcctctctgcatatggaattctatgagtgcagacggtgcccggctgccaacagttccagcttctattgtccaagcccagactgagagccctgagggaaaaggatcctcactgttttttgtttgtttgtttgtttttgaaacagtctcggtctgtcacctaggctggagtgcagtggcatgatctcggctcactgcaacctctgtctcctgggttcaaacagttttcctgcctcagcctcccgagtagctggggttacaggcgtgcaccaccatacctggctaatttttgtatttttagtagagacggggttttgtcatgttggccaggctggtctcaaactcctgacctcagataatctgcctgccttggcctcacaaagtgctgggattacaggcgtgagccactgtgcccggccagggtcttcaccatttttttgttgttgttgttttgttttgtttgagatggagtctcgctctgtcacccaggctggagtgcagtggcacaatcttggctcacccgcaagctctgcctcctggattcacaccattctcctgcctcagcctcccgagtagctgggactacaggtgcccgccaccgtgcctggctaattttttgtattttttagtagagacagggtttcgctgtgttaactgtgttagccaggatggtctcgatctcctgacctcgtgatccgcccgccttggcctcccagagtgctgggattacaggcatgcgccactgcgcccggccggtcttcacctttttaataccatgcccagtcctagtaaagagctcggacaaacctggcatggtcatcctgggccattcctcatgaccacaaatggacatggtgattggtagctctcccagaaccatttagttgtggggcatgggatagttccctggagtcaagttcctagtaccagataaaaacaaatgtctgctggctgggcgcggtggctcacgcctgtaatcccagcactttgggaggctgaggtgggaggatcacctgaggttgggagtttgagacgagcctgaccaacatggtgaaaccccatctctactaaaaatacaaaattagccgggcagggtggcacacgcctgtaatcccagctacttgggaggctgaggcaggagaatcacttgaatctgaaaggcagaggttgcggtgagccgaggtcgtgccattgcactccagcctgggcgacgagcgaaactccatctcaaaaaaaaaaaaaaaccaaaacccaaaaatcagatgtctgctgtagatgctgttattcctaggacgagttaatgctttggtaagcggaaagttcttgtgtaactcatggcactgtgcatgaggatgttagtcacttcctgcagtagtgatggctcatcatgtcaactgcatgctttgcaggtggaagaggaaattgtcactctgcgccaggtcctggcagccaaggagaggcactgtggagagctcaagaggaggctgggcctctccaccctgggggagctgaaacagaacctgtccaggagctggcatgacgtgcaggtctctagcgcgtaggtacctgccccaggcgcacccctgggggctgaagagaacgggcaccacacgtgccccggcatgtgggggggcgtcgtcatgcccagggacgagttgcagccgtggagttgagtggcctgtttggaaggatccagagagaggctctgagcccttggcccagcgactgtgccttgtttgttcaaaaagcttggtgtctacatgtgttttatttatttttaagtttttgtgtactttattattattttttttgagacagagtctcactctgtcgcccaggctggagtgtagtggcgtgatcttagctcgctgcaacctctgccccccgggttcaagcgattctcctgcctcagcctcccaagtagctgggattacaggcgcctcccaccgcgcccggctgatttttttttttgtgtgtgtgtgtgtgtgtgtgtgtgtgtttttagtagagatggggtttcaccatgttggccaggctggtcttgaactcctgaccttgtgatccacccacctcagcctcccaaagtgctggccaccacgctggccttttttttttttttattattattcttttttgagatggtttcgctctgtcacccaggctggagtgcagtggcgcaatcatgattcactgcaacctcaacctcctgggttcaagcaatcctcccaactcaacccccctcgtagctgggatgacaggcgtgcgccaccatgcctggctaattttttcacgttttatagagacagggtcttgctttgctacctaggctggtctcaaatttctgggctcaagcaatcctcttgttttggcctcctaaaatgcttgggattacacgtgtgagccaccacatccggcttatatacgtgttctaaaaaggcagacacactggctagttgtcctggtggaaaatgataggaagactgtttcagggtccagacttgagagagcactgatcaggtccttggcaagagcggtttttctgtggtccttgttgtgggtgtggcatggtcacagcctctgacccagatatggccatatgggccgggcatggtggctcatgcctacaatcccagcactttgggaggctgaggcgggtgtatcacttgaggttaggagttcaagactagcctgaccaacatggagaaaccctgtctctactaaaaaataaaaaaatttagctgggcgtggtggtgcgcacctgtgatctcggctactagggaggctgaggcaggagaatctctttaacccgggaggcggaggttgcagtgagccaaaattatgccactgccctccagcctgggtgacagagcaagactctgtctcaaaaaaaaaaaatatatatatatatatatttatatataggaccatatggtcccacaaccctagggactctgaccctccccgatgacgacgtggtcctacatgacgacgtggtcctataaccctgggacacctgtcccagatgtcgctcagctctgaatttggggagtgctgctttctcacttggccctgtccacgtggcttctctgaaacatacccttcaaggttggggtggctgtggaatgtttcccagaagacatgttcctatacaaagacagaacaggtcacatttcataaatctcacatatgagaggcccatgtttttgtcctaggacatcgtaagttttgaatcccaagggtgttttggagctgtgggctgtgcccttccagtcccccacagcagtgctgttgcccaagaatctcctagcgagagaccaggggctactgccaggtgacagaaaagggaacatcagttccgctatacccacagctcacctggcggcctggggcctgcacagggcctggttgaggcagtggaccccatttttgggccgtctgtggagttgatgttcctgccagctggtccctctctgtcttccctggaacttcacctgcagtttgatgcctgagttaaaattgttcttctaaataattcactgtagactttctgtttttagctatgtgaaaacttctgagaaacttggagagtggaatgagaaagtgacccagtcagacctgtgagtgcctgtatcatcagcacctcctccttcctcctctccgcctcctgacactcagtcggggaagggggctgtgcacacttggcacaaagcttgttttggtatttgctggctattttttcttcctataacttttcttctctcaggtaaactatcctttaaacttttgtggaacagggaatagtagctgagagaaactcactcagccacctgaccacacttaaaactcccctctgcctgatatgcgtcccttatgtaagaggcctgcactggtcctggctgtatctctaactaatagagctccttggcttccggcagtgcacaagctggacaacaccacttggcctgggtttgttggtggcgaatttttgtttgttctaaccctaacccttttccctgcttagctccagctgttgggttctcagaattcctttcctcctttaggggtagttcttgagtggagggcatggtgtaggatatgctggtggaaatttgaaatcctcacgatctgggaggcactgcattgtcagagcatcagccagtgtggatcaagtgtggatagttttgtatgtgtgtgtcagtggtgttgttcagagtgactcctaatatttggagatccttaaactagataatagcacttcatttacttgtgctctgatctgattataacgtctttaaactgaggaggggaatatttttaaatagtctctgtgggattttttcatctgttatttagaaggaagcgctgtaatcgttgccacagaacatgggcagaaagtcctcccatgttggtctgaaaggaagcagttgctgccgagcttgtcttgaaggtcctgggggaccaggctggcactgcgtgcacatggagcctttgcgtctggtgtcacggtgggaggctggtgtcaggaaccccgggcggttctcggcatgttgccccgggtattccagggacccgggtggttcgtgggcatggctacagcagccagctgtacatctgggtgctctggggacccgggcggttcacggcatgttgccctgggtattccagggacccgggcggtttgtgggcatggctacagcagccagctgtacatctgggtgctctggggacccgggtggttcatggcatgttgccctgggttttttttgtttgtttggttttttttttgagacaacgtctcgttctgtctcccaggctggagtgcagtggcgccatctgggctcactgcaagctccgcctcccgggttcacaccattctcctgcctcagcctccccagtagctgggactacaggcgcccgccaccacgcccggctaattttttctatttttagtagagacaggatttcaccatgtcagccaggatggtctcaatctcctgacctcgtgatccgcctgcctcagcctcccaaagtgctgggactacaggcgcccaccaccacgcccggctaattttttgtatttttagtagagacagggtttcatggtgttagccaggatggtttcgatctcctgacctcgtgatccgcccatctcggcctcccaaagtgctgggatgacaggcgtgacccactgcacccggcttgagcagggtgttctagggaccctggtgggctgtgtctcgggctgttgaacagtgactttgctgggcagcagatggttcctaggttgggacagtgacggtcatccttgcagtttgggcatcaggcggacgcacagtgcagactcagtctgaaaatagtcttaggagacttcagtgctgttttgtaaaaccaactgacataaagctgccgggatcctatttcaaataaatagtgttttagagagcttattacaacactcagcgtcccgacccctctggagaaacctgtggctcagcatggaagcatatggccagtgcatcacctggccgaggccattcccctgagttctgtggcgagagctgtcaactgacggttccagagtggaagcgtttctgccgggaaggcccaggccgagggcgatggtttctgccgggacggcccaggccgagggcgatggtttctggtgggaaggcccaggccgagggcgatggtttctgccgggacggccgaggccgagggcggtggtttctgccgggacggcccagacggaagggatgcggcttgggaggtggggcctgaggatgtggccatggcgcgtgctcttcctggctggtgcctctcctagtcagcttcaggagatgggctgtagatgtacctccactgcccagagctctgcaggggaaggcagtaaaagctccctgcatcctgacccacgtgtttgtagatcctttcagctattggcgccctggaggatggacgggaaggagaacgtggccggtgggtggaggatagcactggtgcctggccccatgaggctgcaatgcggccacattctcagtgggtcatgtctgaatgcgagagcagctgtgttctgcgagtggtgaaacaattgcctgttgcattctatttataggcagaggtaactaaaaacctcagtgctgagaggggcatcatatagatcctgcagttatgagctggttcacttggagttgttttggttgcaggtgacagaaagcacgactcaaggtagcatcaaccaaacagggaggtgggagcactcaccaggcagagaagtccctgcccccactgctgcagcccaacagtgtggccccatatgggtctccctggactaatggctgcggccttggaggtggtgtgctctggccaggcctggatcacttgtccatcctgagtgggagtgggggcagcccccagagacagactcaggagagggggagtgcaaggatgtcccccagatgccctgtgctgcccaggggacagctcactggcagtgggacgaaaccgctgtctgtccagggctctcttcctagaaggtcttaggaactcccaaatgggtgctggctggggttgcccggcccggtgctctcaaggagagctgaagctagttattgggtgcagatgctggctctgacccctgccccttcctcccgggctcagcttccccatctgtcatggagtaataacaacccagccttctggtccactgaggaatgtgtgtgcctgtgtgtttgacgctctcagaacaggcctgcagcgctgtgagccttggaagggggcctcacagctgctgccgccaccttggaggcccaggatgggactgagaaggggaagggagaggtcagagccacagctgttgggcagggacctgctgtaggaagagaaggccagggaggcgctggtggtggcctcaggctatgcaggtgatgcccattgtttccagggccatcccagtttggaggttcctgtttctagaggaggttcccttgtgaccccctcatttccacacccgagcaatgctgagggctgtggggcccccaggggcttgagtgtggtttatggcacagcagggactgatcacagtggcaccgggtgtcagtggccagtggtcagtggccaggaaccctcaggaccctcctccttgtgtgggtggcatttacccacccacaggtcacgctcaggacccgcatctcattccgatcctccttgtgtgggtggtacttacccacccacaggtcacgctcaggaccccacatctcattctgaaggccgggcacaggcggttgttttctctccaacttcggtttccccatccccactcttagggcacaaatgcaggtgtagcttccccatgcccactctttaggcacaaatgcaggtgtagcttccccatccccactcttagggcacaaatgcaggtgcagcttccccatccccactcttagggcacaaatgcaggtgcagcttccccatccccactctttaggcacaaatgcaggtgcagctttcccatccccactcttagggcacaaatgcaggtgcagctttcccatccccactcttagggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactctttaggcacaaatgcaggtgcagctttcccatccccactcttagggcacaaatgcaggtgcagcttccccatccccactctttaggcacaaatgcaggtgcagcttccccatccccactcttagggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgcagcttccccatccccactcttagggcacaaatgcaggtgcagcttccccatccccactctttaggcacaaatgcaggtgctgtgagcgctttagaatcctctgctgcaggtgactttgcttcagcgaaccacagaatgttcacatggttttatgcatttgttatttcagggaaaatcaaggttaaagatgtcttcagaatttgtatttttgggctgggcacggtggctcacacctgtaatcccaacacttttggaggctgaggcaggcggatcacgaggtcaggagatcgagaccatcctggctaacacggtgaaactccgtctgtaccaaaaatacaaaaaaattagccggatgtggtggcgggcgcctgtagtcccagctactcgggaggctgaggcaggagaatggcgtgcacccgtgaggcagagcttgcagtgagccgagatggtgctgctgcactccagcctgggctacagagcaagactctgtctcaaaaaaaaaaaaaaaagaatttgtgtttttgaaactaaatatagcaggtcattagttacttataactggtgttttattaataaaagaagaaaaaatttaaaaacagccatgattccagctgcacggagcctggatgggaaagtgcatcctctgggctgagcacggtggctcacacctgtcatccgagcgggctgggcgcagtggctcacacctgtcatcccagcactgcgggaggccgaggcgggtggatcacctgaggtcaggagttcaagaccagcctggccaacatggtgaaacgctatctgtactaaaaagacaaatttagcagggcgtggtggtgggtgcctgtaatcccagctacttgggacgctgaggcaggagaatctcttgaacccggaggcggaggttgtagtgagctgaaattgcaccactgccccccagcctgagtgacagagcgagactttgtctcaaaaaaaaaaaaaagaaagaaagtgcatcctctggtaggccttgggccgggggcgggcatgagagagctgcgctgggatgcgctgccagggcacacttggtgggtcacacactcttgtcaactgtttgggggctggagagtagtagcactcagctcacacgggccttctgcagggagtggtgggagggcctgtgagtaagggctccggaaggcccatcattgggacctggtgccgccagtgggagcaggaggagcctgtgccttctctggcgccagtcatcccagatgccactcagggcttggctgggtttgccagctctccaggttggcactggtaacgccaagatggtcctgggagcccatctccattcagcctcgagttccctggcttcactgagggaggagccgtgataaggtggctgtgggttcgcattttggactttgttatgtcagagtctgctgtgttttgtgtttatggtggcagctggatgagggccagcgacttcaggtgttgactgtcatggtgggcccaacagtatccctgcagccacagcatcctgcctgctgccctttgcctgtcctgcagacgccaaggccctagagctttgctttgatgggatgtacccatgtgggtggacactggagggagctggaggggatagaagcggggccttcactaggggccaggacagacccttgcactgtgaaaagaggcctgggaatggaactgtccgatgttctgaaggcacacggggccccgccgtctggagcaggggcaccttgcgggctgcatggccactctgtgacgctcgttccccacagacgtggttgagcttgcattttctcccctcagcacagtctcatttgggaagaggaaagggaaacttgcacgcatgggccggtcagggcactgagaggcctttctgctctggcactgcctgccaggcgtgcacctcagggggcccgtccgctctagcaggcaaatggggcgtgttctctgtagtcagaggggctgtgagaagacaggaaagcgagcttagtgggtatcaggcaagggggtgaaattgggttgtgagatgagaaagcagcgtcattgcagggctggggggccgagactcggcagggtcgccgagagctcagtgagcgagcaatgcacaggcggctcctcgccgcaggggcctctgggggccgaggggctctgggcctgcaccccctctgtagacacctggcgagtgtccaccccttggcccagctcctttcctcagttttcctcgggcgtgctcccagtgctttgtttgcttggctgtgggtggtgacccgcccatgctgtctggttgatttaactggtgtgtcttccagctacaagaagactcaggaaactctttcacaggcaggacagaagacttcagctgccctgtccacagtgggctctgccatcagcaggaagcttggagacatgaggtgagacgcaaccctgactctgctgccctgagacctggccaggagtgaggtgaggtgttggaggtgctacaggaagcctgcctggagatcagggctcagatgcactggctcagggatgtggccatccatcatggccccgaccagtctgtgtgcagacccttgcctgggaggttcgtccatccccgttggctgcttttctgccgttgctgtgttcttcagggagggttggctgccagtgctgttgggtaacttgtggtgctcggggttggtgagggaggagtctgcaccttgaagcttcactgagtggcagcgactccagcccaggggtcagagtcaggtcagtgtgggacggcagtcctccaccatctctaggacaggggctcggcgtggtacttcctcaggctgtttcccaggtctcagaaagtgcagtcagacgccaggaggccctgaatgagccttctctcccagaggctggtgaaagcctcctggccatcagaggtccctcagcaagcagggctggggccaaggagtgagcagggggccggcgctttgtggctggcatgtttgctcttccttccctgttctaggctccctgactacagcatggtgatgaggggattgagccagaagcctgggtatgatgcttggctgggctacctcctggctgggcaccccagctgggcctcaggcacgccttctttcacaggggttgtaggagtggatgatataggttgtcaccatcaacagcatcctggccccaacttctgggtgctgctgcccaccctgccctgacccctttcccattctcagaactggtcttctggcttttggatctcagggagtgcctccctgtagctctgacccaatcctggcaaagatgggtgcaggcttcctaaaggaccggtgtgtggagcacagtgctgaccccacccagccctcccctcttcccctcttgtggcccctgcaggattcagagatacgtacatctcctgctgggctgcctgcctgcctgcctgcctgcctccctgcctgcctgccttaggttaggtgtgtcctgcctccccgcctgtggttgccaggtgggggtcgtcctgcgccagtgctttcccctgaccactaagccacaggccaggacacagacggccacacacacccagggacccaccctgccaagcagaggggatggccactgcccaggagctgtgcccacttttatttttgtttttttgaggtaatctaccttcccatccctgcaacttctatttcgagaagttttaaacctctggagaagctgcagtcatcagtatgcaatgtgtgtgtttcctctgtgcaccctcacacgcccaaggctccacactccccagcagctgtgacttgggggggtccttgtggggcaccctacaaatgcaggtcttccctaccactgctgagctttggacccaggagggaccccctgagtttcagctgaactcagcctcgcagggctgttttcttcccgaaaatgctggtctcaccacagagcatcttcaggaagtaacaggtgtttgttgtgcctaaattatgccggccatcaggaggcgtttgcccactcttagtgtccacactcccttttgagtttgttcagaccattgtggtggaaatccaaggggcacgtggagcccttggcactgattggaatagccgtgcacaagccagtcctagggttttgatctgggcatttgtttgtatggcctgtttttctctggaagcacagggacacggtcctggttctctgtctgctcctccttctctgatggggagaaaggctttcgctctctgctcagtcctggggttggcagctgacccgtgtcgtgtagcctcagggcatggctggcagtgagcagagttcctgttgcagtgacgctggcacagctgtcagtgtgcccagccacactgtgccacgtgtttgcacgtgtgccctggtacatggggccagctgggggagcggggcctcaggctgacctgggacgagccagctcgctccagttggctggccgtgttcacggtgcccgtggagggtcctgtttgctggtgtgtcttgccctgcttgctcctccatttatgtttgtagtggtggtgggaactctgacgtctggagcccctggtgtatccccatcatctccccaagcagtcacaggtggtttctgaggtctgggcccattcacctcgagttagagactgaggttgagagctcactacttcctgaaagtgaaaattgggttctgggaggtttatgtcatgagtttagggctggatgaaccccggcggacccctgctaactcttgggcggaagcccctctggacagctgcccaacgcccgtgtccatgatgggcctgtcccagggcagccccggtctgtgaggcctttggtgtgccctggggcatgggtgatggggatgggaggaagggaactggattcaggtcagagtgggggtttacagcagggtcaggtcaccgtctgactccgtggtctcagatgaggcatcggccctctcaggacctcgggcgagttgagtgtttctcagttcttcagtggctccctccatgtcagagtgggcctggctgcagtgagtggcagcagctgcccttggacacacaggtttccaggttggcgtctgtgggcacggatggagcgcagagcagaaatgctcggcgccaagggtgtcccacatcctcccacggtgcgtgtgctccctcagctgacgtgatttggggaacacgggccgctctcgttctgtggagctggccaagcccagctgtcatgctgtggcacatttcacacctttgcgctgctggatggggctggttgtgctccaggtgctgtggcttctccaaacaggtgtgccttggggcataaggcgtggacagggcgtggacccaggggcctcttgggcacagccgtgaggctgagcagttgctagtcatgatcttgcgagagcctcctgttgagtcaggacttgaggagactggagacagtgctgctgtccccggtggtgtgcggactggaggagccgtcctggagggtcttcccctgctgggcctgactgagcacgagcagggggcctcccctggggctccccgaggagggctgtgagtgggtgctggcctcccttgcttacacttcgtttcctcttctctcctgctgccaccttccagggctcatccattttcacactcctttaggtaaggctgagcctggacacacctgtggaagacttttctctgaattggggcagggtggactccggcagggcccttgggcggctgtgctagtagagggcagtgaaagtgggatcaccccttccaggacagcagtgccagccaggtggttgctgcatctcagggaacaaagcagcagcgtgggatcgacgcagaggccccccggaaccccccggcccttctgtgtcccctcctcgtgcttcccttcaggctcacagaccgcctgctgccgggtctgtgaataactggcctggcgtccaggcctgagtttactcctgaaaaggagcttttttttttttttagacggagtcttgctctgtcgcccaggttggagtgccgtggcgcgatctcggctcactgcaagctccgcctcccgggttcacgccattctcctgcctcagcctctccgagtagctgggactacaggcgcccgccgccacgcccggctaattttttgtatttttagtagagacggggtttcaccgtggtctcgatctcccgacctcgtgatccgcccgcctcggcctcccaaagtgctgggattacaagcgtgagccaccgcgcccggccttttttttcttttttttgttggagtctcgctctatcaccaggctggagcacagtggtgtgatctcggctcactgcaacctccagctccctggttcaagcggttctcctgcctcaggctcctgagtagctgggattacaggcatgagccaccacgcctggctaatttttgtatttttagtagagacggggtttcaccatgttggccagcatggtctcgatctcctgacctcgtgatccacccgccttggcctcccaaagtgctgggattacaggcgtgagccactgcgccgggccctcaaaggagccttttcacgtgggagggctgtgccgactctcaccaccttcctgttcaacatctgtcctgtttccttgttttccttcagatggagttttgtcttgtttactacccgagagcccataggtgtgcctcccaaagggccctcctgcagaccagagcaagctcctctaggccaagccggggcgccgccagcacgtgcccttctgctggaaccgggaggtctagagccaggcccagaacaatctgtgatttcttgtgtttttacttgacttggtggtttctcttttgccaaaaggtccttacttgacttctgaaggctgtttgtaccaaatacttttcaaaagcccaagcctggtctcctcacagcttcctatggcagtgctctcccccctcccagtgctatgcgctgggcaacttggggtgccccccatgaggccaagggaggaccctggggtcgagtttccttcgggggcattgtgtggaggggcaggcagctcgctccaactgctgggagtgggggaatcccagctctgcccatccctgccaagttggggttgtgtgtggatcttggtgttaactcttgcttccttctctgcttctgccatgcttccaagcagcagctactccatccgccactcaataagtatgccagccatgaggtaatgtatgcctgctcgctgcggctccagagccgggtgtctctggtgggggttggggcagctcccgccggttacaccttgcccttcccatattcctggattaattgaggactccattcccttggcaacctctgatgactaagggccggtaaaaaccccctctaggctgacgaggaagagctggtagggggtcaggctcttcacctgcagcctccagaggagatccttgtgtcaaactgggccgtgtcctttccaagtcctgaccctggctgcctgcagtgggtggggtggggttcgaggggctcgcacacagatcctggcacttgccctggtgggctgtcactcaggacacttcacggtctcagccttcacggaaacacccagagctgtggtccttattctgtgcctgtcaggcaccaccctgattctcaggattctgtgcctgtgccgtgaggcactgccctgattctcaggagagcccagaactgtggtccctattctgtgcctgcgccgtcaggcaccgccctgattctcaggagagccctgttctccttgtggggactctggctgggtgtcgcagacgtgctggcctctagagtccccgggcctgggaggggtatctgtttgtgtgggagggactgagtgggatggagctggcctgctttctcctcttgtctccttatcactctgctgtcccagaagtgtccttggtcttccgtttgcttctctgagagatgtgcatgaagaactgcacagacttttcataacttcagtacgagagcccagggtgtccctgtaggggacagcagagaggggccgacagccccccaactgcgcagacttttcataacctcagtacgagagcccagggtgtccctgtaggggatagcagagaggggccgacagccccccaactgcacagacttttcataacctcaatacgagagcccggggtatccctgtaggggacagcagagaggggccgacagccccccaactgcgcagacttttcataacctcagtacgagagcccagggtgtccctgtaggggatagcagagaggggccgacagccccccaactgcacagacttttcataacctcagtacgagagcccggggtatccctgtaggggacagcagagaggggccgacagccccccaactgcgcagacttttcataacctcagtacgagagcccggggtgtccctgtaggggacagcagagaggggccgacagccccccaactgcacagacttttcataacctcagtacgagagcccgggatgtccctgtagggtatgacagagaggggccgacatctccccagctgcacagtcaaggggtttccagttgccttgtgtgacgtctggacctgtccctgtggttgttgggcatggccgacctcacttttgacctggggagtctccggaatgacctggctgtctcacagttttgccatgagatcttgggatgttgttagggaccctttggaggctggccctaaccctgaggcccttccgagttaggagagcagcacaaccctctcctcttgacaccgacactcttccctctctctttaaaggaactctgcgaccttcaagtcgtttgaggaccgagttgggaccataaaggtaattgtacctggactgtttgatggtcttggcaaggtgtgacctgttacagcaacttgtttattattagtcatttagttatggtagactcacatacagttgtgggaagtaatgcagagaggttccttgtgccttttacacagttctctcctgtgacgacatcttggaaaatcctgtagtgcagcctccccaccaggacattggcactgactcaggacacagaacgcctccacactgcccttcctggtccccactgcccttcctggtccccactgcccttcctggtaccttcttggccatgctgaccttcctcccgccctacccccggcaacccctagtccactctccctttgtataattgtgtcatttcaagaatgtcacgtaaatggaacgatacagtgtgcagctttttggcattcactgtcttcatttggcatcgttctctggagacctgttggggctggtgcccgtccgtgatttgctccctgtccctgctgagcagtgttcgtgttacataagcttttgtagagcattgagcatgggcctgggatctgccttgtgttgtgtgctctgtctcaggtttttctgtcttcatcttttctctcctgtagtctaaggttgtgggtgacagagagaacggcagtgacaacctcccttcctcagcggggagtggtgacaagcccctgtcggatcccgcacctttctaagcctgtggttgcttcacccgctgcagagcacacgcaacccagcctcagcatcacagccgcagctctgttcagcggagcagccagccagggcggatgagcagagccggccctgaggacagtcctgcccatccacgcggagatgtggctgccgcgtttgcatgaatttgaagaacacaggcttgtacacagatgttttacactcacgtttgtagatgaaacagatcactgtgctgtccttcctaggggtgcaggaagtggacagggcggagggtttgaaagaatattgagccaaagcccaggctccctttgggaatcatgttagcccatcagaatgttgaaggattgaagagttctaagcataaaataagtggcattttctgacttcttcctcctcctccttccctgactcacagaaggaatgcaatcacccagcaagtcctacctgttacgcaattttttatctcaaaatgccgaacgagaaaactgtccattttctgagacccccagaaaggaaactgaccctcagcagctgcctgattgttacgcgaatctagctttaacggaagcaaattcattattttttaaatgcagtggacttttcaaaaagtttaaattaggcaaagcagctttagcctcatagaatattatttctttggactcaagctgaaatacaagccttacattgccttatgctttatttctttctaatttttatatgtatatagatgagggttccttaatggttgtgagcattgtgtggaattttacacctggcctgcgtggcagcctcttccagttgaggtgttttatgtcacgcacactccatcccagtgtacaaaacctgcttctcttctcaaccgtggcagctcccgctggctcctatgccctgccctaaagggctcttgagcctctgggaatgggaggggccaagagaaggaaaaccctgtctttagcaccctttaaaagaactgtgccccccttctcagtgctgcctttgcatgggcctggcccggctcacattcgtcagtgactccaaccctcctgcttgctgtacttgggatgaaacgaccccacaggtcaggtggagggtggggcgtgggcatcagccaggattgccgttacagtctttttctcaggagctacaaagatctcttcctgttactaaatagtcgcaccccagcagcctctctcgcacaccggggccctgcatgtcagatggcgtggtctgcagggggagctctgtgccttagtggctcttggcaggacactgagggcctgcctgtggtgtgcccggctctgccactcccgggaggggaagggctgctcagctcaaggtgtcctgttcggtagagcaagtgtcctctgacagccgtgtccccggacagttcagacacccttggggatggcactccacacacgacagagatgcaggggccagggaagcccagcgctcggtgcccttcgtccagggttaaaatcggcctgtggggtgtggtgagaaggcaggttgtgcgggtgttgaccgatgtatcttttccttaaagttattataataatgggtaatttgtcaataaagcattcctttgggggaaagtccgcctcggcttgtgtgatgtatcgttcgggaccatgataagagtggtaaatgaactggcacacggtacctgccctaatgagtccgcacccttgggagaggcaggcaggggacagtgctaaagacaaagggcaggtcctcaatgctgggacaaggggagccagctgtgaggggagaatggtatatggccaacctgtgaggtcagacccagcgtcttgggaagaggagttgaaactgagccccaggaggcggaggaggagctcaccaggctccaggttgggccgggagctccagaggcttcgccagctgcccctgcaagcactgagctgctgctgagcacacctgtagtccccgccattctggagggtgaggcagatcacctgagcccaggagttcaggaccagcctgggcagcataccgggattccatctcaactaaaaacagtaggctgggtgtggtggctcatgtctgtaagctcaggactttggaaggccaagatgggaggatcacttgagcctgggagtttgacaccagcttgagcatcgtagccaggccctgactctacaaaaaagtgaaataattagccgagtgtggtggttcacacctgtaatcccagctgctcaggaggctgaggtaggagaatcatttgaacccgggaggtggaggttgcagttagccgagatcacgccattgcactccggcctgggcgataaagcgagactctgtctcaaaaaaaaaaaaaaaaaagaaaaagaaaaaggaaaagacccttgagggggaacctccactctgcccctggtctggcgctttgcatgtatccattcctagtctttggagttcccactggaaaactagtgggagcaccagtcttcctttggaggtcagaggtagctgggctcaccccagatgtaagagcagggaaagttaggtgacctcgaattgtatggtacataagccccaatacagcagggagctggtaccaataaagggtgaaatgcactattgccgcctgcagtcaagatttacactaatttattttggaatgagttcatgtgttcttcatttattgaacagatactgtaactgccctgcgggtaagagtctgctaggttttgtggggtacaagggtgaatctgatgtggacccagtgctcaaggactttgcaacccgtttgttggggaagacagattcccctaagtcactggcttgtgtttgacgaggtgaagcgcttggagagcttcgaggatggagcaagtggagtaagtggacctgaggagcgggcagcaatgcctgaaggctcagtcccctcttctcagagtgagggtaatggtatctgcctcatcatattgaaaggcttaaccttataaagcacttagcacagggcctgatgtatcagaggtaaacatcagactcttcccaactgtagccactgtcaactttcctgtcttcttttttttttttgagacagggtctcactctgtcgctcaggctggagtgcagtggtgcaatctcagctcactgcaacctccacctcctgggctcaagcgatgctcctgcctcagcctcgcgagcagatgggatttacaggggcatgccaccacgcccagctaatttttgtatttttagtagagacagggttttgccatgttggccaggctggtcttgaacgcctgacctcaggtgatccgcccaccccggcctcccaaagtgctgggattacaggtgtgagccactgtgcccgggcgtaccttcctgtcttattttctccaagcaggctggaatgttcatggatagatatatgtgtgataatatactttttacatatcatgcatcgtgctcattttagtttcaggagttctttgctcctgtgtagcctttctacacattatctttctttttttcttctttttaaataagagatggggtcttgctctgtcacccaggcaggaatgcagtggcacaatcatggctcactacagccttgacttcccacccgatccagcctcctgagtagctgggactacaggggcatgcatgccactgtggccgggccaattaaaaaaatttttttttatagagatggtggtctcactatgttgtccaggcaggtctcaaactcctgggctccagtgatcttcctgccttggtctaccaaagtgctgagattccaggcgtgagccatgggtcccgttgtatacatttcagtaactatattattccatttgagtgctcacttgtgcagttgggcaggtttccattctcgctattaaaaatagtgccttcatgaatatttcagtgcatatacctttttctgtatttaggaatattttctttggaagaatgtccctaaagtggaactgctaggtctcagagggactcacttaaggctggttcattcattcttgcagctcccagcacaagtggaatatagcttcaatctgagatcggtaccaggcccatttcattctctcatccctccaattctggcctgaaatatttcattctcttggaatctatagttgtagatatgaacctggcctttctgcttcttgggttccataggccttttcttgctgcctgcttgatgttgcgcagcttaatgactgctaggaggcttcccaagctctgacacttccaggctgtgagactggaacaagcttggcaattcaagaccggcattatggcagtgagttatgagggcagaggaaggaggccagagcgtgttgagagagaatttgggtttcacgcagtgtgtcacgggaagccttggatgctactgggtttgttttaaaaagatgaccgcactgaactcaggtaaacgggcaagggtggaagcgaggaggcaggagcaccggccgcagaggtctgggagcttctaggatgggaagtggcccaggcagcctacgcggggcaggccgtcagtgagtggcggagcgcctgcagttacagggacagggaagggtggccgacgggatgggcaagggcagagggaggtggagtggacgttcgtggtcctgcctctccacgctgctgtttggagatgattccgggagggtgggagggcgctggcgacggcatttcagtggttggacaggaaggaaggaaggacgtcccatctcggcgctccagggttgagcaaatgtcagtcccaggacggtggctccgggtgggggcgggggcgacggtccgcagccgtctcccaccagctccctgttcagttctttgatgagaacgattacgttttctcagtcttacttaaagcgctgagtaaactcacctgcaagaccagcaagccctgcgcttctctttctgcgcggttccccgcagcacatggcgtgtccacccgggacccacctgcggccacctgaagactgggaggactggctccgcccccgcgcttcgtccccgcccactcatgggcggagcctccacagggcgcctcggccccgggctgtcactcgggactccgccccttcatggacggagcctccgctcggctctctgagcgcatgcgcagccggtcccacccgcggctccgacacgccggagcccacgtccttccgggagcgcgcgcgccggtgcgggtgcgtgcgtgagcgtgctcgtctccgctgccgctgccgctgccgctgccggtgccgcacccgcgccctctgccgccgccgccgccgccgcccggggtctccaggctgaggagtgcgtcggccgctgcccagcagcgccgcgaatcggggagcggagccgcggagccggcgggagggcgggcgggcgggcggacgggcaggtgagctcgctgcgggtcgggcgggcggatcggcccacgtcaggcccgggcaggcgggcgggcgggcgcgggtggggggcgggggcggcactccagagccggaaatggcggcgacccccgggccggggctgcgcgggcgctcggggccggagctgctgcgacgccgcggcctgggccggggcgggggcgcgggaaggtcggcgccggggcctgcgggagccgggccgggccgggccgggggtctgagcaccgtggtgggggctggggcggcgctctccgcgggtctcttcgggcccggacgccccctccgctcccccaggtccccgcggccgcccccaaccccccggggtctcctctcctgcggggggactggagaagctgggccatcgctggtcttagggaggcagataatttagtccctgggtcgttgtgtttatagctcggggaattgaaaattgttctgtaacgcatcgtaaattaatctttccgacgttgtaaattccaaaaagcatttggtttgttagaaaaaacctgttttctccgctttataaaaacatttgaagccatgctttatattgaactcttaaggagagtattaggaactcgtccgttcaggttctaacttgttggtgttaagtgtctggattaaagactctctttttcgtgtgccgaagccatgatttctcaaattcattcagttgtgtcatacaggaaaaggaagcaaaaatttcagctttatttttgttttccggcttaggcttggttgggaagatttgatggtggttagacacgtctgcccttatttgcctgtttagaaaaacctattctaatgacaaaaacagttacattgctcccactattgtcatggttacctgaaggcaaaagtttactcaaagcttctgagattttatgttcgtttatttgcttctctttttaaaaaaatgtcagctgagtttcaggaatgagtagtctgtcaaacaagagatgaaattagaagcctggatctaagggctttggggaagtttcggttgagttcccctttcacttgtgtcggtgctgtaggactcggggtggctccagctggcgtctggcccagcagagagctgtaggggcccgctctggttgctggctgtgtggactctgagggacacccctggcgagggtgttaatgagcctgcagcgtctgagtccacccaccctcagactggcccctgactcactctgcacctgccatatcagcctccttgctagttctgaacagagccacatgctctgtccttggatcttcctggaatgcctggttccttaaccccctagcctggcgactgcctgcctgccttgccacccagttcccttcctcgcttaattttcccacagcgctgaatcctcctagtgtcctgcttaatgcatttatcatacttaatattttactgtgagttagtaaggtccgtggagagaatgttttgtgaaaaaaacagttgctggcacatgatcggggcccagtaaatatttgttcagtgaatgaacgtgaggagcttagcagcagctgtgcgtggtgctggccttgtcacccggaagtccttgtcggtgaggactgagcatgtagaggtaagggttcctggagtgttggccctcaggacagagagccaccatctctcacctgcccaatgaggaaagacagccaggtaaggggtggcttggaagggtgcatgggacccttgtaaatcttttcgcaactttgaatctataattattttgaagttaaaacgtttctaaaaagtcagatctgttgggggcacagtggctcatgcctgtaatctcagcactttaggaggctgaggcggacggatcacttggagtcaggagttcgagactagcctggccaacatggtgaaaccccatctctactaaaaatacaaaattagctgggtgtggtggcgtgtgcctgtaatcccagctactagggaggctgaggcaggagaatcacttgaacccaggaggcggaggttgcagtgagccgagatcgcgccactgcactccagcctgggcaaaaagagcaaaactccatcttataaaaaaaataaaaataaaaattagctggttgtggtggtgggcgtccgtaatcccagctactcaggaggctgaggcaggagaatcccttgaacctgggaggtggaggttgcagtgagcaaaggtcacgccacactgcactccagcctgggtggtagagcaagactcagtctcaaataaataaaaataaataaaaagtcagatctgccagtggtaataatgcttttagaaattttgtctttgattaccaggaaaaaccctacatgctagtccttatactccgtcgtgacatttggtaattaagtagagtgaggtggaatgatctccctggctcttaattcaggaggactgcctgagagtgactgtggctgatccccttagcatgaggcccttcagctgtggtgctgtgacagagccacagaggctgcttggtgacttgcagactctggagtcctttccacagcctccacctcatgcctacattaactcagagtgagtgggcttcagggccttcctgcatccctgaagatggttgtattaacgtggttcagagattgaacagacgctgcacgtttctcaggcatttttcctcagttccccttgcttggagggtggataccactgagcctggttgtacagctgcctccgtgaccagcacctttgcccaaggtctccctgttaacaatcgtcagagctggaacttgaactcgagtcttctctagaccaggtttcttctaagtatttggcatcaccaggaagagccctgtacaaggtgctggtggttttatccttagagcccagatgtgaggtgctcacgtgtgtgcctggggttagcagttggtgtttgttgaatgaatgactaaaatgcagtggggcggggagtcatgataaggtagaattttatctgaggtggagtttgcttctgaaatcaggcagtaaggtgaatgtgatacccagttaggagtatgtaatgctgcaggtaaactgtaacagcaaatgaaagcagtatttctccaggaaggaaacagacccctgggtcctcgggctgggttggaaaaagccatttgtagagaaatggaacatggtggctagccctgcacaagacatagagaagagacccttaacactccagttatctccaagtgggcagttagaatgagtgcttctaggccgggcacggtggctcacaccagtaatcccagcactttgggaggccgaggcgggcagatcttgagatcgagagatcgagaccatcctggccaacatggtgaaaccctgtctctactaaaaatacaaaaatagctgggtgtggtggcgggcacctgtaattccagctactagggaggctgaggcaggagaattgcttgaacccgggaggcagaggttgcagtgagctgagatagcaccactgcactccagcctgggcgacagagcgagactccctctcacaacaaacaaacaaacaaactgcagtgcttctaaggtgagactcatcgtgatgttctgattagaacgttctcgtgccacaaagtcctgagatgtgtccaagaagcaccgtcttctgtcagacacacctcctgccccgccataggccttcccactgtggcagcagaatctgtgctaggccttccttcgtgaaagaggacaagatcagggctcacgtgactggggccgctgtgactctgagcctctgcgttctgtcagatgagggtagtggtgcttcccctgcgtcctgctgggagaaaaaaggaggcagtaaatgaaaggtgtctcatcacctgcttcctaaatagaagggacaaagaggctgaaaaacagtaatagtcttgttttatgaaaatgccacccctaatctaggagctgggactgccatgccaggacccctcagataatgacatccctgaagaggattagcagctagtctgttatcagtcacaggcagttcaacccagaagatttaaggattagattacccaacaaccttgagtgtagattttgtctctcatcaccctttgcattaactttgggtgcatgtgtgttaatgaggaagtgtgttctgctttattcttggtacatcacagacatttaatagatacaggtcattagaaataaaaattgttttaacttgtatgagttttgcaagcattgatatttcaaattgaaattgcagaaattaggacagcatttcattttcttttgtttttttgagacggagtctcattctctcacccaggctggagtgcggtggcgtgaccttggctcactgcaacctctgcctcctgggttcaagtgattcttctgcctcagcctcccgagtagctgggactacaggcggtcgccaccacgccaggctaattttttgtatttttagtagagacagggtttcgcggtgttagccaggatggtctcgatctcctgaccttgtgatccgcccatcttggcctcccaaagtgctgggattgcaggtgtgagccactgcgcctgggcttttttttttttttttttttggttgggggacggagtctcactctgtcacccaggcttgagtacaacggtacggtttccgctcatggcaacctctgcctcctaggttcaagtgattctcctgcctcagcctcctgggttgctgggattacaggcgcctgccatgacacccggctaatttttgtatttttagtagagatggggttttgccatgttggccaggctggtcttgaactcctgacctcaggtgatccacccactttggcctcccaaagtgctgggattataggcgtgagccactgagcccagccccaagttggtcttgagctcctggactcaagtgatcgtccaaccagcatctcattttctaaagaaagaagtacttagaccaggtttgggacatgtctctgaaaattctgggctggtgcagtggctcatgcctgtaatcccagcactttgagaggccgaggcaggcggattgctagagtccagaagtgaagaccaggctgggcaacatagcaaaaccccatctgtactaaaactagaaacaattagccgggtatggtgacatgcagctgtagtcccagctactcggaggctgaggtggtaggatcacctgagcctgggaggctgaggctgcagcaagccatgattgctccactgcactccagcctgggcgacagagcaagacactgtctcaaaaaaaaaaaaaaaaaaaaaaaggaagttctgtattgatcaataatttcctcctcaggacagacctgcatatgccacaatttaactttgttgcaacatcattctacattttgcatgaatggtttcaaaaaacttatttctatgacagagaactttgtcatttattcttgacatattaaacctgagtgacatttttaaatttttgtgttgtgttgtgagtgcttagtgaagattccttgaatatggatgtgaatgaatcttatttttcatgggtttataattgtattgtccctttaaatattctacattgaacatgtatcaccagcagaaataatcatttacgaggtgaagtgtccagagccatgtagtgtctgcattgctgtgtccagggattctttgtttgtttgagacggagtctcgctctgtcatccaggctggagtgcagtggcacgatcgtgtctcactgccgcttccacctcccgggttcaagtgattcttctgcctcagcctcttgagtaactggaattacaggcgtgtgccaccacgcccagctaatttttgtatttttagtagagatggggtttcaccatgttgtccaggctggtctcaaactcctgaactcaagtaatcaacccaccttggcctcccaaggtgctgggtttacaggcatgagccactgtgctcaatctgcgttctgaggcattctgtgcctgttatgaaatcatgatgctggcaggtcggaagatggaatcgacttcccagccccatcggctgtgccctgccctccttgctgtctctagagcgcggctgacttcggggagagctctccctgccctgtgcctctattttttcaccaggtagggtggaaatgtgttctagtgaaactgcagaacgaaaatatcccgtcttactcttgacccttgaagaagcaggagctgaattcaggtgccagaggctgcgtccgcgcgctccacatcagtctcagagtggaggcgagcccaggccagaggcctctaccccggacgaggctgcaggtgcctgacgggaggagtgactgcagctcagcagagggagtgtgtggagtgtgcggccctgcctggcttttattttgctcctcctgttattgggagggattagcagcagagcgaatgtttggatctttgctgagcagtcccatcggatttttctttattaaataggattgtgttttattgtaagaaggtttccctaagacaaataacgaaggaaattctgggtccaggagtacagactgtagcttctgtcatctcttgccaagttcgtagccctcagatggtgtctgtctttcccctttgcttgcggggccttttaccacagcactttggtgttcttttagctgctgcgataggactagctgttaaaatctgagattttacatttttgccagtcgcaataaattttgttagttctttcttgatgtgttctttaaaataataatgctttttttttttgggtgggggacagagtcttgtgctgtcgcccaggctggagtgcagtgacgcgatctcggctcactgcaagctccgcctcccgggttcacgccattcccctgcctcagcctcccgagtagctgggactacaggcgcccgccaccacgcccggctaatttttcgtatttttagtagagatggggtttcaccgtgttagccaggatggtctcgatctcctgaccttgtgatccgcccagctcggcctccgaaagtgctgggattacaggcgtgagccactgctcctggcctcatcttttttttttttttttttttttttgagacggagtttcactcttgtttcccaggctggtggagtgcaacggtgtgatcttggctcaccgcaacctctgccttctgggttcaagtgattctccagcctcagcctcctgagtagctgggattacaggcgtgtgccaccacacccagctaattttgtatttttagtagagatggggtttctccatgttggtcaggctggtctcgacctcccaacctcaggtgatccactcacctcggcctcccaaagtgctgggattacaggcgtgagccaacgcacctggcctcatcttgttttttttttttttttttgagacagagtcttgctctgtcgcccaggctggagtgcagtgactcagtctcggctcactgcaagctctgccacctgggttcatgccattctcctgcctcagcctcccgagtagctgggactacaggcacccgccgccacgcccagctaatgttttttgtatttttagtagagacgggatttcatcgtgttagccaggatggtctcgatctcctgacctcgtgatctgcccacctcggcctcccaaagtgctgggattagaggcgtgagccaccgcgccctgccacatcctgttttttttacaacagggtgtcactctgtctctcacccaagttagagaggagtgacacagtcttagctcactgcattctcccaggcccaagcaatcctcctatctcagcctcccaagtagctgggactttaggtatgtgtcaccacagttgactaatgttttaatttttgtagagatggggcctccacatgttgcccaggttggccttcctgggctcgatcctcctgcctcagcctcccaaggtggtgcatgcctacagtctcagtagattagaatcaccctaaccctcagtaactgagattgtaggcacgcaccacctcactgactcacctcaaactctcttttttgagatggagtctctgtcaccagactggagagcagtggtgcgatcttggcacactgcaacctccgcctcctgggttcaagcgattctcctgcctcagcctctgtagcagctgggactacaggcatgcgccactacgcccggctgatttttgtattttttagtagagacggggtttcaccatgttggccaggatgatctcgatctcttgacctcatggtctgcgcaccttggcctcccaaagtgctgggattacaggtgtgagccactgcgctcggcccatctcaaacttttaataaggctcttcgtatagaaatttttaaaaaattaaaaacatttttggccaggcttagtggtttaagcctgtaatcccagtgctttgggaggccaaggcaagcagattacatgaggccaggagtttgagactagcctggccaacatggcgaaaccacgtctctactaaaaatacaaaaatttgggcaggtgcagtggctgacacctgtaaccccaacactttgggaggctgaggtggatagatctctcgagttcaggaatttgagaccagcctgggtaacatgaggaaaccccatctctgcagaaaatacaaaagttagctgggcgtggtggtgcatgcctgtggtcccagctactcgagaggctgaggtcaggctgaggtgggaggatccctggagcctgggaagcggaggttgcagtgggggatgaaaaagaataccccgtgtccaaatagcaaaacactctgaaatgaggcaaaccgtggtttgttgaacaggtgttctgggacaaggttgccgaatatgcattagccgtaatccccaggacagccatgcagggtgggtcttaaacagttttttagattctcgagtataaaggtataatattgaagaataagcacaaataatgtcatcatacatgttaaagtgacaacacaggatttacaaaattacccttttttccccaaaattacctcttacgatgtggtttctgttggtgctgttttctcttgcatcatcccgccaggttgggtaaccctaactgattgtcaccagcagaccaacagacagactcacagcatccttctccctggtgtgagcactgcttaattcacatttatgaaaatactttaagacaagggcactgtaactcacatagaatctgaagtggccttgaacagggagctggtccagctgcctcttagtgtgtctgacctccaggtgggcggactgagatgcgtgcaggtgttcatggtataggcatccttgtaaacctgctctggttaaggataaataggcaaagttgtgctaatgctgttcctacagcagcctttgccctggactgactccagaacagctggctgactgacagctgcctcccagtaaagccttaaacaggcttatcttatatttttaaaaggcaaaggacaataaggcagattaataaactgtgggggtttttttgtttgtttttgtttttcttgagacaaagtctcgctgttgtaccccaggctggagtgcaacggcgcgatctcggctcactgcaacctctgcctctcgggttcaagcgattctcctgcctcagcctccagagtagctgggattacaggtgcccgccaccacgcccggctaatttttgtatttttagtctagacgggggtttcaccatgttggccaggctggtctcgaactcctgacatcaggtgatccgcctgcctcggcctcccaaagtgtcaggattatagggtgagccaccgtgcctggcttttttttttttttcctgtcttttgtgtatgtgatggggtctcgctcttgtcgcccaggctggagtgccatggcacgatctcggctcactgcaacctctgcttcccgggttcaagtgactctcctgcctcagcctcctgagtagctggaactgcaggtgtgcaccaccatgcccggctaatttttgtatttttactagagatggggtttcaccatgttggccaggccgatctcgacctcctgacctcaagtgattgacccacctcagccttccaaagtactgggattgcaggtgtgagccaccacacccggggctggatttttttgttttaagagacaaggtctcacactcttgcccaggctggtttacagtggtgcagtcactgcagccttcacctctgggctcgagtgatcctcccacctcaggttacaggtgtgagccaccacacatgaccgcacatggcagattttttttttttttttttcacggagtctggctcttgtcacccaggctggagtgcaatgatgtgatctcagctctcactgcaacctccgcctcctgggttcaagcaattctcctgcctcagcctcccgagtagctgggattataggggcgtgccaccctgcccagctaatttttttttttttctggagacaaagtcttgctctgtcacccagactggagtgcaatggcaccatcttggctcactgcaacctccgcctcctgggttcaagcgattctcctgcctcagcctcccgagtagctgggattacaggcacgtgccacctcacctggctaatttttatatttttagtagagacggggtttcaccatgttggccaggctggtcttgaactcactgacctcaggtgatccgcctcagcctcccaaagtgctgggattacaggcgtgagccactatgcccggcccaggattttttttttaattaaggaaaatactttttacatctaaaattctacgcgacaataattaatgtgtcttcaagctgagaattaattaaaatatagccaataaaacatgtattaagctttgtaaactttgtctatatatgtacttattttacttttatttaaaaatatggggccaggcacggtggctcacacctgtaatcccaccacttcgggaggccaagacgggtggatcacttggggtcaggagtttgagaccagcctggccaacatggcgaaaccccttccatctctactaaaaatatgaaaattagccaggtgtggtgcaggcacctgtaattccagctactcaggaggctgaggcaggacaattgcttaaacccagaaggcggaggttgcagtgagccgacattgctccactgcactccagcttgagcaatagaaagactctgtcttaataaataaattaatagccgagcacgctggctcacgcctgtaatcccagcattttgggaggccgagacgggcagatcatgaggtcaggagatcgagaccatcctggctaacacgatgaaaccccgtctctactaaaaatacaaaaaaagccgggtgtgatggtgggcgcctgtatatagtcccagctactcgggaggctgaggcaggagaatggcgtgaacctgggaggtggagcttgcagtgagccgagatcgcgccactgcactccagcctgggtgagtgatcgagactctgtctcaaaaaaaattaattaattaattaaaatatgacagtggcctgggtgccatcgctcgcacctgtaatcccagcacattgggagtctaaggtgggaggatcacttgagctcaggagtttgcctagcctgggcaacttagggagatcctgcctctacaaaaaataaaaaattatccaagtgtggtggttgcacacctgtagtcccaactacttcggagggttgcaggagtccaggaggtcaaggctgccgtgaggtgtgattgagccactgcactcctacctgggtgatatagtgagactctgtctctaaaataaaataaaataaaataaatgacagtggtccatatagtaccttattcagaaaaggcttgatgtacaagaaaataagttatttgtgatcaggacagagaagaattactgccttttgtgaaatggatgctgagaatcagttacgatgtacggtgcttgggaggctgactttgatttcagttacagccctgctgatccttagcacggtgactgcaaataggttactccaccttcctgagtctcagtcttcttagccgaaaagcacagatcatcatcataatagctaacattaactgtgtgcctggcatagggtctgaccgctttattcaagccagctcccagacataccttgctggactgtttaatgcccattcgacaaagaggagatcgacatggggaggtgttgagtaacttgcctggccactgagtccctgtcaatggcagctcagacaggtgaccccagagctaccctcccaccccctgaccaggcccgtctcacaggcctcttaggaagggctctgttcagtagatggcaggcacgtggtaagtgtttcctaagctgcagctgctgtgtagataaaactcaaagcagatatcacaagttttgtcagatcatactgtctcaattttgaggtgaatgcatgtgttttactacttaactacctctgaaatttaggggttttttgtttgttttgagacggagtctcgctctgtcgacaggctggagtgcagtggcgcgatctcggctcattgcatcctctgcctcccggcttcaagtgattctcctgtctcagcttccccagtagctgggcctacgggcatgtgcaccatcacgcctggctaatttttgtatttttagtagagtcggggtttcaccaggttggcgaggctagtctcgaactcctgagctcgtgatccccccaccttggcctcccgaagtgctgggattacaggcgtgagccactgcgcctggccctgaaatttcgcatgttttacggttggcttgttagggttaaattggtgcaccttatacttggttgcatactagactcactggaatgatttgactttcgtcatagttgcagaggcactctgaaaccctatgtatgtgcttcaccagggacagccccacgcatgggaggtggtggccagccatcaccccagggtgaatttctctaagagcagtcctaggccagggggtgagtgtgggaaagtcagggccgtttccatcagttaacgtttcagagcgggttcccgctggaagtgctggaaatacccagatgccatctgtagcattttatgaactgtggcggatccactctctgtgtcttgagcttctgctctgtggtctgctcagtggaagcatcctgtcagtccactgtacagtggggtggagccgcagccagggtgggtgtgccgtttgattggtcacggaatgaacagggcaaaggtcactaagtagatatgatactgcaagtaggattgtggtcataggtatttttatgaatttgtgttatgtgaagttgaggatttgaatgttgtgattattatatccagataaagttctagcctggcacagtgcaggcacgtgcctgtggtcccagctgcttgaagtgggaggagagcttcagctcaggatttccaggctatagggagctgtggtcccaccattgcaccccagcctgggtgacagagtgagaccccatctcaaaaagaaaagaaaagaggctaggcgcagtggctcaggcctgtaattcaagcactttgggaggctgaggcaggcggatcacttgaagtctggagttcgagaccagcctggccaacatggtgaaacccccccatctctattaaaaatacaaaaatcatacttacccggcaggggagataccatgatcgcgaaggtggttttcccagggcaaggcttagccattgcactccggatgtgctgagccctgcgttttccccaaatgtgggaaacttgactgcgtaatttgtggtagtggagggactgtgttcacactgtcccccccgcccaaaaaaataaaaatacaaaaatcagtcgggcgtggtggctcacgcctgtcatcccagcactttgggaagccgaggtgggtggatcacctgaggtcaggagtttgagaccagcctggccaacatggtgaaaattgggaggccgaggcgggcggatcccaaggtcaggagatcgatacatcctggctaacacagtgaaaccccgtctctactaaaaataaaaaaaaaaaaattagccgggcgtggtggcgggcgcctgtagtcccagctactcgggaggctgaggcaggagaatggcgtgaaccagggaggcggagcttgcagtgagccgagatggcgccactgcactgcagcctgggcgacagagcgagattccgtctcaaaaacaacaacaagaacaacaacaaaaaattagccgggagcagtgatgcgtgccgtagtcccagctactctggaggctgaggcaggagaatcacttgagcctgggaggcagaggctgcagtgagccgagattgtgccactgcactccagcctgggcgacagagcaagactccgtctcaaagaaagaaaaagaaagaaaaaagtcttccccgtgagagtagatttctactgaatcgattgctggttttatgccttttcttccgtgataggaagtatgtccagactcatctggctggggatcctcaggagagcctgcggggggcagcagaggcccgcctgggccagggcgtgcaccagaccagaatcctgcggatttagtattgtgagggtagaagaccagcaagcagcatgacctcgtggttactgatcttatgaagaacacttgtctttcatatttgggactgtgttaaggttttctggaatatttttggttgtagtaacgattctgctttaggagctttcttctctagtgttgcacagacctgagtgatttgaccagcagtgctgcggtaacggaagaccactcgtgtcttcagactcgttctgttcctgggggtgcttgcttgttctaggccccctttgtatggagaggttcaaaccttgattgaatagtcgctacccaggtgtcataacctgtggcctcattggtgtcacctggactttttgtctgctgtttgcaccatcgaaagtgatgtgcgctggccgggcgcggtggctcacgcctgtggtcccagcactttgggaggcgggggtgggcagatcacaaggtcaggagatggagaccatcctggctaacacggtgaaaccccatctctactaaaaatacaaaaattagctgggcatggttgcgagtgcctgtagtcccagctactcgggaggctgaggcaggagaatggcgtgaacctgggaggcagagcttgcagtgagtggagatcgcgccactgcactccagcctgggcaacagagcgagactccctctcgaaaaaaaaaagtgatgtgcgcttgggactgggagggcgaggcccgaggtacctgggtgcccgatgcccaggagggcatgagtgtcgtgttggataacctgctctccaagtaatagggttttgagaatgtttttttttttttttaattgagacagagtctgactctgtcgcccaggctggagtgccatggtatgatctcggctcagtgcaacctctgcctcccaggttcaagcgattctcctgcctcagcctcccaagtagctgggactacaggtgcccgccaccacacccggctaatttttgtatttttagtagagacgggggttcaccatgttggccaggctggtctatctcctgacctcatgatccgcctgccttggcctcccaaagtactgggattataggcctgagccaccatgcccggcctgttcaattctttgtattcaaatgtatatctggagttattttgttcaacttctgatctgcttttctttttgaattactgtattctaagcatcagtttacaagaaaaaaaatctttattaggtttccagacccaagtcaataccaataaaattaatgcagcaaacattcactgaatgctctattaggacctggggcagtagatgagtctgtgaattaaaagggcttcagcatgtggggtttggttttgtttctctgtagctaatcatacctttggaatggttttatagtttcaggaaaccgtggttctgggcagggtggcagctatgggttgaggcagttgatccttcctcaggtgtggccgctggtcttgttgcttcttgacattaactttgtgactcacgagggcaggcgttcgttttctgtggcactctgtgtgtgagcgagcatggggcttgttactgtgtgaaaagggccagctgccctgcctgtctgctcctccctggctcggccgggcgctgccatggctccagctcagattcacttcctctcgtacttggatgcttggtgatggtcgtggaagcagttttattttctcttgctgttctcgtgttgcgttaagctcagcatcactgttgctttttattcttagaattaaggaggaaagctgaaatcttttggggatttctgtgtttccagggactttaggaattcttttttttttttgagacagggtcttgctctgtcaatcaggctggagtgcggtggcgcgatctcggctccctgcagccttgacctcctgggctcgagtgatcctcccatcccaaccacctgagtaactgggaccacaggtgtgcaccatcacgcctggcgagtttttgtatttttttttttaatagagatggggtttcaccatgttgcccagaatgatcaaacttctaggttcaagcagtctccccacctcagccttccaaagtgttgggattacaggcatgaactgccatggctggctggaaagtctttacatttgaaattcattttaagttaggaggaaaggcctagcacactggctcatatctgtaatcccatcactttgggaggctgaggtgggcggatcacttgaggccgggagtttgagtccaacctggccaatatagcaaaacctcatctctgctaacaatacaaaaattatctgggcatggcggcagatgcctgtgatcccagctactcgggaagctgaggcaggagaatcgcttgaacccgggaggcggaggttgcagtgagctgaaagtgcactactgcactccagcgtgggcgacagagtgagaatcggtctccaaaaaaaaaaaaaaaagagtaaaggtgagggacacctgtgatgtggcacacagcgtcttttctctagcttgctttgttgactcttgtttataatttcttcaaatgtatttacagagttaattgggttttttttggaatagataatatctattccaaataaaaatccagaaatacacattcaaactgtggggcttttacccttttaactgtgttccaagtccctgtccctagcatgctctgattgtcagtccttcccttgcctgacctacctgtctgagtatcctttggcagtcaggtttttgtttgtttgtttttgagacggagtctcgctctgtcgcccaggctgcaggctggagtgcagtggcgtgatctcagctcactgcaacctccaactcccgggttcaagcgattcttgtgactcagcctcacgagtagctgggactacaggcgcctgccaccacgtccagctaatttttgtattttttagttgagacggggtttcaccatgttggccaggatggtcttgatctcctgacctcgtgatctggccaccttggcctcccaaagtgctgggatgacaggtttggccaccgtgcccggccggcagtcagtttttacatggttcatcacagattttaaattaagattccccagcaggataaaagaaatgccagttgtattttatttttcgtatttgtatttttagcaattttttttttttgtatagaatgagccaagggcatctagagcaaagaggtagttccctgccccgtctccatctccctgtctgcactgtctctcccagaggtgtttgctggtgccttctttgcagttccctgtgctgtgtcatgcccgtttgctgacccagcccctgctgtgtcttccccatcccagtgtgactgtcgctcttggtagttcctccgtgtttcctttgtttccttaggtgacttgtctttgccccactccctgcagtccgcagcacctgttgtctccttccctctcctcccgcttctcctcagacgtcatctgttctttctagagttgttccccttgccccagggtccagggttcctaacagcctgttttttttctttctttttttttttttagtgagacagagtctcgctctgttgcccaggctggagtgcagtggtgcggtctcagctcactgcagcctctgcctcctgggttcaagtgattctcccgcctcagtcttctgagtagctgggactataggcgtgcactaccatacctggctgatttttgtatttttattttttatttattgttgagacagggtctctttgttgcccaagctggagtgcagtggtgccatcttggctcactgcaacctccacctcctgggttcaagtgattctcctgcctcagcctcccaagtagcttacagtagggattgcgggcacctacgaccacgcccagctaattttgtatttttagtacagatagggtttcaccatgttgaccacctggtctcaaactcctgacctcaggggatccgcccaccttggcctcccaaagtgctgggattgcaggcgtgagccaccgcgccaggccctaacagccaccttcttagcatctgtatattcagaccgtccattgcaggatgtgtgatctttgtggcctggaatgtctctctctgagcactccatcctcccacccctcaggcagtgtctcttgaggccacctgcccagccaccatcttggggggaccacaggaggctggggagagagcgaggcagtagtgagaagccgggacgctcaccgttggccgagtaccttagagcagccctgacgcctgcttctgtctcttggtgaaagtggcgcccagacttcagtccttacagcccagaactcagaaccgtggaggtgctgtgacccacagggtttaccttgtaattgttgttaaaacccttctgggcttcataatggaatgcttatgttgaaatattattttaagtactattatctatgatgtggttagaaatgccaaagaatttttagcttttttgagacggagtcttgctctgttgcccaggctggagtgtagtggcgcgatctccgctcactgcaagctccccctcctgggttcacgcgattctcccgcctcagtcttccgagtcgctgggactacaggcgcctaccaccatacctggctaattttttttggtattttttgtagagacggggtttcacgacgttacccaggatggtctcgatctcctgacctcgtgatccacccgcctcggcctcccaaagtgctgggattacaggcatgaaccaccgtgcccggcctttttttttttttttggtagatggagtctcgctctgtcgcccaggctggagtgtggtggcgtgatcttggctcactgcagcctccacctccctagttcaaacgattcttctgcttcagcctgctgagtagctgggattacaggcacctgccaccacgccctgctaatttctgtatttttagcagagatggggtttcactgtgttgcccaggctggtctcaaactcctgacctcaggtgatctgccctcctcggcctaccaaaatgttgggattacaggtgtgaaccaccacgcccggccagagtgtgtagcttttgtaaaagttttggaaatggcctcagataatttcagaggtttttaaataaagaacgctcaaaatggagcaaaatggagagcccctgataggcctcctgcgtggaggtttgcagtaagccagaggcacctgtgggtcccagggagagacgggctgctccatggatgctcctgggacctggggcactgggtgggcctcaggcagataggagctggtccgtatctcttgccaagcccaggccaactcctgatgaagcagattcctgtgggtgacaagtgtcagaagatagaataggaccttagggtcaggaaggatttcttgaacaaaaaaggggaaaaacagattgagagattcagaaagctgtaatatattctgtgacctcaaaggtgacttggaggagggctgttgttcagcgacgggcgtgtagtgaacactggggcatttaaacggttcagatgctgaatttaatgttatatgttttttactacaattggtaaaaaaaaaaaaaaaagcttgtgctcatcaaaagacacaccataataagtaaaaaaagaactgtgaactggaagatacttgtaacatttttaaccagtgaagggtcggtgtcctggatatgtccactgggcaccacagacagaacggccttgaaggtaggctggagacgcctacccttatcaggccaggcaagcactggggagcctggccgtaccagtcattgttgaggctgcaggaatggcagggagccctaagttccagtggccactggtgcagtcctcagagagcagttggcacaccgcctcaggctgagcctgcccattcttgggcacccagaagttccactcttaggtatacaccagaagaattcttcctcgactgtttgtgctgaaggacaaggtttaagtttttaaaatttccagtgtcacagactgatgatatttttgtaaactacaacaaaagtgactagctagtaaaggaaatcacagaacataaaatacaaacccatgtcattattattaatattttgaggcagagtctcgctttgtcactcagactggagggcagtggtgcgatctcggctcactgcaacctctgcctcctgggttcaagcgattttcctgcctcagcctcccaagtagctgggattacaggcgtgcaccaccatgcctggctaattatgcctggctaatttttgtatttttagtagagatggggttttgccgtgttggtcaggctggtctcaaactcctggcctcaagcaatctgcattcctcagcctccaaaagtgctaggattccgggcatgagccatcatgcctggttatcgggggaacccgcccccaatatttcaatgtaggttctttctattttccataagtgtcggccagctgagaaataaagagaaagagtacaaagagaggaattttacagctgggccccccgggtgacatcacatatcggtagggccgcgatgcccgcctgagccacaaaacaagcaagttttattaaggatttcagaaggggagggggtgcaagaacagggagtaggtcacaagatcacatgcttcaaagggcaaaaaggagaacaaagatcacaaggcaaagggcaaaagtggaactcctgataagggtctgtgttcagcggtgcatgtattgtcttgataaacatcttaaacaacagaaaacagggttccagagcagagaaccagtctgaccaaaaatttaccagggtggggtttcccaatcctagtaagcctgagggtactgcaggagaccagggcgtatttcagtccttatctcaaccacataagacaggcactcccagagcagccttctgtagacctccccccaggaatgcattcctttcccagagtattaattcttgctaggaaaagaatttagtgatatcttccctacttgcacgtccgcttataggctctctgcaagaagaaaaatatggctgtattttgcctgaccacacaggcagtcagaccttatggttgtcttcccttgttccctgaaaatcacgattattctgttctttttcaaggtgtactgatttcatattgttcaaacgcacgttttacagtttgtacagttaacacaattatagtggccctgaggtgatgtacatcctcagtttatgaagataacaggattaagagattaaagtaagacaggcttaagaaattatcaaagtattatttggaaactggtaaatgtccatgaaatcttcacaatttatgttcctttgccacagctccagccggtccatctgttcagggtccctgacttcccacaacacctggcttctattacttttttaaaattagcttttttctttttttcgagatggagtctcactctgttgcccaggctggaatacatggtgtgatcttggctcactgcagccgccgcctcctgggttcaagcgattctcttgcctcagcctctcgagtaactgggactgcaggtgcaatacaaaaaatgcagaacttttgtattttctgtagagatggggtttcgctgtgttgtccaggctggtctcaaactcctgagctcaagtgacatgcccaccttggcctctcaaagttctgggattataggcatgagccactgcatccagccttattattattatttttttttgagatggagtcttgctctgtcgcccaggctggagtgcagtggcgcgatctcggctcactgcaacctctgcctcccggattcaagcgattttcctgcctcagcctcctgagtagctgggactacaggcatgcgccatcacaccgaggtaatttttgtattttttggcagagacagggtttcaccatgttgaccaggctggtcttgaactcctgacctcaagccatctgcccaccttggcctcccaaagttctgggattattttttaagcagttttgataggtgtgtacctagtagtgctctgtggtttaatttgcatttcccagggagtgggggcactgcctgtcttctcacgcctcagttgcttgttgctgtgacggtcgcccactcctcctgccagtgtctgtgctgctcacggtagctgcatcagcttcacgctgtccgcccttcgccacccaccgcgcctgctgctcaggaatgttccaagcaacttggtggtaacagaagctgagaacagcccagatgtccttcggtgcaagagtggatggatcagttgtggtctattcacagaatagaatgtgaccacactggagatgaatgaattgtagctacaatctgcagtgtagacgaatcttaggaacgtaggcgtttcagaagcagatcaagccaggcacgatgctgtgtgcctatagtcccagctactcagagcctgaaggtgggagatcacttcagcctgggagtttgaggccagcctgggcaacatagcaagaccctgtctcaaaggaaaaaaaaagcagattacagaaaagtaaatccagtgctaggccgtatttttaagctcaaaaaattaaaactaattagcgtttagggataaacatgaggtaattttttagaagcaagagaatagcattgaatttaaggtatatatggggaaaatgaaacttccaagttattgataattttccagtttttaaattagagacgggatcatggtgtttatgcgtcataatttatatgttccatatattttttgttgtttttttgagacggagtctcgctctgtcacccatgctggagtgcagtggcgcgatctcggctcacggcaagctctacctcccaggtttacaccattctccgcctcagcctcccgagtagctgggactacaggcgcccaccaccatgcctggctaatgtttttgtatttttgtagagacggggtttcactgtgttagccaggatggtctcgatctcctgaccttgtgacccgcccgccttggcctcccaaagtgctgggattacaggcgtgagccaccacgcccggctgatatgttccatatatttctttctgtatttcacataatacatagtaaaatatttaaaacagaacaaaaatagacttccttttaagatgttttcatatctgttcttacaaagttggccacagtttttccccaacagtagtttgagttcagcagcagctcttttataaaacgtttgctgcacacactgagattgcacctggaagtacagaaataagaacacacgtattttattttatttttttacccctgaagatctttaagtcttctgaggagcatggacctgctagactgcaagctgctgcattctgaggagcagggacctgctaaactgcaagctgccgcaggcggagatttttgcctgtttggtttattttgttaccactgagtccccagctctgagaacagagcgaggcatgtgatcgatgcatcgtaactgttgagcaaatgaatgctgagctgtgatggcaccgacgtgtccggggagaggacgcacccggctgtgtggacatgtgcccagggcccaggacagcgccacggaagaggacacacccggctgtgtggacatgtgcccagggcccgggacagcgccacggaagaggacgcacccggctgtgtgcacatgtgcccagggcccgggacagcgccacggaagaggacgcacccggctgtgtgcacatgtgcccagggcccgggacagcgccacggaagaggacgcacccggctgtgtgcacatgtgcccagggcccgggacagcgccacggaagaggacgcacccggctgtgtggacatgtgcccagggcccgggacagcgccacggaagaggacgcacaggacagcgccacggaagaggacgcacccggctgtgtgcacatgtgcccagggcccgggacagcgccacggaagaggacgcacccggctgtgtgcacatgtgcccagggcccgggacagcgccatggaagaggacgcacccggctgtgtgcacatgtgcccagggcccgggacagcgccacggaagaggacgcacccggctgtgtgcacatgtgcccagggcccgggacagcgccacggaagaggatgcacccggctgtgtggacatgtgcccagggcccgggacagcgccacggaagaggacgcacccggctgtgtggacatgtgcccagggcccgggacagcgccacggaagaggacgcacccggctgtgtggacatgtgcccagggcccgggacagcgccacggaagaggacgcacaggacagcgccacggaagaggacgcacccggctgtgtggcaggggaggttcccaagagcaggctcagggctctggggtctgagtgagggctctccagccagcagggagcagggcagggtgttgaagagacggcaggtgcgtcaggggctgacgtgggacccggcactctgtgctctgtgtctgcccgggaacaggtagtcctgcgtcggaccgggaagtgtggtgggtgtggtgggggaaggggctggcgtcagcagggctctcgtccgccaacgtctggtggggatgcccgccatgcgggggcctcaggctacagccagggctgtgaaggagccgaggtcatagagtggctgccctggcgtagggagggaggacacgggtccccgccatttcagaagctcagcgtccctgcacgtgtgcggtcttgtctgcctaggcatgtgtgcgggccctggggctgctgccagcagaacggactgggatacgctggatttgtaaaacgtgaccctttttgtttgcttttaatttttaatttttatttatttatttatttttgagactgagtctgactctgtcacccaggctggagtgcagtggtgagatctcggctcactgcaacctccccctcgagggttcaagcgattctcctgcctcagcctcctgagtagctgggattacaggtgtgtgccaccacacccagttaattttgtatttttagtagagacaggttttctccatgttggtcaggctggtctcgaactcctggccacaagaagcaatccacctgcctcagcctcccaaagccttgtttgcttttttttattttgttttgttttgagacggagtttcactattgttacgcagactggagtgcaacggcacggtctcagctcgctgcaaactccacctcccgggttcaagtgattcttctacctcagcctcctgagtaggtgggattacaggcatgtgccatcacgcccggctaattttgcatttttagtagagatggggtttctccatgttggtcaggctggcctcaaactcctgacctcaggtgatccgccctcctcagcctcccaaagttttgggattacaagcttgagccaccgtgcccggccaccttgtttgctttttaaagataatgatgtcactaaaagagttctgactgaggccgggcctggtggctcacacctgtaatcccagcactttgggaggccgaggctggtggatcacgaggtgtggtgatcaagaccatcctggctaacacggtgaaaccccgtctctactaaaactgcaaaaaattagccgggcgtggtggcgggtgcctgtagtcccagctactcaggaggctgaggcagaagaatggcgtgaacccgggaggcggagcttgcagcaagccgagatagtgccactgcactccagcctgggagacagagcgagactccgtctcaaaaaaaaaaaaaaagagttctgactgaaggttggaacttagccctccagaaatgaagactgcgaataacgctgatggcagctcgtcacttgcagcaggttgcagcacgtgctgctcgtgtagctgcggctgcacaccaggcctctcctttaactgtgttataacctttctgttgacatgggatccccttgaaagttttttttttggagacagggtctcactctgtcacccaggctgacgtccagtggtgcaatttcagttcactgcaacctcctcctcccgggttcaagccatcctcctgcctcagcctcccaactagctgggattacagatgcacaccgtcacacccagctaatttttgtatttgtagtagagatgaggtttcaccacgttggccaggctggtctcaaactcttgatctcaggtgattcaaccacctcagcctcccaaagtgctggaattacaggcgtgagccaccactcccggcccccttgaaatttaaaccaagtttaggaagaatgaagttgtgaggtgctacttcaaacatcaggtggcaaactcccggactcattaccccaaggaaataggcagtccaggttggtggctcacgcctgtaatcccagcacttcgagaggccgaggcaggcgggtcacctgaggtcaggagttcaagactatcctggccaacatggtgaagcccatctgtactaaaaatacaaaaaaattagctgggtgtggtggcgcgcgcctgtaatcccagccacttggcaggctgaggcaggagaatcgcttgaacctgggtggtggagggtgcatggagccaagattgcaccattgcactccatccagtttgggtgacagagtgagactctgtctcaaaaaaaaaaaaaaaatagacatcagaaagggttggctcctgtgatctcggcactttggtgaccatgacccaaggcaggaggatcacttgagccaaggaattcaagatcagcctgagcaacatagaccccgtctctgcaaaaaatttctaaaaacttagctggcatggtggctcacgcctgtagtcccacctattcaggaggctgtgttgggaggatcacttgagtctgagaggttgaggctgccatgatcccttatcacaccactgcattccagcctgggtgacagagcaagaccctgtctccaaacaaacaaaaaagcaaaaaatggtgttttacctaggtatttaccatttccagtggtcttcattcctttctaaaaatctaggttttagccggacatggtggctcatgcctgtaatccccagcactttgggaggctgaggcgggtggctcacctgaggtcaggagttccagaccagcctagccaacatggcaaaacccaatctctactaaaaatacaaaaattagccaggcgtggtggtacgtgcctgtagtcccagctattcaggaggctacggcaggagaatcgcttgagcctggaaggtggaggttgcagtgagctgagattgcaccactgcactccagcctgggcaacagagtgagactctgtctcaaaaaagaaaaaaaaaagaataagtcacattttggtgaggagcagtggcttgcacctataatcctggcactttgggaggctgaggcaggaggatcacttgagaccagcctgggcaacaaagccagaccgtgtctctatagaaaattttaaagttagctgggcatggtggcacattcctgtagtcttagctgcttgggatgctgagaagggaggctttcttgagtccaggatttcaaggctgcagtgagccaagatcgcaccactgcactccagcctgggcaacagagaaaaaccttgtttctaaaaaaaaaaattaggctgggtagggtggctcacacctgtgatcccagcactttgggaggctgtagcaggcggattgcttgagtctgggagtttgagaccaacaagatcctgactctataaaaattttaaaaaatagctgggcgtggtattgcacacctgtagtcccagctactcaggaggctgaggtggggggatcagctgagcccaggaggtcaaggttgcagtgagctgaaatgtgaccactgcactccagcccgggcaataaagtcaggcggggaaaagaaagaatgagttaacattttctcagctttatgtgttgagtgattttggattctatcctgaaatggtaagaatgaaaagaaaatctgccaagtccatccgttcctacactctcactgcctccaagtcattctgcgctcttgagccagaacgacctggccgtttttaaaaatggagttttttgccttagtaattgacttgtgtaagagttctttattccacttgtgaattgttttttatacgtacataatgtaaatattttctccccttctgtgcctttcagtatgaatctatctgaactcgattctgctgttgtgtgtgtgtcttttcctcagtaccagatggtcttgattactgtagatatatagtatatgtcttgaaatcaatagggtaaattctctaacttttgttctttttattaatgttgctgtggctaatctgtctgctacatttccttatacatttaaaaaaatcagtatcagtttctgcaaaaaaaaatcctcttggattagggttaggcttctgtcaagtctacagatcagtttggggagaactgacttctttatatcgaggcttctaatccgtgaacatgaggaatctttttcttatctttagtatcttagcaatttgtggttttcaacgtacagatttcataggtcttgttatttctttttctttttttgaaacaaggtctcactgtgtcacccaggctacagtgtggtggcacgatcatggctcactgcagcctcgagcttctgggctcagccatcctcttatctcaacctcctgtgtcactaggaccacagacatgagccaccatgcctatttaacttaaaaacaaaaacaaaaaaccgggcacggtggctcatgcctgtaatcgcagcactttgggaggccgagggggggattgactgaggccaggagtccgtgaccagcctggacaacatggcaaaaccctgtctctaaaaatacaaaaattagctgggtgcagtggtgcgtgcctgtagtcccgtgcctgcggcatgggaatgggttgagcctgggaggcggaggttgcagtgagttgatgacttaggatttttcttctcggtcactttgcaagccggggacccctggccagtgatgccccacctgggccctgcttggccacactggcgtgccccaactcacctgtgttatagcttgtactgtgttcggccattcccgagctcatgtaccgcactcaagatcaaggatacactggacattgaagggtgaggagggcggagaagaactttattgagcagtgaaacagctttcagcggaccaggggatgcaggggtggttcccctacctgaaggcaggaaagtccgcctgtgtggctgggtctggggctttttatggactcaggatgcggagtgcttgcagagcttgctgatgggtttgtgagtatgcagaaaaggttaaagtgggcatgacagtgtagaaaaccaattataagaggccgggcacggtggctcacgcctgtaatcccagcactttaggaggctgaggcagacggatcacaaggtcaggagttcaagaccatcctggtcaatgtggtgaaaccccatctctactaaaaatacaaaaattacctgggcgtggttcgcgtgcctgtagtcccagtgacttgggaggctgaagcagaagaatcgcttgaacccgggaggcagagattgcagtgaactgaggtcacaccactgcactccagcctgggcaaacagagcgagactccacctcaaaaataaaaattaggaaagggtaggtatgtgtaaaataggtgaaggatggggatcaatcagaggaaagtgtggcaaacaggaaggcaagttcttcatctagtctgaggatttaacttgtagctcagctgtcaggctttaaactgtctttggcttggaggtgggtttcaccgggaacccgccccatctgcctggcattcagctgcctcctgccagtatcaccgagatcgcgtcaccgcactccagcctgggcaacaaagcgagactatctcaaaaccccatattgatgtcatttcctaaatatttggttaaaaaaaaaatctgggcctggaattttatctggttttttttttttttttttttgagacggagtctcgctgtgtcgcccaggctggagtgcagtggtgcgatctctgctcactgcaagctccgccttccgggttaacgtcattctcctgcctcagcctcccgagtagctgggactacaggtgcctgccaccacttccggctaatttttttgtatttttattagagatggggtttcactgtgttagccaggatggtctcaatctcctgatctcgtgatctgcccgccttggcctcccaaagtgctgggattacaggcgtgagccacggcgcctggccttctggggattttttattacaaatataactttattaacagatgcaggcctattcagattttctatttcatgtcagtcttggtaaattgtaattttcaagatatttgtccatttcatctaatttttctaatttcttggcatgaagttgttcgtattttatccttttcacgcctctaggatctgtagtgatgtctttcctcatgttgctcaaagaaccaactcttttggctttgttgaagttatctgtttgttttcatggatttctgttccttatgatttccttgcttgcatttatgttgggtttatcctgttactttgtagcttcctgaggcggagccttaggccttgattaacgtgttgtactagtcagcattctgcagaggaacgttgccattatctgtgtctctttctaaaggagatttgttatgaggaattggcccacgtcattatggagacggaatctcatgctctgccatttgctgaagattgaggaaagcagtgggataataacagtccaaggacaggaggagacacgtggccccgctcaggctggcaggcgagaaggaaaacccaggccaactcctcctcccacccctttctattcgggacccccgtggactgggacgacactcacctgcacagggcagcgcagttggcttcatggagcccccagctcaggtgctgctcttaccaagaaacaccctcccaggcacaccctgaagtcatgtttcatctgggtgccccacgatgcagcaaaggagacatgaaattaaccgtcatgtacactgtatttattattcaattcaaaacattttctaagttcccctgggatttcttctttgagctacatgttagccggaggtgtgttgttgaatatcaagagtatcttcctcctgggtttccagtttgtagctaagtcagggatagtgctgtgtgtgacctcattccattacgtttattgaaaccagcttgaagccctaacatgtggcttgtcttagtgtacagcattcagttaaaaacaatgtgtgttctctagatgttgggtgttctgtgactgtcacgtcatggtggttgattagttagaaacaatgtagaaacaatgtgtatttgccaggcgctgtggctcacacctataaccccagcactgtgggaggctgaggcaggcggatcacctgaggtcgggagttcagcctgaggtcgggaattcaagaccagcctggccaacatggagaaaccccatctctactaaaaataccaaaattagctgggtgtggtggcacatgcctgtaatcccagctactcctgtgtgaggctgaggcaggagcattgcttgaaccggggaggcggaggttgtggtgagccgagatcgtgccattgcactccagcctgggcaacaagagcaaaactgtccccccccccaaaaaagaaagaaagaaactgtgtgttctctagatgttgggtgttctgtgaagatcaggtcatggtggttgatagtgttgttcagaacatcgatgtttttcctgatttttggtctgttctgtcgatttctgagaaagtattaaaattaaagttgggtcttgcatttttatccattctgtcagtcccttactttaattggagttttttgtccactaacattgaatttaattgttgatatgtttggatttagatcttccaactaattttctatttgtttcctgtgttgagttactttttcatttttcttgtaactttttagcttatacctctttgcattttttatgcagaggttgctgtaaggattacaatatgcatgtttattttaattaattaatttattttgtttatttatatatttgtttttaaggaacagggtccctgtctcctgggctccagtgcagtggagtgatcatagctcactgcagcctcaaactcctgggctcaagcggtcctcccgcctcagcctcccaaaatgctgggactacaggtgtgagcccctgtgccggcccacagtacacagctgcagttcttcaggatctcttggggtggccgtattctgccgtctcacacttctccatgccatggcgtctgtctgtgcacgtggcaaactccacaaggcagtgttggattcttttgctttgaacggtcttatggaataaagtccatcagctctgcccttggtactttcatctatactttgtgatactttctttttattttttcttctagaatagcctaacatggcagaccagagacagcgctcactgtctacctctggggagtcattgtaccacgtccttgggttggacaagaacgcaacctcagatgacattaaaaagtcctatcggtaagtggacaagtgtggcccccacatccccccaggaagacacacatgccccgtgtggtttagtctgcattttaccaagaaccattgcacatactttatcctggccgactcagcgttgaactggtcacagctcggtaacacctttgtatgtgtaatgtgctccttatagcttaaagttatggtattcatgttctcttgccaacaaaaaatagcacttagtagaaactgacacactgtccacagttccatagggagtcagggtctgaacctgtttgaggcctcacaggagccgcagagcgctggcatggtcctgtggtctccttgttttagcacagtgatgacagagacccctcactctgttgtggccttctgattgagcttgaagaactgcactcttgggtacagtttcattgagtaacctgtaagagacaccatcactaatccagacaattcagatagtcctcctctcgtgtgctagcatcgtgtagttcataaaacacttcttaaagtgccatcattacgccccgccgtgcttaccgttcacttggcacttgtgcagttagcggctgggacaccagggctggccttggtgccgctgaacttagatgtgccgtggcactcacagcccttggggctccctcctctgaggctgggtcagggtgaggaggtttacctgaaacaaccgcggagcttgcttttgtccctggcccctgcagccctggagagtcggacagtgaggtggcctgggtggacctgccttccactgcacccggcagtgcgtgcgggtgggatggacgcggcggcgggtgcgggtggaacaaagtccagggtagagccaggacatggttttggtttgcaggaagcttgccttgaaatatcaccccgacaagaaccccgacaacccggaggccgcggacaagtttaaggagatcaacaacgcgcacgccatcctcacggacgccacaaaaaggaacatctacgacaagtacggctcgctgggtctctacgtggccgagcagtttggggaagagaacgtgaacacctacttcgtgctgtccagctggtgggccaaggtgagggcgagctgcctgccgtgcgggcacccgagtcactcctgccgtgcgggcacccgagtctctcctgccgtgcgggcacccgagtcactcctgccgtgcgggcacccgagtctctcctgccgtgcgggcacccgagtctctcctgccgtgcgggcacccgagtcactcctgccgtgcgggcgcccgagtcactcctgccgtgcgggcacccgagtctctcctgccatgtgggcacccgggtcactccacgcctgcagggttcccagcattgcagagcccatgcgttgatgccagcaactctacactcctgagaaaaggcttctgggcatatggagcctttctcctcacctgtgtgatgggcgaagctctgtcactggcttggtgtcctgcctggaacaagccatagcgtacagattgtcccagggaagagccgtgcggagccgccagggtttcttctgtaaatggctcccagtccttcgtgagacaggaggaaataagcctcgatgttacatccgcatttcttcgtttcctcgttttgttccaaatgtcatatatgaggccagagggttggaatcactgcatggcatttgtgagaagcctgtatttggctttgactggtcggcctcctcactagaatccttataaagtactttttatttagttaatgttagacagagtctcgctctgttgcccagactggagtgctgtggtgagatcctggctcactttaactttgaattcctgggttcaagtgatcctcccacttcagctccagaactgcaggagttgaggcgtgaaccactgtgcccagcctggaggctgctttgttttttttttgagacggagtctcgctctgtttcccaggctggagtgcagtggcgcgatcttggctcactgcaagctccacctcccgggttcacgccattctcctgcctctgcctcccgagtggctgggactacaggtgcccgccaccacgtccagctaattttttgtatttttagtagagacagggtttcaccgtgttagccaggatggtctcgatctcctgacctcgtgatccgccagcctcggcctcctggagtgctgggatgacaggcatgggccaccacgcccgtcttggaggctgcttttctttaagctgcgggtttctttctgtctctcctcctcccttcttcagttctttccttctgcttcctgtctggaaggcagtatccccacctggaacgcaccccctgccttctgctgagggcatttgggagtcctgcgcctccctctccaggggcctcggaggccatgcaacaccaccttcttctccccccaggccctgtttgtcttctgcggcctcctcacgtgctgctactgctgctgctgtctgtgctgctgcttcaactgctgctgcgggaagtgtaagcccaaggcgcctgaaggcgaggagacggagttctacgtgtcccccgaggatctggaggcacagctgcagtctgacgagaggggtgagtgcccgccccagggcccgtgtgtgtgtgtggggcagagccagaatgggccctgaatggtgtcaacctgtcttgtcaaacaggagggcactgacactgtgccgcgagtgtttgtggtggcagctgggactgttgaggtgtgaacgtggaccctgaggtaaagcaggcgcatagagctgtccccgccgtgacctgcggtagccgtagatcccagggactgcgaggcggggcagggcggcaggcagttggggcggggctgagggccgagggctggcggtgacccaaggcgacggaggaaagccgtgtggggtggaggtcagcgagtagcctctcccggtggagagtttgtccaggtgcccgaaagtcgctccacaggaccagcgttgggtgcgcgccaggctgtggccctcgtgcagtgccctgtgtgcttgcttttcagaggccacagacacgccgatcgtcatacagccggcatccgccaccgagaccacccagctcacagccgactcccaccccagctaccacactgacgggttcaactaaatccaggaggagctgtggtcagaggaggagccggcgcctggccacgccaaccttagaatcatgaactgtagtcacagagatgggaaggcagcctcctgcctgccctggccttgctggggcccctcctgcctccacgcccacccagcgtcgacccttgacccacgaagtgcgtagcatgcagtatttaaagcagtgtagctacggtcttctgtttttttcccttttttaatagcatgtatggggttctgttccatgtctgtgttgtggacattccgcggcatgaccgcgtgaactgcacggtggagctgcctcagggctgtcggtcaggttggtccagtgaggggtgactgcagccggtcaggtgggcgaggagaaggggggctgcccctttcctacctgtgcttgaggggccggaggcaggtgctgcctggcagagctgtgttaccgtcttggcctcggggtctggtccacactctgtgctcccagccttgaggctgcagtaggactctgatctcacctgccagaagagaggcggggccgcgtcctcctggcgtcaccggcgtcactgtcattccttggtgtctgtgctgggcatggttggcttgggggtctgtggtttcctgggccttgtggcagggtttctcccgtgggagaatttggtgtggaaagcataggaggccccttccgaggttgacaccgtgtcctccgcggtgtttctcgcctggtcgtctcgtcgtgtggacgctgccgttctggttctcggaggtgtgtccttcgccgtgttggggttatttgtctgtgttcctgcacttttcccgggctctgagctggattgatggggccagtctcccccctcccatcttgaggtcgttctccacattccttccagcacacctgtcctttccatagccctttttggacctttagaaccacagatgataggaccagcccaatgagccacagtcagagagtagattgtgcatgtgtgagcacccagctactggggacgggggctctcccacgacccctcctcctgtgtttgccagagctcccatctgccccactcgcctttgccccgtcatcgatgattcaggcagagccagattcgttaggtccctggaggaaggactgactggaccagagggaccctctggctcaggagggttgggtccctgggaggccggcagccaggccacagaatccacacgtggaccattgtgggtccctgggaggccggcagccaggccacggaatccacacgtggaccattgtgggtcccttgggaggccagcagccagactacggaatccacatgtggaccatgggaagtcagtctcttgcgtgtcctagaccttgtgggtggcgccctgcataggggagcagggggaacgggtctgatgtccctgtgctggctgagggctcagagctgcccgcactccgtagctcatgggatgtgctgggcctgcctttggcgccatgctgcagactccagtgggcctggtttctgcagaatgtccatggtggccgctgcagagttgcagaggtccctgtagagataaagctgaggaggaggctgtgtgtgatggctctggctcggaccaaccagatgagcctcctgaagcccccttccctgcctgcctgctgacccgtggccccagctcactcattgccctcagcagccacccgaggctgtgcagaagggtaggttcaggttgaccaggaagctgccaaaagggacatggatatgaggatacatctggacgtgcttaggaacagggtgctggttgagggcccccagctgacccctactgcagatccgcatgtggaccatgagccggctgccagcactaggtcctgggcagctttgtttgtcccacttttctttgtttcttctcactaaaatgatcacgaagacctttgacaagaggagagatatgcactgtgatattaaattagaaataatttatcaaaatcagacctctcctaaaagaataagaaattcattgtttggcccatcctgaaaggtgaggtggcgagacagtggggtgcctccgtgccgcttcgtgcagcagcaagttcagcctgagatgctggctgtactcagcctttgcaatttttgtagatgtagcttaggacgtgagttatttttccgcagactggccaagagccaggttctaagcttggacctaaggtagaaagctgcccatcgggggccctagctcagccccaccaggccctctgttgggcctgcacacagctctgtggctagaacactccaaggcccttcggtacccatcagagtgggccccttgccaggtggcttttcagttacagagtccagtggaccattttgtagaaccatgcagctccctgcggaaggtggggtagggtgggaaagaggagcaggtctggaggtttgtggaacccagtcccctgcagaatctgtaaaacctaataaatcatggttgtggccattctcacggtggtgattgtgattagacgacccccgggaagcccagacactcggggcctggagttcctccccctgcctgacctagaagcagaaccgttttcagcgctctgccctgttggctttaaggctttgtcttaatttaaggaaaaagatcctcccgggttttatttctctctttcttgagtggactgtttccctataattaaaagaggtggtgagtcctggggcagcttccgcgcctccctgtccacgtgctaacagatcaggacgcccccagcacccctgcctgcttttgctggtggcagtgacgggaccccgactcctcactctcgggccgcagacaatgctgtgagcaagtgtggccatgggcacagaatgtccctttggacgccgctgctgggggctgccaggggccctctggggtcgtgctttgaggcccgtccggttcacgagggggtccgggcagcactgactgcttccgacctgcaggaggcgtaggagcggccctgcgggccctttcacggcagctgctgctgtatagatttgtctccactcagtgacgtgggatttttttgtcttccttttggctttatttttaaactgctttagatattactgctcagtgtttgtgaactttcctagttctctatgttgttagtgcagccagcacccagtggggacctactagaaaaaggaactggcatgcacacgtgcccagcaggaaaagcttcgtcttcacgtcggctgctgccatccagaagaggccctggagcctcacgccgtcgaggctgctctcaggcgttctgttccgggcgaggcttgtgctgcaaggaagggcaccagcatgcaggctgccactggagggtccgggtgctgcgggcagagttcagcgcttgtccaccctcccttagctctgactcagtgcatcctactgtggggacatctcgtgaggggacacgaaatgactgatctcaccctttcccagtattcagagctgtgaacccctgtggcgcaggactggcctgtgtctgttattttggttgtaaatcattctcctgtggaattggcaaaagctacatttttactgtccttaccagcaacagtttgcgtcgtcacatgctgtgagtgtgggctgtggtgtgtccgtgtgtgtacatatgtgtatatgtatatatcacgcagcaggagtgtcattcatgctgctgtcccctggtgaagtgacaagtacaattaaaggtggctctgaaatggcctctggtttcttgggagtcgggcagggacctgcaggaggctttcccagcaggtgcacagaaggaagcgctgagcccactgtgtgcagagggtgtgtgcccagggcactgccacggcccccaccagcattggcctctgctctgcagggtggggtgcccatcctgggggctgtgtgtcatgctcacctgacccaggtgtgtgtcccggtgtgaaatcgaggaggggactggaagcccttccctgccttgaaacatgaaagctgattttctgagcagcagatacggtcagtggcaaagctgcatctgaagggcggcctgggaaggggccctgtgctggccccgggtccgccccagaggagtccacacagcaccacctccagaaggggctgggcccggggtcctgcaggcggcaccttttggtagagtttgtttccctggaaaatggggaaaatgtttcaagccaggtgaggggggaagttaacactgaaatatgtattgtttttaaaaatcaaatgcacacgcatggaagctgcttgtccatgcactggttttgtcactggcgtcctggaatccgaccgtgttggggtgcaggcgctgtcagactccggctgatcctggctcgagcacacacatctaagggccaggctggttccgcatggtgatctccgtcttgtatgtctgaatgttggcctaaaataaagattactgttgtaaaataaatgttttcactgcggaccccacgtatgtcttactcgctagtcccgcagatccctggttttggagagcagcagctgatctcagccctccacaccccttgcggctggaaccttgcttccctcctgcctggtccagatgtggataaatgccccctcctcttgattgtgttttcacctccgttttctaaataccaagactggagcaaagaggccaagcgtggtggctcatgcctataatcccagcactttgggaggccagtgtgggaggattgctttgagcccaggagttcaagaccaacctgggcaacagtgagatcgtgtctctacaaaaaagagtttaaaattatctgggtgtagccgtgcctgaggtcccagctcgtcaggagggaaatcacttgagcatgggaagtccacgctacagtgagctgtggtcacaccaccgaactccagcctgggtgacagagggagatcctgtcaacaaactaacaaaaactcagaataacgtaacaaacatcttgaaatcctctattctgacttaagaaaaacgaaggaagggccaggcatggtggctcacgcttgtaatccccagcactttgggaggccgaggtgggtggatcatgaggtcaggagatctgagaccatcctggccaacatggtgaaaccccgtctttactgaaaatacaaaaaaaattagctgagcgtggtggtgcgtgcctgtagtcccagctactcaagaggcttaggcaggagaatcgctagaacccgggaggtggaggttgcaacgcaccgagatcgtgccaccgctctccagcctgggtgggagagcgagactccgtctcaaaaaaaaaaaaaaatttgagtcagattttccattttaaaaaaatggcagcatccaagaccgttttgcgtctctccccatttccatcctctgcttccatagctttaaactctgtctaccactgtcaggtccagtaagacgtactattggtttatacctttttacataaattgtactacaccatagtactgagtacaccacctgccttatgagtttgtttgttttttttttttttgagatggagtctcgctctgtcacccaggctggagtgcagtggcgcgatcttggctcactgcaacctccgcctcctgggttcacgccatttaggaaaacgcatgcctcaccctcccgagtagctgggactacaggcgcccgccaccacgcctggctaattttttgtatttttagtggagatggggtttcaccgtgttagccaggatggtctcggatctcctgaccttgtgatctgcccacctcggcctcccaaagtgctgggattacaggcatgagccaccgcgcccggcctgtttttgtttttgagacggagtctttgtggcccaggctggagtgcagtggcacaatctcggctcactacaaccttcatctcctgggttgaagtgattcttgtgcctcagcctcctgagtagctgggattacaggcatgtgccaccacgcctggctaactttttgtatttagtagacggggtttcaccatgttggccagcctgatcttgaactccggacctcaggtaatccgcccgcctcggcctcccagggtgctgggattacaggcgtgagccactgcaccaggcctaagtttttcatttgatacagtagtagttaagaaatcaagccgtgtggttatattaggtctggttcattttagcttctgtacagaacagtcacgaattaatcacagtcggtcctgggcaaactgaccacaggtttttagtttctcactgtggaaacaaagctgcctgaatgtcgctgctgagttgtctcgggtgggatcgctgggagcgggatctggaagccttcccttgactggtggccccacactgccctgcaaagaggctccccatcttctcgctgccccttctagccttagcgttgtcagacgtttttttctggcttggtctttgaattttcttaattaagtagaatccacgtttattaagttcagttttttttttctttttcctttgagacagagtcttgctctgtcatccaggctggtgtgcaatggcgcgatctcggttcactgcagcttccgcctcctgcgttcaagcgattcttgtacctcagcctcccgagtagctgggactaaaggcgcgccaccacgcccagctaattttttgtatttttagtagagacgggggtttcaccatgttggccaggctggtctcgaacctatgtaggcctcccaaagtgctgggattacaggtgtgaggcagcgcgcccggcctatgttaagtattttatatatgggattcttacagagaaatgttaacagcaagccgagcactggacactgggtggcgggcagcaagacccttgccagggagggttgtcggccctgtttctcctggtccaggggaccgcggttaacaggcgctgcggcaaaactctccgtccgcccagcgccccaggaatctcctccgtctccaagacggggtcggaccaccctccccgctccccccggctatgccttccttgcgccccgctctccgtgaccgaggaacgccaggaagggaccacttctagcgccagccccgctgctcagggtcgggtggggggcggggccagcgcgggggcggggccggctcaggggcgtggtcactcggtggggcccagcgggacctggcctaccaggcggagcgggggctgggcaggggcgtggccaatcgggaccggtggggcgggcgagtggcgggagcgctgcacccgcagatgggccccccacgtggggaccagcgcccacccggcctggtcgcatgggcaatgggagaccccactgcagcgcaaggtctcgcggcatctgggaagaccggccttacgccgtccctcccttcgtcagcagacccctgtccaggatccgggatccggcataatcgaggtgccaggctccgaggacgccacgcttttggccgtggacttccacgcagaaagacactggcgcctgagaggacggggacgaccgtgtcccgtgtcagatgcgcctggcccacggctgagtccccagcatcagccctcagctccacggctgagccccgggaggctgattcagttatctgggcctctccggggcccgacgtgtgggcgccgcgcgtgcacctcctcttcctcagtaaaccacggcggcgactcctctcggggagcccggggggggcctgctcggaaagcagggtgggcaggacctaagggaacccacgcttgcgggcgtgggcacggcagagagcacgggatgcgggtgggcctccaggtctggaggggtgagcgaggcgggccctgagcagcagtggctccgggctcgtgggccccgggtggccccgcctccaagcgcaggcccccacttccgccctggtctgcctcctggctttgctgcctccagcgacttgtcctgacgggaaggaccctccccccccccaactgtggggaggaccctgatggtacaaatttgtgggtgggggcaaaacagcctgcctcttgtgagacccagagcaccagggggccctgtcccctccctaggtccaggccaggtggccaccaagctatgggttctaggggccccatctagcagagctaggagctgcagggcccagttctaccccttccttcatctggcacaagtgcaagactgggaatgcttggtcctgcaggggagaaggcagggccctcagctccctccctccctccccatgggagtctccacaaatgcatgcctcagccaggacacctctcctgtgctgtaaccaatcacaccttcatttttctaaagctttatttattttataaaatgcatagaataaattatactagtaacattttaaaaattaacatctttgtattcagcagtcctgggtcaggaggcaggaggagggtggtggggacgggatggctcactgggcagctaacccgtgtaggccacttcctcctcgtcactgccatcggggaccgcgtctgtcccaaagtagcggtcgccaaagttccctggaaaaaggggggggggggtccagtgtggtggggcctcccagggccacccaccctgccctcatgtgcggctgaagggcccgggcagcctcaccaatgcctgggatgatgcggaaaaggtcattgacccgcttgtccaccgccgtggtgatgattctcactcgcggaaatgcataggccactgagtgcacgcccatctctgccatgagcagcgacagcaaaaagatcttgtcctcaggcacgtcgtggtcctaccgagtgtattgggcaggtaaatcccacctctgcctgaacctgccccgcctacccagggctcactcaccaggagcacgcgcactgccatcatggccgccgcgcccgtggacacggtgcagtccatgaggatcacgtggtcatcgctgatgtccttgggcagcctcaggtagtggagctgcgggcagcaggggtcaggctgcaggtggggctccctgcgtccccttgctgtgagctccctctgccccctacccccgggctcatcaccccggctgcccccaggcacctcgggctccccggtaagctggttggtctggatgaggatggtgccgatgcgcacgtctttgcacacagcgcgcagcgcgggctccatggtttcaccggcgcgcagaatggacacaccggtgatctgcggggaggggaggctaagcgcccacatcccgccccagcagcctgtcccgcgcccaggtgtgcccaggcaggtacctgcttccccgcatagcacttgcccgcatagtcctgcccctgcggggtctgtacgacgcagtcctgtggggtgcagggtgaggactccggtgagcgcagggagctcgcaccggctccaagacccaccctccacctcgcgggctacgggctacgaacctgaaagggcaggaaggagagcgcgtgctcgatgagcagccgcatcagtctcttggagtagaagatgaactcgtcgcgactggtctccttgtccctgtggggccaacagttgagcgggagcacgcgcccggggccgccccgtccccaggtgggccctcacctgatgatggtgtgcatgccccgtacctgcggcgtgctcttcaggacgctcagcgtccggggcagcgggtggcactggtgtgccgaggccagcgcagccctggggacaaaccgatggggaacactcaagaagggggtcttttcccagagccctccctccccacaggacggctgtgcgtcactgtgaggggaacacacgggccaggcacagcacgaggtgcagagcgggcctgacttctgcctggggctgagctggggggagacgtcgccctacctgagctgtcaggcaaaggcgaaagatggcggcgaacaacggggcaagctcaccatcaggcagaaagctagcggggtaggctgtgagggcccctcccagtgcgggacccctcctgcgctaagaggaagcagaagtgggccgggcacagggcgggctcacacgtgctgataggtgtcataccccagaatgggtagcttgtccccagcctctccccgggggaactaaagctttgtggggtcaggccccgccctggctcctccccgaggtggtgcgcggcccctcaagagaggggggtggggggcaaagctggctcagtgtctcttggctgtcccgtcccgccccgctgcccaagcctggggatggccggggcagcagcaggtctaggagcgggcaggaaaagggcggggtggaggcaagaaagaggtgggacagggaggaggcaaagccggaaaggggcatgacaggggcagggaatggggcggggcaggaaagggggtgatgcaggggcaggaagaggaaagcgacaggccacagaattgggtgtggcaggggaaggaaagaggcagggcacggaattgggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccgggaatggggtgtggcagggcagaaaagaggcgtgacagcggcagggaaaggggcggggccggaaatggggtgtggcagggcagaaaagaggcgtgacagcggcagggaaaggggcggggcaggagcaggaaagagggcctagcgggagcagcggggcaaggggctacgggaaggcgggtcacacagcagcaccacggagcacactgctcacatatcccaacgtagcttcctctgcttgccaggtgaagagcatgttcagggagggaacaaggcaggaaacgggggtttacagagagaaggaagagaacaaagagaaggctgcttagttggggagcagggcgttccccgcaggcctgaggaggagtgtgggcggtcaggcccccagccctgcctgaccctccctcctgcccccgaccaaggcttcctggggctgaaggaagtgagtgcagccacaggccaacacttccttggctgaccagacgacggaaaatgtgtctggctgcgttcaggtgtttttccaagtttgaaaccctggaaagtttttcctctcagaacaaaagcttcaggaggaacctgacgggacaagacctgcgggttcctaggccgaggagagggccaagcggagactcatgcaggcaccggaagctggacggctggtggacgggccctggaggcatttccaacatttggcaaactctttggagggctctgaatgtgagggctctccctccaggtggctcagtcaggagcctcccaacccacagaaggcagggagaagggcaggtcccttgtggctgacccccctgcatgcctgcccttggggagggacagtgggatgcggccccggcccagcccaagcttcttgctgcagttgcccagttcctgctggcagagctgtgcgggctgcgaggacagagctggggcaagcaggacccgggtgggtgggaggacaggcgcgaggccctccacctgcaaccagggaaagctgactggtccgtgaggctgggcacaggaggtacagcaggctccctggctgctgggacatgtctgtagtcactgccccagaggcctggcagtgctggctcaggaggacagctgtgctctctggggtcaaatcccatagacagactcaggagtcaggggagcctccagcaaagtctggccaggacagggtcaggactccgtgacgctgggcaagctacttcacgtctctgtgcctcagtgtcctcatctgccagcaaggggaggcagaagcagggctgggaccactccacaccaccccttctgtgactggggaagagccagctgcctggctggatcacagcccagaccccagagctccttggaggtgttggaagtgcctccatctgtgcagacagctgtgcaagtcttacctgacgctgagttcacgctgtggcagcaacacaggaagacacaagggaacggtggcgcgtcagtgaccagggcaggcggccaggccacccccacccaggaatggacatgctgcaggcccgcggggacacagccagccatggggggtggcaagcttctaatgcctgtaacctggggaccacctgggccagacctgcagttctgcgttggggcaatcagagccaggaccctgggctctgttctgcaggcctcaggccttcaacatcctggtagggagtgtgttcagagccactcaggctccaaggcccagccatagaatgcctcagggagcaggggacctctggtgggggtgtcgctcctggggtgaccccctgagaaagagaggagcctggcctggcgtgggactcagcagtgaaaccccacaatcctgggccagcaggtcatgcctgtcttcccaaaagctcaggctgggtgtgctgagcgggctgcaccctcggctgggtcctgagcacctgtacccccaccccagcttcctcagggaacccaggccctgcacagcacaacgggatggggtctgggctggacaatctgactggccaagcaggctcaggacactcagggctggcacctggcaggggacagtgaacgcagggggatgaggtgaccaggccactgggggtggtggcagcggagaagtgggtagaggggctgggggctaggccgtggggacgtgggaccccgctcacctcctccagctggctgtgcacgtgctgcacaatcaggtcgatggccaccgtgttgccgctccctggggcgggatgggggggcgggtgaccgggggctgggccgttggcctgcccgacacccacccaacaggcagcccagcaggctcacctctggggaccacgatgtctgccaggcgcatggtgggctggatgtactggtcgaaggagggcttgacaaacttgttgtactgcttgatgacaccctcgatgtcccggccgcgctcactgatgtcccggcgcagccgccgtaccaggcggatgtcggagtctgtgtccacaaagatcttcatgtccaggagctggtggagacagcgggccagtgagtggccagatgccagcagtgggcatggagacactgggaccagcccctgcactgaggccgcctggtccgtgggcctggccagagccacttccccagggcaccctggcaggtggggaggagtggggaggtgggggtgtctgcacctggtccgtgggcctggcccgagccacttccccagggcaccctggcaggtgggaaggagtggggaggtgggggtgtctggggatgcggtgctgcccgtcaggggcttaggtgaagaggcatggcatggtggctggctaaggaatcaggcaggaatggggctgggcacatgtgatctccttactttgcttggggtaacttgcaccaacacactggggaatgggggacgtggcgagtttagggtctgtccccatgctcagcacacagtagttggcccgtgaagaggccttgtggaggctgggggctgctatgtgccggatgatggagtcctctgggcctgtacaaggggcaggacctgggccctgggatcaggccaacctgagtcacactcagctgtgtcctgaaggcccccttgagctacagcaaaatctctcaaacacaccagccctgggtcctcacctgtccgtcaggaccacggcaagggacgagaacgccaaggacactccaggtatgcgcacaggcctcagccggtggagaggaaccactgcctcaggcagccacgctctgccttttggggccggcagatggacccagctgtggcatgcctggggttggggttggggtagggagtggctggcctaggcctatacagtgtggaggccttggggacagggcaggaggacgcacacctcatggacagggcggccagggctgagataccagcggggtgggtattcccggcgggtgcttacctccaacagtgtcttgtcagcaaaggccatgatgccctcaaagatgatgacgtttgcaccatacagtgttttctgtgaagaaacccaggagttgcggagcctggctcatgtgcctgcagccccccgaggccccctctgcagggccctggcctacccagtccttcttccggctgtgcgtggtgaagtcataaatgggcaccttgacactcttcccctgcttcagcttcttgagggtggaaatgatgaggtcgaagtcaaaggcatctgggtggtcgaagttgaagttgttgtgtgcggcctgttcctgctgctgctcagtcagcacctggtgggggaggctgtggagcagctgtgggcacagtagggccctcacccaatgccagcggacaggggctctaggcctcccaggagcagccacgctggggctgagaccagggacctacttttgcagggggtccagggtcagggagaggacaaaggggtcctcgggggagctgggcgggggcccaccttgtagaaggagtccatggacagcaagaccacccagggcacatccagggcctcgatgatcattctggccacagtggtcttcccagaggcactgccgcctcccaagcctgccggcgggagtggagaccctctgtgaggaacaggcaggctgccggcacagataggtcccagaggtgcccatcccgctgccgctgcctgcggttgcccggcttccttctcctgctccacaggcactggaggggagccggaggcaggcgtccggcagcaggtcccacccccccgctgctctcaccgatggcgaaggcctctttggattgcgtgccgtgttcattgtaccagggcggccgcccggcggtgtagatggtacgcttgcttgtacgcagcaggggaggctctgacttgcactggctggtggtccgcttccggggagagcgcccagtgcccacaggtggcaggagcctgtccagggactctgcattgctgctgcagagagggatgtactcggatgtggcccagagctgcccacctcccaggtacccgctggcatggccggcccacagggcaccccccccaccccctcaacaggcatggctgaggcgggcaggctcattgggggtacataagaactctgcctgggctgggcgtggtggctcatgcctgtaatcccagtactttgggaggccgaggcaggtggatcatttgaggtcaggagtttgagaccagcctggccaacatggtgaagacccgtctctactaaaaattaaaaaaaaaaaattacctgggtgcggtggtgggtgcctgtaatcccagctactagggaggctgaggcaggagaatggcttgaacccgggaggtggagattgcaatgagctatcgtgccactgcactccagtctgggtgacagagtgagactccacctcaaaaaaaaaaaaccctgcctcctgcctgcagctgggccacaggacacacagacccaagtgctcagcctggcacagggcctcagatcatcactgtccacacagcaaggacagaggaacagcaaacaaggacaagggaaggaggagaggcgctatcttggggccatgctcatcctgctgtgtggacaggcactggctgggccaggctctgtcccctaggggactcaaggtgggcctgtgaaaggcaggtgagaccccaaaatggaccacgttcccttgcaacccggcacactctctgggcagccaaatcgctgccatgctgaaggctgggtgcccaaggagacgtgagggcggcgtgtgggtggaggcgagaccagaccaggttgtgcgcacacaccgagggtgaggtccccagacaggaccaggctgaagggctcagggagagaggcagagggctcagccaggacctgattctcctgcagtgacagcaggcccagcacagtgcctcggcctggcctctctggctgtcagagtgccggatgggggaccctgcgctgggagccttattggaaccccattcattcttgctgtggcccctcctgggtccccaagacagaaacctccggcatctggcaaacaccagagaggaaagtgctgccacctgtctgggctgccgtgagcctgcccagggtaagggggagcccctaaagtctgcaagggggaaatcaacgggaggaagacacaggcctaggctgtgtggcatctacatgcactgcacgtgctggaccggcactcaggcgcctgccaacttctccgtcagtttacaacctcaagtgggcagggggccgtgactggccatggagccctgggaggggcagcctctggggaggctcaatatggccgagtgccctgctggggggttgggggggcatcaacgtggcgcctgcccagtctgttctgagaggctcagatgcagagcctggtgtgaagatgccatgagacaagacacaggtccggcagaaggcacttgtggccactgcccaggagacaccgagctggctgtggtggcctcagcaccatgtttcaggtctccctgggaagctctcaggggtcagcaccttggccctgcaggtcatggcccactcacatggggagcaactcagaaccacagtcactgtctgtgcagggcagagcccccgggggcaagagggaaagctccgcaaacggcaggaccgcctctttgtagcttcctgcagcggcacagtctgtccaccgcgctccggagttccacaggaaatggaacgctccacagatgccagttacgcccgaaaacgacacagaacacaggtgcggacagggaacggcatcctcagagcatggtcaggggagaaaagcaagctggaaggagagatgattccatctgtataaaatccaggaaacgaaggacgctcaccgccatgcgcctcggtgtgaggagggaggcgtgtgtgagagggaggggatgtgtgtgagagggagggggcgtgtgtgagagggaggggcgtgtgtgagagggaaggggcgtgtgtgagagggaggggcgtgtgtgagagggagggggtgtgtgtgagaccgagggggcgtgtaagggagggggtgtgtgtgagagggaagcgtgtgcacacaccagccctaaccatgatcactctctggccaccaagatttggaacagcaacttctgtcacatttgaatgtttttaaagcaggtgccactttgttgccataaaccaaaccgtagtctgtctttgaaggtggcatctccagcgtgggaacactgattcccacctgggcactcctccccgtgcacccgtgacacccacagccaggaggacagtgtccgtgtgcacacacagggggcagtggaaggagggagcccagcccgacacgtgacagctctcctgggcccagagaacagtgtggcagcatttaaagcagcaaagagacccgccgtctgcacctgacggggaaaacgcgctgtgcctctcctcagagacagacaggtctgcctgtttccatgccaccatcaggggagtgagcacggggaataatcagccaggcagcctcactcagcctcacctcggctccggagatcgttctggagctgagtggtgacgtcagcagcagggctgagcacaaacaacaaggccaggcgccaagacgaccaggcgagggcggcccgggggacagcaccactgcacggtgccctgaagggggagcaggtgccacggcacttccccgagaccgcatgcgggggctgcagctggaatgggacctgcaccccactcaggtctgcctgaagggctgtcagtcaagaaggaagacgggacccagcaaacagaagccacgacctcccagcggccctggacacacatgaccaacgcaccagcagtaaacaaaagggcctgcaagggtcacccccggggccacccctcccagcaggtggtgatggatggcccgcagctgtgcacagtggggcagtcctgcttaggttcagcagcaggttcccagcagacagaaacgctctggtggccctggaggccgtggtgggcagagaacaaatccaggcggcccctcccctctatgcctaaccccagcatctgcagggaatcacccactgtcttcaacctcagggaggaagccccgacacaatctgacttgcaaagaggctccccagcgaagctcccagcaccgcccttgcggctgcctgcacttccgccatgcaccctggattccgagggtgagcccgctaatgcacaaagctgggactaacttgagggacagacaccagacggcagaggccgggctggcaccgtgcctgctccccattggtagtctcctggtgctcagtcctctccagcaggagccttccaaccccgcatttgtgactcttcctcatcctactgaagtaacaaccccgtcaccgcagatccctcctgaggcacacgctgctgacagccaggcgctggcccttctgctgggagtggtgcccatgcagcggaacggtcacaagcaggccaggacgatctgccagaagcccgcctcaccgcaggcctgtgacggcgtcaggctgagtctgcaccgagcccagccccactaccttctccaaagctggtctgtctcagagccaaggacaaagcctcaccccacggttcacaagcagcaccccttgacaggaaagttggccgggtgtggtggctcatgccttgaacagtcctttggaggctgcagtgggaggactgcttgaggtcagcagttcgtgaccagcctgggcaacatggtgagacggtctccacacaaaaaactttagaatattaaaaataaataaaaacagaggagaaagttgcacagcaaacctcacttcctgtgcacagatggacaggagtgcttctggccacaacaacaaaaggttaattccaacccggagggttccaagccgtaaccaacacaagagagacgcgcccagaccaacagcctcaagcaaaatggcaccttcgaccctgggctctgcccggtgcccgagagcacctgccagcctgtttgattcctgatatccacagacatgcaccaaacacaggtctgagtggccaggaccacagcacaagtgggtgcccctcacggcagagacctccagtcgagactcacctgccttctgctccaagggcccggcaccctgagatcctgatgccagggtaagctggggggctgctcatggtcgaggacacgggtgggtgctcctgaacagcagagtggccccaggggtggatgcgtgggggctcaggcgcaggcagccgtgggggacatcaccacctcagacccacagcagtcccctagggcagctcaggagctccggccacctgaactggcccttccatgggcaggaccactcctgtgggcagcacagtgggtgcagagccgggtggctggggtgagacccttggctggcagaagctgcctgccaaatgtcagcagaggcacagcagctaggaggcccttgaagcctccaccgtactgagggaacagcactcactgccgtcctcagaggccaaggccacaggcataagaggatcacccagctgggggcttgtgtatgcctgatattaatagcgctggctttgcctggtgtggccctgacaatcctcgggccagccctcggtgtgaactgccccctcctgtgtgtgggctggcacattcggccagcctaggaccgcaggcctgcggaggaccactgtgcgccgtgtgcctgcacccctcctggatcccctggaaaaagctacagtaccccggcctgcctggggctacagagtgaaccccccgcagcaggacaaggatatctgaggcgcctcttggccaggtgtcctgaacgtcagtgctgagctgggcaccccatccctagccccagagtgcttccgacaggcataaacaaatctgaaactccaccctctggcaccatctgaaaataactgccttgccctacccccactcacgggggatcctgcagggacctgcagccacccagggctcaccacccagggctcagcagagcacaggggacacagccacctccccgcccagggctcagcagggcacaggggacacagccacctccccgcccagggctcagcagggcacaggggacacagccacctccccgcccagggctcagcagggcacaggggacacagccacctccccgcccacagaaacagggtttcggccccaccctccgcagagtcagtcaaggatgtgcacagagaagtcctggcagccctaagctctctcccaggggcagacaggtcagccatgggtgtcagcttcctcctaccatgggtttctcttggagcttctagtactgaggcaggggctgccagaagctcagggaaaagggaagactccacatggaggtcatactcctcaatagtaggccactcctgggagctgcctcagaggcaggaccggcccatctgtctgtgtccacaggtgcttcctctcctcattctgctcccaggaggcggctacatccctcacttgggaagtgggcaggagacagcccagggtcggggaggcggaggctgtcctgagcaggggcgcagagtccgggctcctgggggccatgccactggctgggctgtctgaacagcagagtggacgcagactggtcttgcctggcatgggcatgcaccctggctgccctagccggccaagaggcaaggctacaggcctggggaagccagcactgtgctggccaggcgagggacggaggagcccaggcacgcagctgtgaatggaaccaccaggccccaccctggaatcacgtcgcctcgctgcaggccacgtggtccccaacatgcccctccacggggctgctctcggccacagcagcccacggcagggaggggccgctcacggtggggaggggtagcctgccctggtcctattcactggtgttcctcccaggttctaacttcctgagctgggccggtccagagaactcccattcccacgccacccacaggtgctgatgccgcgctggggtaagcgctgcccagagcaccttctgcctaaggcttcctccttgcaggtggggctgtctgaggcccgtggtgctggaggctgcctcagtcacttcagggcaccccttgcccttccctcaccttcagccatcctactctgggccacagcacagtcgaatgtggctcagtcccctccacggagccacagcttgcctcagtttcctcctcaaggactaacagcaggttcattacaggtgggtcagctcataaagtccaaggcagatgcctcatcggtgatcaggccccataactgatgtcatcgtcaagaaataggcacaggtggccgggcgcggtggctcacgcctgtcatcccagcactgtgggaggccgaggcgggcggatcacccaaggtcggagtttgagaccagcctcaacgtggagaaaccttatctctactagaaatacaaaattagctgggcacggtggcacatgcctgtaatcccagcactttgggaggccaaggcaggtggatcacctgaggttgggcgtttgagaccagcctgaccaacatggagaaaccctgtctctactaaaaacacaaaattagccgggcgtagtggcacatgcctgtaatcccagctacttgggaggctgaggcaggagaattgcttgaacccgggaggcagaggttgctgtgagctgagattgcgccactgcaatccagcctgggcaacaagagcaaaactccatctcaaaaacaaaacaaaacaaaacaaaagaaatacacacaggcagccgggtgcagtggctcacgcctgtaatcccagcactttcagaggctgagcgggcagatcatctgaggtcaggagttcaagaccagcctggccaacatggtgaaaccccgtctctactaaaaatacaaaaaattagctgggcgtggtggcgggcgcctgtagtcccagctactcgggaggctgaggcaggagaactgcttgaacccgggaggcggaggttgcagtgagccgagatggtgccattgcactccagcccaggactctatctccaaaaaaaaaagaaaggaagaaaaataagcacaggcatgtgtggagacctggaggcagggctgcccctcacgaaccatccacaatgccaaggaaaccagaagcaaacgtccagcagcagggagcgcagggcatgtgaaaccgacactgaggaaacagccacgggagagagcacacagggagaaaggaaggctcgggcactcccttgctgtggttcaggcctgttctaccacccctggggtcaccatcgcccacggaccttcctgctgggtgcctgtagcacggcacctcctgacaggtcaggtttaagggaagtttgctggataactaaaatgaggctggggggaggagggagcagggaggagctagcccacaggagccaatgcaggcctgaccccactggtgccggactgactcagggagagtcattagggctgctttctcaggctggatgagcactgggggttgggggcttgccctggcccaccccaccactcaggaaaccttccctcagcaggacctgccctgcacagatcatgggcagcctccctctgctccccacttccacagccccagactccatctcaaccgcagccaggagtcactgctaacaccacaaaggacctgttcctgcaccagcacgggccagctctgggggcaggtgcccaggacagagtcacgagtggcaagcagacaataaacaacaggcaagatggacagactgattgccgggaggatgtggcaggaggcactggaacggtggtggaggaaccccagccctggggacagacctccacccgtgcacagacctccaagctggagcctgctctggaacactaagggcagcagcagaggttgaagaggggcagacgcaggaacgttggggacacgctcggggaacagtgagaaaagccctaggctggggcagaggaagtcctcgatggcacaagcatcaggacacaaagtgcaagaaatgtgcctaagacaagaggcagttccagggcagaccggggcccctggagaagggtgctgcaatctatcctcactgcctggagcttccctcctgtcccttggtaaccacaccaaagaaagataacaacagtctctgcctcgtgggacacagcgagggccaccgtgcccagcccaccgtctgtgcacagggcaggcccagatggctgctgccaccaacctgtgtcatccaggagtgcctttctcaagagctctcagtgcttatctagcgttggcctgccccacctcgggttaaatcaaaacctctttggtggctgggcgcggtggctcacgcctgtaatcccacggaggccgaggcgggcagatcacctgaggtcaggagttggagaccagcctggacaacctgacaaaatacctctctactaaaaatacaaaaaaaaattagccgggcgtggtggcgcacacctgtaattccagctactcgggaggctgaggcaggagaattgcttgaactgagctcgggaaagggaggttgcagtgagccgagatcgagccactgcactccagcctgggcgacagagtgagactccatctcaaaacaaaaaaacaacgcctctttggaaccagcagaggaacagactcaggccctattagactccagccatgcaaagttcctagtcactgcccactgggagggtgtggacctgaagggacgcagggccaggggaaagctctttctgctcagcagctcctggagaggagcgaccctgtgccgggacacccttccccctgcggcatccagcgcagcccatctctgagggagtcctggctcacagcgtttctgacaggagtcacagcctgaacccaggcaagaggcgcctgagtgggaacaaccccttcctggggaccccgcgggctccccaagggacacttcagacccggaagggaggggcagcgcccagagcgccctcttgcagccccgggcactgcgtggccaccgccccctgacggccacggccccaaaggcgccgcgcagggcccggctcccagaggggccactcggggtgacgaaccggggtgggggcgggttcctcccgctgcacccccacaacttccccacttcatgctcttgcaaagcccccgcagaggctcgaaggtgccacgcgcgtgcgaggcaatccgaaggcaccgtgcgccgcagcacctccaaatcctaagccctggcctcgcgggtcgggcagggccacaccccgagccgacaacatagaccaactcgcacagtcgagcaggcacacagcccgccgggcgctcgaggccgagggccccacccaccgggggcagagaccaaggtcaacgctgggggtgcgcacccggactccttccccgagccccgaggagcctgccggcttgggccaggtccgtcctcccggccgcttcaagcccgcggggttccacccggcacgtgggagaacggggcgccgccgcctggcctccgggagtgggggacttgggctcgcggcggggacggaccacccgcccagctcggccggatctgcagccccttcccgctcgccagtggagtggaggcgaggcccacgcctaccggtcctcgcacgcggtctcgcttttctcagcctgccggcctggtgtgtctcgggccgtaggtggcgacgtgggcgaaggatcagcgtccgcgcgggccgggggcgcagccatggcgctcggaggcctctttgcgggcctggccgggcggcgcgcatgggccgccgggagctggcgggtccctctcttgcccaccgcggactacaagccccacaaggccgcgcgtcgcggactacaagccccacaaggccgcgcgtcgcggactacaagccccacaaggccgcgcgtcgcggactacaagccccacaaggccgcgcgtcgcggactacaagccccacaaggccgcgcggcgggcatgggggacccgtagttcggcagcctccgccacgtgcctggagggccccgccccctgtttttcaccacaaactgagccgcacaaaaaccctggaaaaaaatcaataaacatttatttgatacagtcattttaatacatacagtgatggcccgtccccacgccactcgggaccagggcgcggggcggggacgaggaccggggacagatggtcacaaggcgggcggggcccgaactcaccgttgaaacatctcgcaaataaacactttgtagatagaatatatatgtatatatatatggttacaagtgatagctggaacctctttcaaaatgcacttatgtactgagaactggcattaaaaaacccaaaccaagaaacccaaagcacgggacgcccggccgcgaggcaggggaaagcctggggccccagacccgggcctgggggagccgcctggggccccgccaaacgcggcacacggggacggcccctcccggggtcaggctcactggctccttcccttcagcgccaccaggcaggagggccaacggtcacacaggaggcaccctcacctgcctttgcaccagcaaataaagtgcatcccattttcgtgtgagcgtcggcccggtgagtcagcccttccgggccctttcctgttctcagggcagggggcgtgcgctgagccagaggtagatctgcagaaagggccccgactgggcctcgggcagggccggcgcccaccacactctgggggtcagctatgctggtccctctcactgagggctcctggaggcctatgtgggccagcgtagggagtgggcagaccctgctgagctccacccagggccccaccccttgggaggagggctctgcggaccagcatgtggcagagggagggcagaaaggagggggtcagacccaacagccacttctggcagtagcccccacgcctaccttaaagacaaagggggttaaagtgctaaacatcaaggtatccaggactcctcttcccacaccagggattatctgtgggctttgggagtgtcccggaaactcacccccagcaaaaaccagaccctcttctcttctccccaagggccaagtacctgagaggctggggcaggcaccacaccctgcaggtgttcaggtccaccctcctcccgccattggtggcaaggacaaagtgcacctaggcccccgcccagtgcctgctcccctcccctcccctcccctcccctcatgaggctgccccagcagcagctgccagaccccaccctccacctccggctcctccagctccaccagtgaagctctgggacacaggaaggaatgcctcccccgaccctctgacgctgggtcacgcccatctctgccccagcctccatcctctcatcaggccgaggtgtgcgtgggtggggggagtccgggtctccacacccactccctggcacatctggcaagggctgctgagggttggagccttctggcccaaggatgaagccagagacaggaagtgttctgcaaccccagtccccaaagtgctcctggaacttgtctccctactactgcaggccaagcccagtggggccccttctccctggggaatgggggagggtgggtgctgggggcagaggcagtgcccagtcagtactgcctccctgagcagcaagggaccccaaccccagagacccacgccctggtccagcccagcccccaggcccaccgtctgcaccaggaaacccttagcaccaaatgtcggattgcgagtgtttgtataaaaaacaatttaaaaaaaaggttgttacttgtcacagcaacaagactggcatccactacacccaggagacacacgcacacgggcaaacatcaaaattctcatcgtccagggtcagtggggccgagccctcagcccactcccacccaccctggaaaatggcctccctccaaacctaccccctctgagcctcatcctccctgcaatgccgtggttggaaggcaggaccccagggagggagccacaggctgtggccacctcttccaggcaccctggactccctgcctgacccctgccctacctatagacccagccgtcctcagggccacaaaggggcaaagacagctctggagctgccatcaacctgctgtgactttggccaagcccctcccctggctggccttcagttcccatatcaaatgaccacacaaccagaaacaatgggggcaggttaaaaaaaaaagtggggagggggctcccatgagagcttggccactgggcctacccagattggcagacagaaggctgcctttcccccagtggccactcagagccaggccagctctgcccagcttcctgccccacatgcctatgggccccagcaagaccccagggcccgaactagtccgtccctactccacgaggctgctccaacctaggcctgcagtgccagaaggctgaacactggaggagagcacactccaggggccccacacccccagggctggcagctgtgttgaagggcatcaagcttctgctgccctgtaggtacaagaagcaaaacccctcccttgccccaagctgggagaattacagacaggcctggggggcagggcctgagcacagcagggatcgcactgacaaaggaggagcaggggtgggggtagtgggcaggcctggagaggtagaaaacagaagcaaggggaccaagtgggtggccaagggcaggccggagcctgtcaggtcagcatggcagtggtcagacaggggtctgtcctgggaggtagctgggggtgctggagttccagtgttgggtggaggtgaggccaggatggtggctgcccgtgccaggttgctcaggtgccctcaccagcccagaaccacaggtcaccagggatgcctgagccttggggtagccagggaagggacccggcagggcctgaggaagcggagccggggggccaaaggccatctgcctactctgcgctgcagcccctgtggcaccaagaccccagacacattcccatgaggaggggcaaccctcctggctattgcacttctgctgggcacaccttggggagccccaacccaggtgtgccctgtggcagccttaacaggggaagggccaccttcagggaagggagagtggctggctgccccactggacggatgaagaggcgggggtgggggatggagaactggaggacagaggtcccggagctggccctgccttgaacagagggcggtgtggcggctgcatgggggccaggccccacgcaccatgctcacttttcaggcgccttgctgactcccaccttccggccggtggagccccgggcccccttgtctctgcatcctggaggccagtcgtcccggcgcgggggcagcttggccacaggctcctctggggtccgctccttgggctttcggccccgcttctttccacctgccagatttttcttcttttccttcttgggcaccaatgagtcctggctcctgtgtttgggaggtgggtctgctgatgttcggaaccagttctggggagagaaaagcgctgatgaagacctgggactggatgctgagcacctgagccaggcatagcctgagagctgaagacctgtcagccttcaggaccaggcaagcacctgcagcagggctggacacagcctttaggaccaggcaggcacctgcagcagggggctgaacacagccttcgggaccaggcaagcacctgcagggggctggacacagccttcgggaccaggcaagcacctgcagcagggctggacacagccttcgggaccaggcaagcacctgcagcagggctggacacagccttctggaccaggcaagcacctgcagcagggggctggacacagccttcaggaccaggcaggcacctgccgcagggctggacacagccttcaggaccaggcaggcacctgccgcagggctggacacagccttcaggaccaggcaggcacctgccgcagggctggacacagccttcaggaccaggcaggcacctgccgcagggctggacacagccttcgggaccaggcaggcacctgcagcagggggctggacacagccttcgggaccaggcaagcacctgcagggggctggacacagccttcgggaccaggcaagcacctgcagcagggctggacacagccttcaggaccaggcaagcacctgcagcagggctggacacagccttcaggaccaggcaagcacctgcagggagctggacacagccttcaggaccaggcaagcacctgcagcagggggctggacacagccttcaggaccaggcaagcacctgcagcagggggctggacacagccttcgggaccaggcaagcacctgcagggggctggacacagccttcgggaccaggcaagcacctgcagcagggctggacacagccttcgggaccaggcaagcacctgcagcagggctgctgggggctggaaaggcggacaccccgagggcagctccagctcagggtgcaagcctcccagttctcccagggaagccagaccccactttgaggagaaactaccagatttctccacattggccactctcccaggcacaccccatgcaggccactgacctctctacccccaaggggtgcccaaccccagccctgtcccctcctgggctagcccccagccacaggccctggtgatggccctcgcacctctgcgtgggtcttcaggatgtggtatttgacgccactctcagaactgaactccttcggacacagcagacagcggtacttccctgccaggtgggccccctgcaatgcataggcaggccagtgccccagcccttggaggacccagatctgtcctaagcccctactcatggctaaagggtcagagtcagcggtggcccaaggaaagctgtggctgtctgtgccagacaatgcagggggccactgagttaccagggcggcaggggtggtaggggagaggaagggtagggagaggcaggtgcccaggggaagagttgcagacctttgccgagcatcccttattgtaagccagtgtgccatctgcgtgggtcggggtgcccacccatgcctacatggacgcagagctccaaggacaggactaggactcgttgtcttgtggctggggttggggcgagggaggtgtcctaggctggccatcagccaccggccagtctctgggttcgtggaagaggaggccacgtagaaaaagtaggggacaaggcagggtccctcactactgtgtgggaagcccgcgtggggtgagctgggagctctgagtgcagcgcacctggccgtggggcaggccccagaactgaccttactgcagctggcgagatgagccttgagtccggacacgctggagtagatggcttcacagcactgcagggaagggagccgtgggcgaaggcctctggtgggcaccccacaccaagatatacccctgccctaccccaggggatctctgaggctctttggggcaagtgagggggtgtgagtcctggggactgggcaggctgggcatgtgaggcctggggtgggcttgggcacctcctgaaagctctcagcctctgttcctgctcagagggccacacccaggctctggccctgtatggctccccacgccccccacccggctgcctccgctcacgtcgttgggacagttgacgtggcctttctccttcacttcattcttccatgcctctagcagctgggggttcagcgtggggagccctggtcgagtgtagttgagctgtgaattcgacagcaccagggtgagcctgaggccagaagacaccccagctgctctaagaacactcgcctcggcagcaggcgacactcgccgcagatggcgggggcagcgggtggcccaggtcacagcagtggctgtcccaagtctcaggccaaggcatgccccacgcagaggccacggcgctgtccacagccctggggggggcagctcacccgtgcggtctcgggcacaaggtcatccttcatgcgccgcttggtccagtcgcgggccagctcgtcctccgctatctcctgcaggtggaacaccgccacctgggccgacgtgcggcggacacgcccgcttggggtccgctccacacccagcgggtcctcagcctcaggggacttgtctgtgggctcctcagggggctggagggcaggaaggcatggaggctagagtgagccgcgggagcaagagtcaggtcagcgcgcggcgaggccaccctaaggccggtggacccacaggcctcccagtgtgctggggacatggctgacgcaggcaacccgagggaacacggaggtttcaccctcccgcccaccaggacacacgtctcttacagagaggggtgggaaacacacgcgttgggcggtacatggacaaatacagttggcacccaaggcacacggaacacacacggcacacaggaacaagcactgtgccacagaacagagagccactcacgggggccgtgtgctccgagcgcacgtggtagtcgtggccagccttggatcggtacgtcttgccacagtgggtgcaggggaaggaggggctgtccacctcgcagggcggcttcccgcagcgccgctggtggtactggtagcccatgaggctggagaaggcagccccgcaaccctgggggtcaggccagagggtgggtgagtggccagcagggcccccccaccccacactgccgcggccccccactgacctcctgggggcagcgcagccgtcccatctgcttcagcaccttgcgcagcctctcgcgctcctcctgctcgcccccttcggaggcctcggcgtcagagggctggggacagggtgagcatcggtgacccggcaccatcgccacggagccctgccctggccccgccccgcccaggtgttgggccaccgttgtccgaggttagaaaccgggggcactgcggtgaaggtggggtgcgaggtcagaggtcacgctggacgggagctgggggcccgacggtaccttggcactgtgctcggccatagtgtggtagttgaggccggctttggacttgaactgcttccggcagtgctggcacttgagtgcatcctgaagctgcagatggcccacatgtgagaagcctgcctggggccagggcgcctccctcccagcgccttccgggagctgccttaccttctgacacacctccatgtgcttcttaagccccacgagagtcttccgggtgaccacgttgcaggtggggcagacggcttccccgcgctcatggatggccctctgccactgctcttcagggccacctgtgggtaaggcaggggcctcgaaggcttgtgggggctgctgggtggcccagacgccaggcacagaatccagtctccacactcagcccccatccctgtgctgtgggatctacccgccgtctagagctgccctgagcccctgccaggcagcccctacctggagctgggtgggccacaggggccggtgcctccttgctgacagtgatgggggcagctggcaccttcttccgggcgtcctcagggcctggcccctcctgcttcttggagcggtgaactcgggccttgtcctcagctttgaccaggcctgtgtgcacacatggggtggagagaaacagggatgggctcaggggctgtcactcggtggacagccccagccctggaggtgcacaccgggctggggtcttacctttgagcccaaaggtccctgagatggatggctgctcccctgtaaactttttgggtgttttctgtttccttcctgactcggggagagaaaacgggggccaagattctggtgaaataaccgtcaggaggccgagcctgccccggccgccacccctggagctctcatcttactgtgctttgtgcgctccgggtcctcctcaggcggggacgcagggcctgcagccttcagtgcctccatgccccctgacggcctgctgcctggcgacaaggagccactgctggtgtctgcactcagctggaaggccgagctctggcccatggaggaggggccgtactccccattctctggcctggcctgcttgggtggaattgggcaggtgtccaggctgtccgcagccctgcagggagcaggtgaggtgagggccaggagggcctaactgtgggccccattacccccaggccgtggccgaggagcaccctgacctggaacgagcccccataccttttctcaccactgttccccgacctgggacaagcccccataccttttcttaccactgttccctgacctgggacgagcccccataccttttctcaccactgttccctgacctgggacgagcccccataccttttctcaccactgttccccgacctgggacgagcccccataccttttctcaccactgttccctgacctgggacgagcccccataccttttctcaccactgttcctccccgacctgggacgagcccccataccttttctcaccactgttccccgacctgggacgagcccccataccttttctcaccactgttccctgacctggaacgagcccccataccttttctcaccactgttccccgacctgggacgagcccccataccttttctcaccactgttccccgacctgggacgagcccccataccttttctcaccactgttccccgacctgggacgagcccccataccttttctcaccactgttccccgacctgggacgagcccccataccttttctcaccactgttccccgacctgggacgagcccccataccttttctcaccactgttccctgacctgggacgagcccccataccttttctcaccactgttccccgacctgggacgagcccccataccttttcttaccactgttccccgacctgggacgagcccccataccttttcttaccactgttcctccccgacctgggacgagcccccataccttttctcaccactgttcctccccaacctgggacgagcccccataccttttctcaccactgttcctccccgacctgggacgagcccccataccttttctcaccactgttccctgacctgggacgagcccccataccttttcttaccactgttcctccccgacctgggacgagcccccataccttttcttaccactgttcctccccgacctgggacgagcccccataccttttcttaccactgttcctccccgacctgggacgagcccccataccttttcttaccactgttccccgacctgggacgagcccccataccttttctcaccactgttccctgacctgggacgagcccccataccttttcttaccactgttccctgacctgggacgagcccccataccttttctcaccactgttcctccccgacctgggacgagcccccataccttttctcaccactgttccccgacctgggacgagcccccataccttttcttaccactgttcctccctgacctgggacgagcccccataccttttcttaccactgttcctccccgacctgggacgagcccccataccttttcttaccactgttcctccctgtggcacgaggtgctttgttctccgacctggtcagcagcaccattttgcagggcggtgtgtgtctgctgatagcaatgggcctgctgactgtcaccggcttgctgaccacaatgggcctgctgactgtcactggcttggtgaccggcacgggtttcgtaactgtcacaagctttgttaccgtaatgggtttggtgacaggtacgggtttggtgaccggcacagacttggtgactgtgatgggtttggtgaccggcatggccttggtgacgggcatgggcctgctgactgtgacaggtttggtgactggcacgggcctagtgaccgggatggccttggtgactggcatgggtctgccgaccgagactggcttgctgatgccaatgggtttgctgacacccacaggtttgccaatagtgacaggtttgctcactccgatgggcttgctgaccccaacaggccggctgatggtgaccggcctgctgatgggcccaggcttggaggcaggcaggggtcggtccatgtggttccagatccggtgtttctccagctgggtcttagaggtgaatgcggcctcgcagaaggggcaggggaaggccaggcgatctgagatggcaccctgggcagggaagggaaggtttgggacagggccccaagggcctctgcccaaacacaccccgaggcctcctctcccccgacccacagtcccttaccccttggcaccgctggtaatggtacttgagcccgtagatgctggggaactccagccagcaccctgagtttggacacttcaccctcgagtgtgccttgaactcatccttccagtcgttcatcagggagagctaggcgtggggaaaggtggtgctgctgacccgcagccacctgggccactgccagcccgagccccagactcagagcccccccgggcctgcagggcacacacaccacatgagcccctcaacctcgggactgcagtgggaattcaagccacctggcaggggccatgcacaagacccgttctaggagcccaccaacgcgatcccccgaatctcccggcacatcagatacaaagccaggccacgtgaagtctgccaggccagtgcccacatcttgaggcatagagttggtaccagatgtgcagaggacaaatcagggcagggcagtggctggatagggagaccccagcatgagccccaccatggccctgagggagctcacaggaatgtctcggagggcctggttctcggcttttggccgcccctttttcttcccttctgtcttgtcactggctggacttcccgggtcaaagcagagaggggcctggccgggcactgtctgtccaccacggaccaccggcatccctgcagcacacaacacagcaaggctcggaagctgtgtagcaccgcctaccaccggcggctgcacaggcccacagtgagcaccgctgtcccaacacgagggcaccgggggcaggggctgcggccagctgaggacaagaacccaggaccctgggctatgtccaaggcaacccctaccctggtaaggtccttgggaactctaggggcctagctgggtacctggagacaggacgcccagggcaatggtccactcctaccacttgctgcccagaaccatctggaattgactctggccctgactcctcttacccatcttcggtgggtcatgcagcattggaagtcggacctcctttcggctgccatccttcccgggaccactcttgctggaccccgggagccgacggcctccaacgcagaaaggatccgtcatctctgcagagcaagtagacaatctgtgaagcctgacgggccccacttggaacacgtggtgaggctgccctggagccctgcccttggcaggtcctctctggtcagggaagaggggcctgccttcctgtggttttgttcacgtgggaaaagcaagtgatgggggcttctgacttaggggaggggctgccagccaaggtctccccagataacccaggagtcatcatcagtttgataggatctagtcctgtcctgagaccctcaccaacttccagacccccttcccaacacgcagctctacagtgtacgcagctccacagtgtgcgtagccccacagctgcgaagatgatgccgaaggtgatgcactcctacccagtgctgggagggggtgtgcccctgggagaggtgccttgcgcaggaggaaggaggctggcaacattcctccaggggccaattatgtctctgatgatggctgctggctcacaagctgcccaggcccagcagtgggggcacagcttctcactggggccctcataccttcccatgctgacttgatgcaatgccagcctacccaggcaggtacccttggaatcttctctccagacacagatggaaaacagccaaggtgggcactgaggacccctggcccaatctggcactgcaccaagctcccgtccctgtgccggctgaactatcctacctgatgctcttcgcagacttgtctccaggcttggcaggctgacccgccccccacctctctctggatcctctcagtcctctgcctacagacccaccactaccacttcagccaaacaagtcgtggaagcaccagcagtgaaggcccaggatgctggccagagagaacgccctgctgcccaaggctggggcccccgagggcctgtgctgctgggaaccccatcctgagagctggggagcagaggagactctgggcccagccctgtggaaaagccacggaagggggtgggacaggaagcagggtgagggttgagtgggcaggtggccccctcctgatagcttctaattaacttggatccgaggggatgggaaggggctgctgtgtccaggagggccagagagctgaggtcagaggtcaggacagtcactgcccattgccaagggggaggccagtgtccggggacaaagttctctggaagtcctcactttgcaacttttgaaaggagacagggccggcatgagtcatcccagcacctgatgaccccggtggcctggggtgcaggtgcctgctgaggccccacttccaatttttctgaagcctgggagaagaattcagaatagtggggcctgaggccagggccagcctgggaggcagagacgcgactggcgccccggatgagaaggggcttcggccctcccgagcccagcggggacacagagccctcgcggggagagggggctccgccgcgctgcgcgcaggagacgccagcagcgggtccgccgcgtaggccgttcggcccgggaccccggcccaggcctggcgcgcgggtgagcgcggccagggacgcgcacctggggccagcctcgccacccacctgtcacctggggccgggagcgggcgcggggcgcgggcctcggcctggccgggcagggccgatcgcgggcgcggggtgggggggcgaaggcagtgaaccaaaatggcgactttttctggagaaggaggaggcaggaagacggcgccggcgcggggcgcgggggctcgggcgcggcggggggcgggggggctccgggcccggccccctccttggcctgcgcgcagggtcgagatccggggcgcggtgggcgccggggctgcggccagaatgggtccggggcgcggccgggcgcttacctgcggcgcccagcggggctgcggccgggccgggccgggccggggcggggggcgcggggcgcggggcgctgggtccgggcggcgcaggctgcgcgccgcgctgcgcacatgcgcgctcccgcccctcccacctttgacagttttactgcgggggggagggggcgaactctcgcgttattcccgcggccgctccgcgacggggagggggcggggagggggcgggggcgggggcgggggcccggcgctggcctgtggttcccccgctccgcggttccgcccccgtcggccgggcccgcagtccagagtagccggttctgccgtcctggggcgggggacgttttttggacagtggggtaaactgaggcccgataggggcgctaggcactgcccggagtccggcgcgcacggattgaggcgacctgattccgccgcatcctggcccgcgcggcgagtgtggtctctgggctcgggaccctgacctctggccctgggggccgtgcaccggcagcgcaggattcagccttcttccaactggccctgagaccacttttgcgactgacccccggaggtgcctggcggcttaaggccatggggttttactggggtcactgaccattgggtcaccctttcccagctctgggggcagtggttctgaaccagtgccagggccttctctgccccacagcttgggcttctgcaggcagggggcactggggtccggtgtgggctgagtggtctggaggtggcggggcactgacagcacaggacttgggaatgaatgagacagagaaaggttggctctcctaaagaggactggtaggaggcaccacacgggactggcacaggacccacaagaatctcccccaggagagcctgcctgcctgcctgcctgccttccttccttccctctcttacttccttctctccttccttccttccttcttccttccctcccttctcttccttcccttccctccctccctcccttcttccttcctttccttccttcttccttccttccttttctctttccttccttctcttctcttccctccctcccttcctcccttccttctcttccttcccttaccttcctccctcccttcttccttcctttccttccttcttccttccttcccttcccttcctcccttccttttctccttccttcccttccttctcttccctccctccctttctccttccttccttcctttctctctctttctttttctcccctcccctcccttctcctcccctcccttcccctcctctcctttctccttctccgttctttttttattcttgagatagggtctcgctctgtcattcaggctggaatgcagtggtgtgatcttggctcactgcagcctctaccacctgggctcaagcaatcctcccacctcggcctcccaagtagctggaactacaggtgtgtgccaccccacctggctaagttttaaagtattcatagagacgaggtctttctgtgttgactaggctggtcttgaactcctgggcttaagccatcttcctgcctcagcctcccacagtgtgggcattacaggtgtgacccaccgcctctggctaggagggcatttttttttttttttttttttgagacagagtctggctctgtagcccaggctggagtgcagtggtgcgatctcggctcactgcaagctccgcctcctgggttcatgccattctcctgcctcagccaaccaagtagctggaactacaggcgcccaccaccacgcccggctaatttttttgtatttttagtagagacggagtttcaccctgttagccaggatggtctcaatctcctgacctcgtgatccgcccacctcggcctcccaaagtgctgggattacaggcgtgagccactgcccctggccttaggagggccattcttacctgttcacagcacccatctcccagggaaggcctcaggcctcaggagggaagagtcaaggagactctgggttttcatcttgtgcccatagagcatttttttttttttttttttgagatggagtctctctctgttgcccaggctggactgcagtggcgccatctctgctcactgcaacctccgcctcctgggttcaagcaattctgcctcagccccctgagtagctgggattacaggcacgtgccaccatacccagctgattttttgtatttttagtagagacggggttttaccaagctggccaggctggtctcgaactcctgacctcgtgatccacccacctcggcctcccaaagtgctggaattacaggcatgcgccaccgcacccagccagcattttttttaaaaccatgtgcatatattacttttataattaaaacagacttttaaaagtttcgtaatgcccctttttgcatactacaaatattctggactccttaaaattgatgtgggctggaagttgctagtcaggaaatggaactaccaggtgtgcctccttcgctggggcccttccggcccagtcggcccctttccctgtaccccgtggagcaagctcagaggcactgctagggggttgggcagtaagatttttgcctttcctcaaaggggcctgggatctgcttcactcaaggctggtgcagagcactcacatggagattggaggttggctcttatagaagaggcagtcagtcaatccttccttcgggaatctgagtcagagaggccagtgcacaccagcctgtgtgacccgaggaggaaggggagggcattccctgtgaggctagcgtcatcacgtccttcccttgttgacctttcccaccctggggacgggaccagcaggatttcctgaggggtcagtgtgtgtccccttaggtgcagccaaggccgtcagctctccctgtgtaagtctgggtgtccatacatgcgacctgtttggacattgccgtgtcaggatatgacagtgtcccatgctaggtgagaccaatgcctgtctgtattttagcatctgggcgactagacctcagggtacctggggacgatgtgtctggatttcagtatccatgtgtccaggctgcggcatgtctcagtgtcagggtgctggtgagggacggctgttttctgtgagcatctacatgccagggtgtcgtggaatacagtgtgtttgtgtgcaccggggatgtgccgtgtcccatgtgtttctatgtgttaggaggtcgttgtgtgtctgcatgctagtatttgtgtatttgtgtaatgacatctttgtatgggggcatgctgttacatacctttgtgtctgtgtgcctggccaactacatgcatgtgtttgtgtgtgttggtgtttgctggtgtcagtgtcattgagtctctgtgtgtggtttatgctcttatgtgtctgattgctgtgtgtgtgtggtgtgtgtgtgtgtgtgtgtgtgtgctgtgatctgtgtttgagacagggtcttgctctgttgcccaggctggagtgcagttgtgtggttagagctcactgtgccttgaactcctgggctcaaggaatcttcctgcctcagcctcccaagtagctgggactacgggtatgcgccaccatgcctggctagtttcaaaagttttttgtagagatggggtcttgctatgtcacacaggctggtcttgaactcctggccttcagcgacactcctgccttggtctcccacagtgctgggattgcaggcgtgagccaccgtaccaggccagatgtttgtgttttatccctgaacgtgtgaatgggatcttattgggaaaagggtatttgcagatgtgatgaaagatcttgtgatgaggagattatcctgtattacccaggtggccccaaatccaagcatccttataagagagagacagagggagatttgagagacagaagaggaggaggtgatctgattacagaggcggagacgggtaatgcccatgcgcccgagttcccccggcagccactggaagctggagaggtgaggagtcgccccaggaggccctgagggagctggattttggactgcggcctccagaactccagagagaatgaatgtctgctgttctcagcacccctccgtggtcctctgtcacggcagccgcgggaccctcacgcgctgtctgggccgtcccttccagcgtgtcgggcgttgtgtccagcactggggaccgcccacaggcgtgacttgagccctgtttccagcctctgcgcggggttgcccagacgcccctccagggcgtgacgccactgccccctggtggccgcggctgcccagacgccctctcctcgcagacccagcaccgccagcacttgggaaccagctttatttctgattttttttttttgtcagagtataaaaaagtgagtgcagcaaaacaaggaagacgagacaggcgtgcgtgggccagggcaagacagaggagaagggagggaagcagaggcagaagggccccttgggcgaaggctgatggtgggaggcgggcagaatacttgcgcagccacacaggggcagggatgagggtctccccgtggtgggggcttacaggatgggagcggccaggccagttgtccaaattccacctgggacctgcagtgaccagcctcgagtctggaggctcaaagcacacagaggggactaggggctcagcctcatctgtccctgagattttcagaagccacagggggactgggagagggcagaggcgcaagagggtggaggcggctagggccgccctcactgtccttccgccaggcagcaccagccccaaaccacccagagaggggttgctcaggcctctgggagggtgtaaggggagtggccctgggaaggcctctcccctgaatccaggccttcttgggaaagcagcaatgggaaggcccacgcacaaggcccttgttcttgagggcgaggggggaagaccataaaagcaagattttcccaaagatagggcagggagcactgctaagcctgggccctgggcgcggagccacctggacagggctggggttctcgttgtgccacattttgtctctggcgcttggtcaatctggtcctttctcagctttacttctcatgaatagagggggtgtggtgacgatgtataaataatgatgaaagtgcttggcatggtgcccgttaggcgggtgctgatggccactactctagatgatgggttggcctgctgggccctggcaggtgcatgggcacaagccacagggagccgaggcagcttatggtacctgtgtgggccaacctggaggtgctggggaacgacctagaactgggctgggtgggtggacagacaagtgactcagcaggcgatgggggaccgacatcacgtggagaggggaatgtaaataaacagactccctgggagtctaggggggacatccaaaccggttctggctccaggcagctgccccacatgctgccagctgcaccaggggagggcttgggctcaggtcccaggaggtggggccacactcaagcagccccctacccacccagccccagggcacgacctggaatgtccaaccagaggcgcctggaggtgtgatcctggtcctgtctgtccgttgggccagcctggccgccccggcatcccgcagggtccaagaggcgctgcggggccagcttggcctcctccctagccgtggactcccatcacagtgctggggtctgggttcaagcctcagcagcagctaggacattttcccgaaggaagctgtgtgatggaagagggtgagaatggggtggggtctttggcatcatctgcattagggcgcttactggggcctgcagccgacctcctgaggtcatcccaccccacactcagaggggcttctccatcagcccccaggcctctctggcacctcacactgaccttggctgagcagctgcaggctccgcccctcctcacgcacctgcaggcggagcacctgctgcagcacctcctgcctctgggcctcctgggccagccccatccgctgcagcttctccgcattcagccgcagcagtgcccggcctggggagaggaaagaggggctgagctgaggccaacagaggcatcaagagccaaggcaaggctggtgccatggctcatgcctgtgatcccagcactttgggaggccgaggcgggcagatcacttgaggtcaggagttcaagaccagcctggacaacatggtgaaaccccgtttctactaaaagtataaaaattagctgggcttggtggtgtgcgcctgtagtcccagctactcgggaggctgaggcgggaggatcacttgaacctgggaggtggaggttgcagtgagctgagatcgtgccactgcactccagactggatgacagagcgagactccttctcagaaacaaacaaacaaacaaacaacaaactgagccaaggcagaagcagggactgaaagagaaaaagggaggagagagagaggaagcgggaagcacgggcacagagagactcggagagagggaggagagagagaggaagcgaggttcagagagactcagagggagaaagagaatcagcaaaacacacagagacttaaaggagagaggcagagggaaaggaaggagagcaaaaggcagggacggaacagagaaaagccagatgaagacagcacagagagatgggaagagacacagaagaaaggcagagaggtccggacgcagtggctcacacctgtaatcccagcactttgggaggctgaggcaggcggatcacctgagatcaggagttcgagatcatcctgggcaacacagtgaaaccctgtctctactaaaaatacaaaattagccaggcgtggtggtgcatgcctgtaatcccaggtactcgggaggctgaggcaggaggattgcttgaacctggcaggcagaggatgtggtgagccaagatcgcaccatttcactcagcctgggcaacaggagtaaatctctgtctcaccaaaaaaaaaaaaaaaaaaaaaaaaaaagaaaggcagagagatagaaaagacagattctgcggagatgaagaacagaggggaggttgattcacaggagaaactagacagacgaaaacaacagcaagagaaaggcaggctgagtgtggggaagagacgctctgaggcaggttagccccactcccacagcaccctcagcgccactgtaccggtgatggcatgctgggagaaggcctccacgtagacgaggtagttgtggggacagtgcttcttgagccacttgcagacgtcctgctgactccacaggaccacgggccgggtcaggccacccagcgaggggcttgtatggtacaggccatagtggtcagagtacagccggccctgcaggggaggggcgtggcaggcagagtgagagtggtggagaaggagggcagggacggaggtgggtggagtgggtgggtacctggggggtgtctgtgccgggctgctgcaggagcttgattggcctgctgctggccgccctctggctgcgggagtcatgccacgtgaggctggtgccaggtgtccgaggcaagtggcaggggatgctctcagctgacaccgtgtgctccaggagggtccggcagaagctgaagtgggcagtggctgtgtgtgggggtgcctggtcagggcagtcaagggcagaaccagaggcttcctctacttgagagctagctccctgccccatctcctccacactagtgcgggaaatcacctccccaatgaggggttcccaagcctccaaaggcagaaggaagtgtgcaggacctgtttcgaggacctcacccagcacaaaaagagaagaactggaaacacctttcatcttgcaagtctacagccctcacccaggggagcaggatggattcttagatcagaggatgtgccctctagggaagggaacctgagacatatgacaagaggagctatcctgggacagccctgacctcacccttgccttgggctggcccacaagtcttgcacacaccacaccagaccaggaagtgcacacacggcctgctttgaggaaaggcagatcccgagtccggggaggtcgtctgtgctggggaaaccgggctgaggatgctgcttgcccatcgccactgaaggcacccagttcacacagccctatctggtgttggggcccgactcactgactatgactcattgacagcctgaactgtgggccaactgacaagcagggctcactccgcaaacacgcgctgggctctccagctgtgccgccccccacagggcctgcagcccgggacaacaccggccatgtgaatggtgggtacccattggatatgggcgggtcagcacaggtatgtggggtgcagccattgcttggggacccacggtgatgctctgtgctccctcttcccacagtaactgcattaaagtgtttcatctgagctttgtcatcatctctgggggcactgctgacctgagtctggggaggcaggcgtcttgatccaggtctggttacagaggggcaccccacattcattgtcaatgaatgaatgaatgaaggctctgtatggtatctgcaagtgaacagagcctgtggggagacagaaggtgggcacaggcctgcccctgtctttacagcaccctagcacccaggccttcagcagggcaggtgaggttcccacgctagggccctcatcccatccaccctagagtgagagaccctcccggcctcagactcagccacccactccacacccagggcaggggttggggatgtgtctaggaggtctaagtatcggtgaaaaccacatcctacttccccgtcctcccacgcctgtaagacttaggagacataacaccttccgcccccattcttgcaactttcaggaaccggacccctgggtgactccaaatttgaggtctggggtcagcagagggtgtgctcagtgggccaccgccccgaggtggcccctagtgctgtgggaaaaggcttattctaagcccgcgccttccagcggacaggcgccgtggtcgccgggctttgcagggcctcgagcggcggggctggtgcagaagcgcgcggcagtccggggaaacccgtcggactcctcagcccgcacggcacctgccccggccaagcaggctccgcccatttcctgcctgcactcccggagggagttccgtccgtcccgcggtctgtcggtccggtccctcccgccccaacgtcaggattccagaaggaaatggggcgggggcaccgaggcgggatgtgacctcggccccctttcggccccactgcaaaagcgggggagggttttccccgtgcgcaggaaaaggtgacccgagcgtagtgccagcctggacacaggcgccccggcttgacaccccctcaccccaagccaagggcgcgctgacccccaaggcctgaggctggctgccccctaaagcaggacaaaggctacgggaccccgttgagccgagacatccgccgaatacccccagccaccgccgctcgaagcccgccgggtcccgccccgcccccgtgcctctgggtccctgagacccccgcccgagaaatccccgctccccaatccagccccgctcaccgtccacatcccggcgctccccgaagcccgcgcgcacggccccggcgcggccacgcggggggctcagcttggacctcagctcggtgaacatggggcccgcgggtgccaggcccgcgcacacgcccctcgccgagtgcagggcggccggtgtggccggcggggaacgcgcgccgccgccccgccccgccccagccggccccgcgcccgagccggtccccgcggcccgcgagtgtgcgcgacgaggcacctgccgccgagccctgtgtgccgggcgcgctccgggagctccgaggtgtgtcggcggcgcgcgggcctgcgtgcaccaaggctgtccgccagggcgaggggcgtccgtgcgcccctgggcacggctccgcggaggagagtccccgtgaacctgccgggcgtcctctgaggtcgggcccctctgtgcgtgggggtgggctgaggggcatctcacaggggtcttctacctaccggggccaggacaaggggcaggtcaacgcctcccacacactttcctcggtctcctacgtctttactcgccttcaaataggcacccgcttccccggagaaaccagcttgactcttgcttaccgcccaccccactgtgaacatcagggtggttctcccttccctctgcagccccagaacctggctcagtgcccgggggagagggggcggtacagtgctctgtaactgaaaggggcttggcttgcctggagatggggcagaggggaactccaaggaggctgtagcaggccggagcggtgtgtttgctccaggactccagtgagaagtgctgagatggggctgggctagggaactgtggttgcctggtgcagcagcaggccaggcttgcaaccagctattcggcttgctctgcccaggagcctgggtgctctccctgggtgtatgtaggggctctggaggatgtcttacagcaggaggaccagagatgcacacagacatgtagaaatgcatgcacagagtacagtcatgcacttgcacccaaaacacgagcacacgtgacctctgtgcacacaccccactaatcacacacacagaattcacccacatgcttgacagccatgttcatgtactgacgtgttcccgacagctcagctgcggttatttatttcgtcaattagctctccaggagctaaggatgtggccctcaccagaatgtccaaggcatgttggcgggcgtgggtggggtctctagtcccactggagggacagatgcctgaatgggggttcaagaatatgagtgctaaaagcgtagggcagcagtgtgcgcacaggacgcacacagacaggtgtgcccataaccagtacacacaagctctacacaactggacagggtacagctctgctcggacagggcgcaccaggggcgagggcgggcagctgggctggttcagagggagggggccatgggttcagagggaggggaccatgggtcccactctcacagacaggtctccggactgcatcagagcactcgggaagcagcaatgccccaggctgtttttagcccccaggggccagttagggtcccagtgcaagctcgacctagcttcttccgcctctccacgaggaggcgctcccgcgcacgcgcctaccacgttcctgccccctagccgcggccggaagtcgtcgaaccaggacgtcgggacttccgcccagggaatcaaaagtgggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccgggggtgaggcctggggcggcgcgcgaggggcggggacccggctacaggagcgcagtgctttggggcgtgtttgggggcgggggtctatggccgcgcagtctgaaagacgcttggtggatcggcttaatccctgcaggaagcaacgggctttggggtcaggacatacctgtgtgtgcaccctgcttgccgcctagatgtgacacattgactctcagcccagtgttttggtctgtaagatgggtaatgctgtatacggtctgcagtgaggagtagaggaatctgacgtgtagtggaaacacgcgaccaccttcctcaggtcgggctgacactccccccccccgcccgcccgcccgccccgccttaagcgtgcctgggtcctctatgcctgcaacacagatgaccaccgtgcgttgctggataagtgagcagtcgttattatcctatttggctattcatttgatgaggaacactactgggtttttcttggtggtggtattatattggaatctgtggggcacacacaagctcactaaggagggtttgctattaccataaataagtacgtaaagaggaccagatttagaacccagtgcttaatggagagtagcattggagccaagtttagtaagagagctggacttagggctgtagaaacggtgacgatagaagagaaactgacattctgcgtgtgggagttcaaaaaaagtgaggcaaggaggaagcccagggaacaggagggagtccagtgtgagtggaatgtacagcgaatagaatagagctcaggaggttggaggggccttgagcgtcaggctagagctcctggagacgttagaaagatcatgacccttcagaattattattattattattattttttgagacaaagtcttgttctgtcgcccaagctggagtgcaatggtgcgatctcagctccctgcaatctctgccccccgggttcaagcagttctctgcctcagcctcctgagtagctgggattataggtgcccgctaccacgcccggctaatttttgtatttttagtagagacagggtttcaccatgttggccaggggggtcttgaactcctgacctcatgatccacccgcctccgtctcccaaagtgctgggattacaggcgtgagccaccacgcccggcccagaattttttactcagagctgtgttttgggaagaatcatctggcagagcatgggttgaagtagaggaaggctaaaggcagggagaggtaacttggtttccagctgtgatgggagtcatagtctgggaaggagggattttgaaagtggattcattagtacttggggacagacaggatggggaaagtgggagagggaggcaaaaattacatcatggtcccgtggcatctgggacagctgttatcagctgaaaccccccagagcagctgtaaggtgggcacggaagagctcagtgtgggccaagttgggtttaagggcctggttggatgtggagggggagatgatcgaagccttagggtggagagagattgccttggtaacatcatcagggtaggctgaaactttcaggtaagcagagaagatcagaagtgtttgagactgcagttcattgtcaccaggatctttggaggtttcccaaaggtgttagaaaaagaggtgttagtaagtgataaccaggagtggagaagagcacaggaacagagttattcagacacccggtgtcttgggggtctcctgcagcgccactggcttcaccacgcggtcagacattgggcccgcccgtgatgcaaatgaccctgtggatgatcgccatgcacccccaggcaagagaaccgttggggaccagatgaagaaaaatcaggctgctgacgatgacgacgaggatctaaatgacaccaattacgatgaggtgagatgtgtccggctttcgtggctcctccagccagtctctgggagcagctgacctaaccagtgtgtgttggtgtctgtaatgaatggcttggagtggctcatgcatttaaattttagctattcatggaacatctttactgagagtgagagggagcaggaaaaacacggagaaatgtgcactttttgtccctcagaagagatgttcttgcaggtgttaggaccactgccttggcattttctattgcccagtcttttttttttttgagacggaatttcgctcttgtcggaagagatgttcttgcaggtgttaggaccactgccttggcatttcctattggccagtcttttttttttgagatggaatttcgctcttgtcggaagagatgttcttgcaggtgttaggaccactgccttggcatttcctattggccagtctttttttttttttttttttgagacggactttcgctcttgttggccaggctggagtgcagtggtgtgatctcagctcactgtgacctctgcctccccatttcaagcgattctcctgcctcagtctccaagtaactgggattacaggcatgcgccaccatgcctggctaattttgtatttttagtagagacagggtttctccatgttggtcaggctggtctcgaactcctgacttcaggttgtccgcacgcttcggcttcccaaagtgttgggattacaggcgtgagccactgcgcctggctgccagtctttaatgataaaaacttaaagtggaattggtgatagtatttgctttttttagctttagtgattgccctctaaacagacatctaaagaaaaacttcagctgactgaataccgattaactgtcttctaacagatgacatttttcctctgaggaaaatttttaaaaataattttagttttgaggccaggtgcggtagctcacacctataatcctggcacttttggaggccgaggtgggcggatcatgaggccaggatatcgagaccatcctgtttaacatggtgaaaccccgtctctactaaaactacacaaaaattagccgggcatggtggcatgtgcctgtagtcccagctactcgggaggctgaggcagaagaatgctgtgaacccgggaggcggaggttgcggtgagccaagattgcgccactgcactccagccttggcgagagtgcgagactctgtctcagaaaaaaaaaaaaaattagttttgaaataattttaaatttgcaggaatttgcaaaaatagtgcccccccaaaaaaaagtttctgcatgtctttcaccaagcttctcccgatgttacatgaccttagtgcagttattgaaacgaaggagttaacattgacacagtactattaactaatttgtcagtcgtatttgcatttcatgtttttccatgaatgtccgctttctggcttaggcttagtccaggatcccccattgcatttcgtcatgtctccttggtcccttccaattgggggtctcctctgtcttccatgcccttgacgcttgaagagtagtcaccagttatatggtagactgtcccttgatttggcttcgttggctgaagaaaataatttagcaagtatttcacaagtagagatctccgtttcgctggtggggatggtgttgaaggaaaagctgacctctacacgtgttgtttgcttctcagtttaatggctatgctgggagcctcttctcaagtggaccctacgagaaagatgatgaggaagcagatgctatctatgcagccctggataaaaggatggatgaaagaagaaaagaaagacggtaaaagaaattgttgcctttcacaatatttatccaagtttaaaaaaaagttttgtggccaggcgcagtggctcacgtgtgtaatcctagcactttgagaggctgaggtaggacgatagctagagcccaggggtttgagaccagtgtgggcaacgtagggagacttaatctctacaaataatttaaaaattagccagatggtacacacctgtagtcccagctacttgggtggctgaggtggaaggaccgtttaagcccaggaggtagaaactgcagtgagccatgatcattccagcctggttggcatagtgagaccctgtctcaaaaaaaaaaaaaagttttgttttgaattgttttatatttggagaaaagttgcaatagagtatgtgtgtctgcttagcttttaggccacctgagggtcttggtctgtcgtagccatgcctggataagcactgggctgttacagaacagccttagggcctgggggctgcagtggagagcttaagaactcttaagtttttccagaaatcagcagaattttgtggattacttttacgatacatcagggttaccatctttgaaatgaaaagggcctactgacttgattattatatgttgagtaatttgcaaatgaattaaagatgttaaatgacacatacaagctaccaagattgaaccatgaagaaatcccaaacctgaacagaccaataaaaggtaatgagatcaaagctgtaacagaaagtgtcctagcagagaacatctcaggatctgattgcttcattgctgaattttaccaaatatttgaagaagaactaataccaattctactcagactattctgaaaaatagaggagggaatacttccaaacttattctacagaaccagtattaccctgataccaaaaccagacaaagacacactgaaaaaagaaaatgttaggtcagtatccctgatgaacactgatgcagaaatcagcagaatactagcaaaccatattcaacaacacattagaaagatggttcatcggctgggcgcagtggatcacgcctgtaattctagcactttgggaggccgaggtgggcggatgatgggtcatctgaggtcaggagttcaagaccagtctggccaacctagtgaaacccagtctctactaaaaatacaaaaattagccgggcatggtgggtggtgtacgcctataatcccagctacttgggaggctgaggcaagagaatcgcttgaactcgggaggtggaggttgcagtgagccgaggtcacaacactgcactctagcctgggagacaagagcaagactccatctcaaaaaaaaaaaaaaaaaaagatcgttcatcatgaccaagtggcattttgcccaggggatacaagtgcaagggtggttcaacatatgcaaattaatcagtgttatacatcatatcaacagaatgaaggacaaaaaccatatgatctttttttttttttttttgagacggagtctcgctctgttgcccaggctggagtgcagtggcgcaatctcagctcactgcaacctccacctcctgggttcaagtgattctcctgcctcagcctcctgagtagctgggactacagttgcccgccaccacgcctggctaattttttgtatttttagtagagacgggatttcactgtgttagccaggatggtcttgatctcctgacctcatgatccacctgcctcggcctcccaaagtgctgggattacaggcgtgagccactgcgcccggcctaatcattttaattgattctgaaaatgcatttgataagattcaacattccttgatgataaaaactctcaaaaaactgcatatagaagaaacatacctcaggctgggtgtggtggctcacgtctgtaatcccagcactttgggaggctgaggcgggaggactgcttgatctcaggagtttgagaccagcctaggcaagagggtaataccttttctttacaaaaaaatacaaaaattagccaggcttcgtggcacacacctgtagtcctagctactcaggaggctgagatgggagaattacttgagcccaggaggcagaggttgcagtgagctgagatcataccaccacacttcagcctgggccacagagcgagaccctgtctcaaaaaaaaaaaaaaaaaaaagggggggggagcataacacaataaaagctatatacagctggatggggtggttcacgcctgtaatcacagccctttgggaggcccaggcaggcagatcatttgaggtcaggagtttgagaccatcctgaccaacatggtaaaaccctgtctctactaaaaatccaaagattagttgggtgtggtggctcaggcctataatttcagctactcaggaggtggaggttacagtgagctgagattgtgccactgcactccagcctgggcaacacaatgagactgtgtcgcaaagaaaaaaaaaagccacatatggtaggcccacagctcgtatcatactgaatggggaaaaactggaacgcaacaaggatgcccactttcaccactgtgattcaacattgtactggaagtcctagctagagcagtcggaccagagaaataaataaaagggcatccagattggaaaagaagaagttaaattatccttgtttgcagatgatatgatcttatatttagaaaaccctaaagactctaccaaaacactattggaactgacaaattgattaaagttgcaggctatgcccccaggtgtggtggctcacacctgtaatcccagcactttgggaggctgagggtgggtggatcacctgaggtcaggagtttgagaccagcctggccaacaaagagaaaccctgtcactattaagaatacaaaaatggccgggcacggtggctcacgcctgtaatcccagcactttgggaggccgaggcaggtggatgactggaggtcaggagttcgagaccagcctgaccaacgtggtgaaaccctgtctctactaaaaaaattacaaaagttgccaggcgctgggactcacgcctgtaatcccagcaccttgggagagtgaggtgggtggatcacttgaggtcaggagtttgagaccaggctgaccaacatagtgaaaccctgtctctactaaaaatacaaaaattagctgggtgtagtggcacacgtctgtaatcccagctactcaggaggctgaggcaagagaattgcttgaacctaggaggcaaatgttgtagtgagctgagattgcaccactgcactccagcctgagtgacggggcaagactctgtctcaaaaaaaaaaaaaaccaaaaaacaaaaattagccgggtgtgggggtgcacgcctgtagtcccagctagttgggaggctgaggcaggagaatcgcttgaacccaggaggtcgaggttgcagtgagctgagattgcaccactgcactccagcctgggtaacagagtgagactccatcttaaaataaaagaaaatatccatactacccaaagtaatttacagattcaatgcaatccgtatcaaaatactggggacattattaacagatagtgaaaaaatagccaggtgcagtggctcatgcctgtaatcccaacactttgggaggctgaggcaggtggatcacttgaggtcagcagttcgagaccagcctggctaaaccccatctctactaaaaatacaaaaattagttgggcatggtgacaggtgcctgtaatcccagctacttgggaggctgaggcaggagaatcacttgaacctggaaggcagaggttgcagtcagctgagatcgtgccattgcactccggcctgggcaacagagtgagactccgtctcaaaaaaaaaaaaagaaaaagaaaaaataattctaaaatgtacatggagccaaaaaagacccagaataggcaaagctatcctgagcaaaaggaacaaaactgggggaacacttgacttcaaattatactacagagctgtagtaacaaaaacagcatagtactggcagaaaaacagacacatagaccaatggaacagaatggacccagaaacaaataggtacctctacagtgaactcattcttgacaaatgtaccaggaatatttattggggaaaagacaatctcttcaataaacggtgctgggaaaactggatatctatatacagaagaatgaaactagacccctctctgtcaccacatacaaaaatcaaattaaaagactttaagacctcaagctgaaactactagaagaaaacattggagaaactctacaggacattggactaggcaaagatttcttgagtaataccccacaagcacaggcaacgaacggaagccaggtgtggtggctcgctcccgtgagccaagagtgcgctactgcactccagcctgggccacagagactgtctcaaaaaggaaaaaaataaaaagttctcattatagaatattaggaaaataagagtaagtatgggtaaaagcataacatttattcataagtctagaaagtaacagttaacattttggctcatttcctctttctgttgcttttttttatcttggctcactgcaacctctgcctcccgggttcaagcaattctcctgcctcagcctcccaagtagctgggattacaggtgcctgccaccacgcctggctagtttttgtattttagtagagacggggtttcaccatgttggccaggatggtctcaaactcctggccttgtgctccatccacctcggcctcccaaagtgctgggattacagacgtgagccactgcgcccagctctgttgctttttatacatgtaatcataacttcctgtgatgtatgtagaatgttttattttttgaagataattttagaatagtaaaatatagttcttctggaattttatttattttttatttttttgagtctcccaggctcaagtgattcttctgcctcagcctcccaagtagccgggattataggcacgcgccaccacacctggctaatttttgtgtttttagtagagacagggttttaccatgttggccaggccggtcttgaactcctgaccccaagtgatccacccgcctcagcctcccaaagtgttggaattacaggtatgagccaccgtgcccagtcttgccacacactttaaacaaccagatcttacgtgatgtaaacttgctgcctcgaggacagcaccaggccatcaggggtctgccctcaagactcaagtggcctcccaccaggccccacctcaaacattgggaattataattcagcatgagatttcatggggacacagatgtaaaccatatcctttggcctcccagagtgctgggattacagacataagtcaatgtgcctggcctggacatctttttagaagctcgttattaaatcattgtgcataaattttatacctatagtaattaaacgtgaatggcattgcatttcacttttttttttttttggatacaggatcttactctgtcacccagggtggagcgcggtggcttgattatagctccctgtaaccttcaattcctggctcaagcgattctcctgcttcagcctcccaggtagctgggattacaagcacgtgctaccacacccagctaatttttcttttttctttttttttttttgagatggagtctcactctattgcccaggctggagtgcaatggcgcaacctcggcttactgcaacctccgcctccagggttcaagtgattctcctgcctcagcctcccaagtggctgggattacaggcatgcaccgccacgcccggctgatttttgtagagatgggtatttttagtagagacggggtttcaccaatgttagccaggctggtcttgaactcctgcccttgtgatctgcctgccttggcctcccaaggtgctgggattacaggcttgagccaccacgccaggctcacacccagctaatttttgtctatgttgcccaggctggtcttgaactcctggcctcaagtgatccacctgcctcccctaaccttggcctcccaaagtgctaggattacaggcatgagttactacactcagccctacattttaaaaattgattggaacctccagggttaatgcattttaaaaaacatcaggctgggtgcagtggcttacatgtgtaatcctagtaccttgggaggccaaggcaggaggaccacttgagtctaggagttcgagaccagcctgggcaacatggtgaaaccctgtctctacaaaaacaaaattaaaattagccagttgcacatgcccgtagttccagctacattcccaaggctgaggcaggagcatcgcttgagcctaggaattagaggctacagtgagctatgcttatgccactgtgctccagcctgggcaacagaccaaggccgtgtctctaaaacaaaaacaaaacaaaaaacagcaggtgacacggacccatgaagaaagccattaaattaaatgtttttaaaaagtagtgtacttggccgagcacggtggctcacacctataatcccagcactttgggaggccgaggcgggcagatcatgaggtcaggagatcgagaccatcctggccaacatggtgaaaccccgtctctactaacaatacaaaaattagctgggtgtggtggtgcatgcctgtaatcccagctactcaggaggctgaggcacgagaatcacttaaacccaggaggcggaggttgcagtgagctgagatcgcaccactgcattccagcctggtgacagagtgagactgtctcaaagaaaaaaaaaaaagtagtgtacttattaaaactttttattctgaaaactgtcgtaatacaaacaagtaggaagaacagtactgtgaataccatatcctcacatgtagtctcaacaccgaagtgcaattacatgggttatgttctggcacatagagctgtgcagctgagctgagttggttagaggtgaactatttacttggaagagaaggaagcaaggaaggaaaggtgggatgagttcagtagagtgtttggagtgtttggtggtaactaggatagttactgtttttccttgtaggtgtttttttgttttgttttgttttgttttgttttgcgacaaggtctcgctctgtcgcccaggctagattggctcactgcaacctccacttcctggattcagatgattctcctgcctcagtctcccaggtagctggggattacaggtgcccaccaccatgcccagctaatttttatttttatttttatttttttgagacgaagtttcactcttgtcacccaggctggagtgcaatggcatgatcttggctccctgcaacttccacctcccaggttcaagcaattctcctacctcagcctcctgagtagctgggataacaggcatgcgccaccacgcctggctaattttcatatttttagtatagatggggttttaccacattggccaggcttgaactcctgacctcaggtgatctgcccacctcggcctcccaaagcgttgggattacaggtgtaagccaccacgcctggccttcttaggtgtttatgggatggtcctacctttgggattttgtgaattttcaagcagtaaatatacacatgtccaaatggaggtatttagatcaaagtaagatcttttttttttattttaatgaatttctacatgtttttatttggtggataattgaattagtagacttacgaatgtatttatatttatttatttagaggcagagtctctctgtgttgcccaggctggagtgcagtggtgcgatcttggctcactgcaccctctgcctcctgggttcaaatgattctgcctcagcctcccaagtagctgtgattacaggtgtgtgctaccatgcccagctaagaatgtattcatagttaccttaaaatatatttgatttgggctgggtgcggtggctcacacctgtaatcccagcactttgggaggccaaggtgggtagatcacaaggtcaggagttcgagaacagcctggccaggatggtgaaaccccgtctctactaaaaacacaaaaattagctgggagtggtggcgagcacctgtaatcccagctacttgggaggctgaggcaggaaaatcacttaaacccaggaggtggaggttgcagtgagctgagattgcgccactgcactttagcctgggtgacagagcaagactccatctcaaaaaaaaaaatgtgtgtgtgtgtgtgtgtgtgtgtgtgtgtgtgtgtatatgtatatatatatatatatatttgatttagctactaagagtatggaattgttctttttggtgatttaattgagatggataataaatttgcttcagaacagacatgcagtgtttctgatgtgtgcatgttttatttcctagggagcaaagggagaaagaagaaatagagaaatatcgtatggaacgccccaaaatccaacagcagttctcagacctcaaggtgagccgatgaagcggtgaatggtgtgcggtttctaacgctctcaccctaacccgcagagactcagactgctcttacgtggaatttatgagactttacgtttttaatttagggggtcattgcttagaagaagaaagtgtttgcttcagtatgtttaattatatgtgtgtaaaaaaaaacccttcccctactgtaaaaggtaggacaaatgaacttattttctttgtaattttgactccatttatacctaagattttcttttttcttttttctttttttttttggaggcagtctggctctgttgccctggctggagtgcagtggcgtggtctcagctcactgcaaccttcacctcctaggttcaagcaattcttgtgcctcagcctcctaagtagctgggattacaggtgcctgccaccatacccagctaatttttgtatttttagtaaagacaggatttcgccatgtgtaccaggctggtctcaaactcctgaactctagtgatctgcccacctcagcctcccaaagggctgggattacaggcgtgagccaccacgtctggccccatttatacgtaagattttctaaactgtgtcccctgggctttgagagaataatttacattttagtgaagttgaacagatccaataaattgatttttcttttctttttcttttttttttttttttgagacggagtttggctcttgttgcccaggctggagtgcaatgacgcgatctcagctcaccgcaacctccgcctcccaggttcaaacgattctcctgcctcagcctccctagtagctgggattacaggcatgtgccaccatgcccggctaattttgtatttttagtagagatggggtttctccatgttggtcaggctggtctcgaactcccgacctcaggtgatctgcccgctttggcctcccaaagtgctgggattaacaggcatgagccaccgtgcccggcctaaattgatttttctaagtgaagtagaaaactatttttggggctgggtacagtggctcacatctgtaatctcagcactttgggaggctgaggtgggaggatcacttgagcccaggagtttgagaccagccttggggagaacctgtctttacaaaaaataaaaacttagccaggcatggtggcccacgcttgtggtcccagcaacttgagaagctgaagtgggaggatcacttgagcctgggaggttgaggctgcagtgagctgtgattgtgccactgaatccagcctgggcaacagaatgagacccatctcaaaacaaaagtaaaaaacagttgctgcatccaaatcccttctaaagcttggtgatctggaggctaggggtgagagagggcatggtcctacctgggcacatgaaattctgtcagagaattaatgtttttgggggctggatatttccagaggaagttggcagaagtcacagaagaagagtggctgagcatccccgaggttggcgatgccagaaataaacgtcagcggaacccacgctatgagaagctgacccctgttcctgacagtttctttgccaaacatttacagaccggagagaaccatacctcagtggatccccgacaaactgtgagcttccaaaaaagggcacatgtggcccatttagtcctgttagatcagtggcaggaatggtgggtggtgttggattcaatgcttctgcaggtcatggctatgctgtggccgagtctgtctgcacagctgtgcatatgtcaggccactggggaagtatttcagagagtaaatttcttgggcatgcagtgcaaaccgttgttttattcttgcctttcctctcttcccctccagcaatttggaggtcttaacacaccctatccaggtggactaaacactccatacccaggtggaatgacgccaggactgatgacacctggcacaggtgagctggacatgaggaagattggccaagcgaggaacactctgatggacatgaggctgagccaggtgagtttgtcacacagcattttcctgtggacaggtttagacagtttaattttgttttgttttctttttctccttcttcttcttctcctttttcttctcctccttctcctcctcctccttcttctccttctcctttttttttttttggcttgatttttgcctgaataattccgcagatttttaaaattttgacccagagtcttgctgtgtcactcagaggctggagtgcaatggtgtgatcttggctcactgcaacctccacctcctgggttcaagtgattctcctacctcagcctcctgagtagctgggattacaggtgcccaccaccacacccggctaatttttgtattttttgtagagacggggttttaccatgttggccaggctggtcttgaactcctgacctcaggtgatctgtctgccttggcctcccaaaatgcggggattacaggtgtgagccactgcacttggcctttttttaaaatataaaataataattttttaaaaagtgtgtttttttcctgcctctcagtaaattgtcttgtggccctgcatggaacgtgtactttgatctggagactaggtgctctagacaccagtgaagtacagaactctttctgatatgcatatcagataccacgaaggaacatactacttttggcctggccaacatggtgaaaccccgtctctactaaaaatacagaaattggccaggtgtggtggcgggcgcctgtaatcccagctacttgggaggctaaggcaggagaattgcttgaacccgggcgttggaggttgcagtgagccgagattgcaccagtgcactccggcctgggcaacagagtgagactgtctcaaaataaaaaacaaaaacaaaaacaaaaagtggcacaatcatggctggctacatacagccttgacctccctgggctaaggcgatccttccacctcagcctgccaagtagctgagattacaggcatgtgccaccatacccaactaatttttgtattttttgttgagatggggtgtcactaggttgcccaacctgggctggagctcctgggcacaagtgatctgtccgcgctggcctcacaaagtgctgggattacaggtgtgaactaccatgcccagcctgaaatttgtttacatagaaattgtaaaactttttgggccaggcactcatgcctgtaatcctagcactttgagagaccaaggtaggaggattgcttgaggtcaggagttcaagaccagcctgggcaacatggtgatggtgagactctgtctctacaaaaactaaaagaaatagctgggcctggtggtgcctgtagtcccagctgttcgagaggctgaggtggaaggattgcttgagctagggagtttgaggctgccatgagctatgatcgcgcctctgcacaccagcctgggttacggagtgagactgtctcaataaataaataaaactgtcacagtaatttttttgtggtaaaatatatgtaacacagaatttaccattttaatcattcttgactgtacataccttcactgacataattatgttcatgttgttatacaacctcatcaccattcatctccagaactgttttcatcttcccaaattgaaactccgtacctgttaaacattgagtccccgtgcgctttctccccagcccctggcatccaccgttctctctgtttctataaatgtcactactctctggatcttatatgactggaatcatacagtatttaccttactgtgacaggcttatttcaattagctcatggtgcagcatgcgtcagcatgttcttttttttttttttttttttgagacagagtctctctctgtcacccaggctggagttcaatggcatggtcttggctcactgcagcctccgcctctcgggttcaaatgattctcccacctgagcctcccaagtagctgggactacaggtgtgcaccaccaagcccagctaatttttttttttttttttgagacggagcctggcaccgtcacccgagctggagtgcagtggtgtgatctcggctcactgcaacctccacctcctgggttcaggtgattctcctgcctcagcctcccgagtagctggaactataggcgtgtgccaccatgtctggctaatttttgtatttttagtagagacggggtttcatcatgttggccaggatggtcttgatctcctgacctcgtgatccactcgcctcagcctcccaggatgctgggattagaagtgtgatttttttgtatttttagttagagatgggatttcaccatgttggccaggctggtctcgaactcctgacctccagtgatccacgtggctcggcctcccaaagtgctgggattacaggcatgagccccggcgccccggccagcatgttctcagtttaaggcaggatgagacttgactctttggtgtgtgtggaccgcattcgctcatctatgtagaccgcattcgctgacctgtttattcgctgacggacacttggaccactttcaccttttgactattgtgaataatgctgctgtgaatacgggtgtacagatatttgtcagagaccctgctttctattctttcttttttaataaaaattttatttatttttttttgagacggggtcttgctctgtcacccaggctggagggcagtggcgtgatctcggctcactgcagcctctgcttcccaggttcatgtgattctcctgcctcagcctcctgagtagctgggactacaggcatgtgccaccacgcctggctaatttttgtatttttagtagacacggggtttcaccatcctggccaggctggtctcgaactcctgatcttgtgatccacccaccttggcctcccaaagtgctgggtttacaggcgtgagccaccacgcctggtcaaaaattacacttttttttgtagagacagaatcttgggaggctgaggcaggaggattccttgagcccaggagctggaggctgcactgagctatgattgccactgcactcctgcttgggtgacagagtgagaccctgtctcaaaaaaataaataaaaatatagatcttggacagacgcggtggctcacgcctgtaatcccagcactttgggaggccgaggcgggcggatcacgaggtcaggagatcgagaccatcctggctaacacggtgaaaccccgtctctactaaaaatacaaaaaaattagccaggtgtggtggcgggcgcctgtagtcccagccactcgggaggctgaggcaggaggatggcgtgaacctgggaggtggagcttgcagtgagccgagattgcacaactgcactccagcctgggcgacagagcgagactccatctcaaaaaaaaaaaaaaaatagatctttttccatacagaagaaatttgttattatcacaaggtgttgtctgagtgaaatgaaggctgttttccttctccttctgactgctctctcagggttgtgggaggggcaccagggaccctctgagaactttgttttgcacctggtcatgtccagctgactcttagcttggcctgtctcacaggtgtctgactccgtgagtggacagaccgtcgttgaccccaaaggctacctgacggatttaaattccatgatcccgacacacggaggagacatcaagtgagtgctttgcagaatcgctgggctgggatggagactctagttgcctagggtattttggattttatatggacagtatgctgtcaaaatgggacatggcggttctaagaaatgtaaagtggagtagtttgttttttccatttgaaatgtatctgtatccattcattgcgtacactcaatgtgttacatatgatactgcaaagtccctgcctgtgctgggcaggaaagcagctggctgtgtcccacatgtcccatctggaccttcggttctcagcgtttgtctgcggggaggctacagaggcttggaatagtgcgcactgaggttttgagttggtttttgtaactcaggacatcaggactgatagttcttacattgtgactgtgaagtgggtgccctcatcccaggtctcgggtgcacccctgacagcatggcctgatgccgtgtgcactctccctctcatagtgatatcaagaaggcgcgactgctcctcaagtctgttcgggagacgaaccctcatcacccgccagcctggattgcatcagcccgcctggaagaagtcactgggaagctacaagtagctcggaaccttatcatgaaggggacggagatgtgccccaaggtgaggtatttcctgggaggcgtttcctgggaggctgcgtgattgtggcccctacgggagtaaacttgttagagcaaatctctttgtcttttggtattgaaactacagacaatagggcaggctgggggaggatgtgaaaagcagccaagggctttttcctgcttgttttcatgtggagtgaaggctaatccaccactttttttttttttggagacggagtctcgctctgtcacccaggctggagtgcagtggcacgatctcggctcaccgcaagctccacctgccaggttcacaccattgtcctgtctcagcctccagagtagctggcactataggcgcccgccaccatgcctgaatccaccacgcctgaatccaccactggtttgacggcaggctaagcttcattataaagagctcagttggtcagctcttcacccgcctaatggtggccagtcacggtggctcacgcctgtaatcccagcactttgggaggctgaggcgggtggatcacttgaggtcaggagttagaaaccagcctggccaacatggcgaaaccccgtctctactaaaaatatgaaagttagccaggcgtcgtgacaggtgcccataatcccagctattcggtaggtggaggttgcagtgagctgagattgcaccatgctgctccagcctgggcgacagagcgagattccgtctcaaaaaaaaaaaaaaaaacaacaaaaaagaacgacccgagcagatgtgcagtctctgctttgtccatggagttgtcctgaaggaaatcatgctcttttcacaaagtggtgtttcattttttttttttctttttttttgagtctcgctctgttgcccaggctgaagtacagtggcgtgatctcagctcactgcaacctctgcctcccgggttcaagcaattctcctgcctcagcctcctgagtacctgggattataggcacctgccaccacacccggctaatttttgtagttttagtagagacagggttttgccatgttggccaggctggtctcaaactcctgacctcatgatccacctgcctcggcctcccaaagggctgggattacaggcgtgagccaccgcgcccggccattaggtgttcttcagtcagacatatggtagccatgttcccaagtgtggttataagggggcgactcctggtgcaggtgtgttagaggctgagctaattggctttcgtaaattctggggcccgaggatctgctctggagatctgtgcctgctgccctgttgcggcttccagcctgcactgagccttattggtcttatctcttgcctcacagagtgaagatgtctggctggaagcagccaggttgcagcctggggacacagccaaggccgtggtagcccaagctgtccgtcatctcccacagtctgtcaggatttacatcagagccgcagagctggaaacggacattcgtgcaaagaagcgggttcttcggaaaggtgagcctccctcggaggtgctgctttctccctccttggggcccctcctctcagcagctttcctgctcctggctcaggcttttggtgagagtggataaggaaccagggacatttttcaggccttttctcaggctgggttgcctctgcccttggacccccatgggggagggatactgtggtgggcaagttcccatcctggaagggatgcttgggttgagccctcactcctgcctttttccagtgtgtgatcttggatgcttgggcggtcactctggtccaggcttccctcatctgcagggtgagaacaacggtagctcaaagcctgtgtcctggggctctggagatggtctgtgtgaagagctgagccggcacctggcacgtgcagacccgttgtgggtgttactcattttctctcctgagaaggcaccagagccacacgttgattgaactctttcctgctgctgacgaggctgtgccttctgctcccgcgatgcagcgtgtgccgtcagctcaggtcagataacgacagacggtgtgcctaccaggcaacctgattccatccagggattcctgccagggtagagcttttgtgggtagtttgtttatttttattactgtggattcataaaaggagcactgtttctcctgtcactggaagtgtgtagtagatgctgctcttgaactgggtccagaacgagtgctagtcagggggctgttctgaagctaatctgtgcaggtggcttcttttttttcattttttgttttttttttctggttttttttttttttttttttttgagatggagtctcgccctgtcgcccaggctggagtgcagtggcgtgatctcggctcactgcaagctccgcctcccgggttcacaccattctcctgcctcagcctcctgagtagctgggactacaggcgcctgccaccacgcctggctaatttctttttgtatttttagtagagatggggtttcactgtgttatccaggatggtctcgatctcttggccttgtgatctgcctgcctcggcctcccaaagtgctgggattccaggcgtgagccactgcacctggcctatgcaggtggcttctatccatttttttttttttagacagagtctcgctttgtcgcccaggctggagtacaggggcacgatcttggctcactgcagcctctgcctcccgggttcaagtgattctcctgcctcagcctcccgagtagccgggattacaggtgtgcgcctccatgcctggccaatttttgtatttttagtagagatggggtttccccatgttggccgggctggtctcaaactcctgaccacaagtgatcctcctgccttggcctcccaaagtgcagggattacaggcgtgagcccctgtgcctggccttttcttttcttttttttttttttttgagatggagtctcactttgtcccccaggctggagtgcaatggcaccatcttggctcactgcaacctccgcctcctgggtttaagcaatcctcttgcctcagccttctgaggagctgggactacaggcacctgccaccacgcctgcttaatttttgtatttttagtagagacggggtttcactgtgttgaccaggctggtcttgaacttctcacctcaagtgatccacccacctcgacctcccaaagtgctgggattacaggcgtgagccactgtgcccggccagattttttttttttttttgagacagcgtcttgctctgtcacccaggctggagtgcagtggcacgatcttggctcactgcagccaccacctcccaggctcaggcgatcctcccagcttagcctcccaagtagctgggagtataggtcccacccccatgcccagctatttttaatttttggtagagatgggatcttgctgtgttgtccaagcttgtctcaaactcccatcctcaagtgatcctcctgccttgatctcccagagagctgggattacaggcatcagccgtcgcatccagcctattcttcctgaatttatagcctaggaaaaataaagtgtattttatggaatcaagggcagttttcagtgagagctttccagctcttgtttttccaaatgtctttaagcgaaatatcccattgaggcttctgtgctgataggaccgtgcagatgagggctctttggtagaaagccccttatcaaatatagtttcattcacttactgtctacgtctgttagaagacaggtgaaggctgcttgcctgtgatgcatgttcccccgaccctgtgcactcacatgtgaacgtgctttcctctgtcgaggctggtttcttgaccgcagcccagctgctcagtgaatgctcagagacagcctcttttatttttttttattgagacagagtctcgctctgtcgcccagcctggagtgcagtggcacgacctcggctctctgcaagctccgcctcccaggttcacgccattctcctgcctcagccccccaagtagctgggactacaggcgcccgccaccaggcctggctaatttttttttgtatttttattagagatggggtttcaccatgttagccaggatggtcttgatctcctgacctcatgatccacccgcctcggcctctcaaagtgctgggattacaggcgtgagccaccgcgcccggccagagacagcgtcttataatgaggtggccaggaacagaaagttagcacctgtctgggtttgtagaaatcagtttatcttttttcagctaggaagaaatagttctttgatgaagagcccatgaaagtctgggtaattagtattgtttacttagaaaagctctattgaattcttcctgccacagtttgatgaatgatcatgaatgtctttgtggccactccctgctcaccaccagattgtctgggttcatttccagttggtttggatttggagatgggagtatgctgttggaggcgggggccttcggggagtgttgagggactgtgtttccacggctgttctctcagggagtggcctcctggctgtgctctctcaggcagagaagctgggctaaggtggaatgaacccaggatctccaggatggcctttgccgctgccctaatactggtcctggcctgccctttcccaagagtgtttccaaaaactgtattcttttcctggggtgaagcccagcactgcttcatttggttattagcaaacacttacacgttgcttgaagggtctggtttttgaaattaagatgacagctacttccactggtgacttaggacacctgccagccagggagcctggcagtgcatggtctctgtgagctctgggtcgctgttgggctgagctgacaccttagtcctttgttgggagaatgggcgttttgggtgctgatcttgagacctgaggaggctgagtaaccttaggcatggtgcttggcctctgagcttccatgtcttcctctgtaaaagggaagagggctttcaggattggggagggtgcagcatgtgagcttcctggccagggtggggtgtcccacgtgcagagtcccctggggaggcccgactggcagctcccctacaataatgcactcacatgctgtgtactccgctagttaatgcagatgtgtggaagtggagttattttacactaacgccatatgctctggcctgtgaagcgtggcatccttcagtggccgtcgccagcgtgtccctctgggggcacaggaatggcacagttcaggttgagggtcttccctgcagtcacgtgacccccggagagcatgttggcctctgcacggtcacgtcttcatggctgtgtctagcattcagaatactcttctgttctaggccaacttcaggggtgtgtgcttcctccacttctgctcataaagtcacactccttgaaggccattgtatcatggtgtgccatgtggcttccgaaagcacctggggaaggtgaccttgttggttttagtgccatgcctgtgggctgctgatgagatgccatggagatatgtcagctctctcccaaaacttgaagacacagagtcctgggagtcgtaagttaatgactccataaattgagtcccgcatgaatattctgttctttagagacgcgaagttcatctccaccaatgtacaaagtattaagggaagtagttcatatttagacaaatagagcactcatctcccacgcagtcgaggtgagagcgcacaggaaaaacaactgggtcgttctgtgtcttctctctatgcctagtcgcctggttggaggttaggactttccttctttactgctgtgccctctgctgtcaccctgcttggtcagggttcttgacctggatgagtaacccaaatcttttttttgttttagacagagcctcgtcctattgcccaggctggagagcagtgttgcaatcagctcactgcagcctcaacctcctgggctgtagtgatcctcctgcttctggctcttgagtagctgggaccataggtacatactaccatgcctaaataatttttattttgagacaggatcttgctctgttgcctaggctggagtgcagtggcatgatcatgggtcactgaagcctcaacctcccagactcaaactatcctccagtctcagcttcctgaatagctgggactccagggacataccaccatgcctggctgagtttttaatttttcaaagagacgaggtctccctgtgtcatccaggctggttttaaactcctgggctcaagtgatcctcccacctcagtctcccaaaatgctgggactgcagatgggggccactgtgctcagccaggacccatatctttatccccaaagggtctgacttgttggtagttttgcttttttggtggctgtagttcccattaacttttactggtaaaagcagaaatactaaactgtttttaggactggcctctagatagtctcccacagtgggtggcagcaactcagtctcgctttgggagtcagggttagcctctccagccagggctggtacatgaggaggccagagggagctgtggtctgcaccctggttggcacatactccctttggagtagctcgtagcttgctcttttttttttttttttttgagactgagtcttgctctgttgcccaggctagagtgcagtggcgcaatctcggctcactgcaacctccgcctcctgggttcaaggaattctcttgcctcagcctcccaagtagatgggattacaggcacctgccaccacacccgactaatttttgtatttttaatagagatggggtttggtttcactgtgttggccaggctggtctcgaactcctgacctcatgatccacccgcttcagcttcccaaagtgctgggattacaaatgtgagccaccacacccggcctttggaccagctctcttgacaggagggtccaaggaggcggagacgggactcttggcagtggagacgggacttgtggcagcggagatgggacttgagccattcagacatcactgtttattcctagacccgtgtgttctggctgtgagatccagccgggattggtgtctattcacagcatttgtggcatcctactgggctgccaggccatggctctgagtgatgggcacatggtaagaccatgttctgcctgaatcggtgaattcatatagcttcgtcttctggccgtctttcagttggtcaagtggacatccagataataaggccaggggtgtcagtgccagtgtgctgtgcagaaccatgcgtaaaccacagcagacttttgtcttctcagtcccttgaccctaagggactccccagaggttgtcagtgtgggctgagggaggaaagcggttgagcagccaccagtgcaggaggcatctgccccatagcttaggcagctgtgctgcacctgccttccttccacaccatctcctgggtgccatttccaccctatgaggccactgctgcatctgcccaaccttgtggcttggtctgtcagtaacacctggagtgggcagcaggttgctcagtcattttatgtcccttagctgagtgttcattccctgccagggcctcacagccagcctggggctgtttctcagcaggagagcaggtacctgcaggagagctagctcacttgccctctcccctccccgcctcccctcccctctgcctcccgtcccctcttcccctccccgcctccgcttccctccccgcctcccctcccctgccctgcccttttcctcttttttttttttttgagactgagtctccctcttttgcctaggctggagctggagttcagtggtgcagttttggctcactgcaacctccacctcctgggctcaagcgattctcccacctctgcctcccagctagctggaaccacaagtacatgccaccacgcccagctaatttttgtattttttgtagagacagggtttcgccatgttgtccaggctagtctcgaattcctgggctcaagcgatcctcccacctcagcctcccaaaatgctgggattataggtgtgaaccaccacaatcagctgcctggcctaatttctttttcttttttttgagttggagtctctctctgtcacccaggctagagtgcagtgtcacagtctcagcttattgcacctgcgccttctgggttcaagcgattctcctgcctcagcctccccagtagctgggattacaggtgcatgccaccatacctggctaatttttgtatttttagtagagacaaggtttcactgtgttggccacgctggtctcgaactcctgacctcaggtgatctgcccacttcgacctcccaaagtgctgggattacaggcgtgagctacgggctgtacctggcccggcctaatttcttaacatcattaaatgtctactgcattcatatttttccagctgtcatgtcagtacctgcacgggcacatgcatgcataaccacatgcacacatggttggtttgaatcaggatctaagcaaagtctgaacattgccgtttggttgatgtcttctctcggtttgttgatggaattgggttgtttttccttgagattcctcacatcagggtttgctcactgcagcctgtgagattgtttcatgtgggtctcgtttcctgtatcctctgtttcctgtatcctcttgtaaattggaaggtagatttggagactcataagagtaagctttgtgttttttttttctttttttatcaaggaaatattcgtggcaatgcaagcagcgtcaggagctgcagaggctgtcactgctcagtggccccagtgtccttcatggagttctccacagcctttcagctcctgcctttggcagtggctggtgacccgtgcccgcatctgttccttcattagggtgtgcaaaacggtgacattataattaggtcactctttgcttttattgccagaattattcttaagagaagaattttcctatatccatgatttggttattctgagtttatttgggaaagacagaatagatatttgatttgcttcctttcaactttcgggatgatgcgttgattctctagcattctccaaaggtgactaatggtctcttggagctttgttatgaactattgaatgctgtggtatttcatgggtttgaatacattgcaggtaatattcttaatatgcttattgaccttcagactctctgatcattgtccagtggaagtctcttctagtttgctcttgaattttttttaagttttaggtatttttatttaagggaaaacatgtaataatgaggtattttaggtcgggcgtggtggctcatgcctgtaatcccagcacttcgggaggccgaggcgggcggatcatgtggtcaagagatcaaaccatcctagccaacatggtgaaaccctgtctctgctaaaatttcaaaaattagctgggtatggtggctgcacgcctgtactcagctacttgggaggctgaggcaggagaatcgcttgaacccgggtggcagaggttgcagtgagccgagatcacgccactgcactccagcctggcgacagagcgagactccatcgcaaaaaaaaaaaaaaaaaaaaaaaagagaggtatttcagacactggcattttttcgtaaatatttgaagtgaattacgtagatcttaagtgtgcagtttgatgtcttcacaagtgcatgcacccctgtaacccacactcgaccaaggcatagagcatttccagggtgggcaccgtggctgacgcccataatcccagcactttgggaagccgaagcgggcggatcacttgagatcaggagtttgagaccagcctggccaatatggtgaaaccccgtccctactaaaaatacaaaaattagccaggcgtggtggtgcgcacctgtagtcccagctaccttagaggctgagacaggagaatctctgaacccaggaagcggaggtagcagtcagctgagatcgtgccattgtactccagcctgggcaatagaatgagactctgtctcaaaacaaaaacaaaaacatttccatccccgcagaaagtcccctggtgcctctcaatcaatccatactatccccattcgttggcagtcatgcttctgacttattttaccaagattagttttgcctcttttcagacgtcacataaagggagtcatatagtataaactgttttgggactggtttcttttgttcagcatgtttttgaggttcattcccgtggtcactggtttcctgagtcctgttgatatgaccctggcagtcttcagtcacttccttgctttctgctaccacaagatgctccgtttgtccttgtttgtgtctgccccagacctgaaggaagccacataaagggcaggtgtgtggtccctgactgtcaaccagggaagtccgtctcatcctgaccagcagcatgctcaccacatgagcctcctgtttttatctccttttctgtgacgtggtttctcgtttgacctttcctagccctcgagcatgttccaaactcggttcgcttgtggaaagcagccgttgagctggaagaacctgaagatgctagaatcatgctgagccgagctgtggagtgctgccccaccagcgtggaggtgagtctggcgggctcagggccaccagagcccaaagtggccaaggcctgagcccaggttcagtgtctggaagtgatgatacaagtggagcattgagctcactcaggctgcaatttctgggagcagaaggccctgtggaaccccaggatgccgttctgtacatagccgctaggcagggtggtcagtggcctcagctagctgtgctcttaatggacgtgcagggagaatcttagctcatacctgaccactgcagaaaattctctgttgggcagttgctcaggggccatttcctctcagcagcccagagtttgtcatgggagccgaaggtggcagcgtgatagaaaacattgctttctgtcagctccgcatgactgctctttgcctctaagctaagtgggatttctttggttttaagcattccagttcacagcattctgtgcagtgatttttagtcttggttttatgatacctagtatgtctttaattatcctaaggggtattgtgaaattctccaaacaacattaatcttattttatttacataaaaatgaataaagcccgtacacatcttagggatggaatgctgcagaaccaagggtctgggaacttcaggaggctgaacacccttctgtgtgtttagcctgtgagggcagtagcctcatcctgctcgtctgtgccagcccctggtatcaggtctggcgtgctgtgtgcctggaggctgtgtttgtgaacattcaactgagaatcttttgatgctcacgagagtcactaaatgagtcagaagcataaaggaacagttggtcaggtgagaagtgctgctgtggacacttctcaggccatgttcagatggttctcgagagctaagaaagaacgtggtggccaacgctggagggtgggtcgctgtctggcctgcagctgtccccccagcacagtgtcctctcctttttctcgtgtcctctccgcgtagctctggcttgctctggcaaggctggagacctatgaaaatgcccgcaaggtcttgaacaaggcgcgggagaacattcctacagaccgacatatctggatcacggctgctaagctggaggaagccaatgggaacacgcagatggtggagaagatcatcgaccgagccatcacctcgctgcgggccaacggtgtggagatcaaccgtgagcagtggatccaggtgggccgcaggcgggtgtcgtggtgtctgctttaacagtgcacatgcagcacgtgagagtcccacgcaggactgggggttgctggatggtactggggagtcctgtgccaaaccagaagcaggcacaggtgtgaatgggccctgagggacctgggcatgcccactgtcgctcttgatggattcaggcctggagttcgtcttggggtgaacacttcagaagccctttcagtgtgtgcacacctgactgcatttctttgctagtagaaatgatacacctacgagaggaggacaggaagtctcatggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcacggcttctttctttgctagtagaaatgatacacctacgagaggaggacaggaagtctcatggcttctttctttgctagtagaaatgatacacctacgagaggaggacaggaagtctcatggcttcttttactcttcccctctcccccacaccctttttttttttttttttttgagagggagtctttctgtcacccaggctagagggctagagtgcagtggcacgatcttggcttactgcaacctccacctcttgggttcaagcagttctcctacgtcagtcacctgagtagctgggattacaggcacccgccaccatacccagctaatttttgtatttttagaagagacagagtttcaccatgttggccaggttggtctcgaactcctgacctcaagcaacctgcccgccttggtcttccctgtcttttatctttgtctgtagacttaaggctatagaaaagtttccaaagatgatctaacttaggaagtagggcttgggttccctctaatgccttcttttaaggagtcacccactgagttatgtttctctcaagaaaaataaataatgaaattactattttctgttatattttatgacagtttgtctttctttccttccttcctttcttcttctttctttctttccttctttctttcttgagacagggtctcgccgtgttgctcaggccggagtgcagtggtgcagtcatggctcactgcatccttgacctgggctcaagcaatcctcccgccttaacctcccaagtggctgggactacaggcgtgtgccaccatgcttggccaattttttttatttttattttttgtcttgttatgctgcccaggctggtcttaaactcctggccttaagcaatcctgccacttcagcctcccaaagtgttgagattacaggcatcagctgccatacccagcatatgacaggttattaagctataactagcgttctacagaatccacccatttaaagtttacgattcagtggttttagtatattcacagagctatgcgctatcaccacaatcctagaaccttctcatcaccccagaaagaaatcctgtgtccgtgagttgttgctccccattttcatacctctgtagccttttgtttttgtttttgttttttttttgagacagggtgggtctctgtctcccaagctggagtgtatggtgcaatcaatcttggctctctgccacatttgcttcctgggctcaagcaattctcctgcctcagcctcctgagtagctgggactacaggcatgcgccaccacacctggctaatttttttctattttttgtagagacgcggttttgccatgttgttcaggctggtctcaaactcctgagctcagatgatccacctgcctcggcctcccagagtgctgggattacaagcgtgagccaccgtgcctgtctaaccttgtttttttactttctttctctacacatttttttctggacattttatatacagatgttcaacttatgggcttatatcctgataaacccattgtaagttgaaaatatcataagtctaaaatggatttgaggctgggtgctgtggctcacacctataatctcagcacattgcggggctgaggcgggtggatcacttgaggtcaggagtttgagaccagcctggccaacatggtaaaaccctgtctctactaaagatacaaaaaaattagccaggcatgatggtgggcacctataattccagctactcgggaggctgaggcaggagaattgcttgaacctggcggaggcagaggttgcagtgagccgagatcgtgacactgtactccagcctgggcaaaagagcgagactctgtctcaaaaaataaataaaataaaataaaatgaaataaaatgcgtgtgatacacctaacctactgaactttacagcttagcctgcctacgtcaaacatgctcagaacacctaccttagcctacagttgggcagagtcatcgaacgtaaagtgttgaataactcacgtaatttattgaatgctacgatgaaagtgaaaaacagactggtggtttgagtcaaagtattgcttctactgagcgtggtggcttttgcatcgtccgacaccgtgagtggaatcacacgacacgtggtcttttgtgactggccttaacttagtgtgttttcagggttcctccatgttgtagcatggaggtattgaaatcctttgcctacttttacattggattgtgtctttattatggtctatgtattatttttgtctgttgttttattattgagttgtaagagatgtttttatatattctggatatattgtcacttatcagagacatgatttgcaactacagatggtccctgacttcccatggtttgacttttgccgtggttcaaaagcagtttgcattcagtagaaactgtccatggaggaagagccagcgcagtttgcgttcagtagaaactgtccatggaggaagagccagcacctttgccgcaggcccctgagggtctgggtgctgggtccttgccccacgcattcttctcaccactgacctttgtgccagcgtctctgcctcagatccttgctcttggctctgctttctgtctgggatggttttctggtgctggcagggccctgggagggtctgggaggcatgtggctccggttgcactttgctcacggtccatgtcgtggtcccccatgttggcatgccgcagtggtgcctgtgctcctgcaccctgttgctctggctgggttattgttctcttgttggtagacacattctcttgcacacatgggaatatatttgtcacatgaatgccttaaagtagaactgctgggtcaaatatgtgcctgttttattttgatagagaatgagaaattgccctccatagagatatgtgcttctttgcagtataagatttatgcccccttcaccaagtgagccagtcagcacatgtttcaatgttgctcatctgatacgtgcacaatggtacttagaatagtttaattagcatcttgaaaataagaataggggctgggtgtggtggcttatgcactaatcccagcactttgggaggctaaagcaggagggttacttgagaccaggagtttaacaccagcctaggcaacataaggagaccctgtatctatgaaacataatgtaccattgagcatggtggtgcatgtctgtgctactcgggaggctgaggtgagagtatcccttgagcctgggagttggaagctgcagtgaactatgattgtaccacagcacttcagcctgagtgacagggagagaccttgactctctctcttttttttttttttctgagacgtagtcttgctccgttgcccaggctggagtggagtggcgtgatcttggcttactgcaacctccgcctcccgggttcaagtgattctcctgcctcggcctcccgagtaagctgggattacgggcacccaccaccacgcctggctaatttttgtattttattttttagtagagacagggtttcaccaggttggccaggctggtctcgaactcctgaccacgtgatccaccctcgacctcccaaagtgctgggattacaggtgtgagcccccacacctggctgagaccttgtctcttaaaaaaataaaataaaaaggctttacatttcttttcacatgtttgaaagttgtttgtatttttattttctagtgaacagtgtgcctatgtcctttgtgacatttctctattgttttttctgattggcgtgcagtagactcacttcctcagatccccagtaggcagtgtcagcatcttgtgctgatgtctgtcagttttaaccgttcaggaactccgtactccccgttgggaatctgcagctctgatttccaaaatcacaaataagttttgtgttcctctttcaggatgccgaggaatgtgacagggctgggagtgtggccacctgccaggccgtcatgcgtgccgtgattgggattgggattgaggaggaagatcggaagcatacctggatggaggatgctgacagtgtgagttggcaacaggggcctttgtccgtaatatggagtctctgcttgtgggaacagcaggcaccttataaactactaggctattttaaaactctttttttttttttttaaatctgagacggggtcttgctctgtcgcccaggctggagtgcagtggcgctatctcagctcactacaacctccacctcctgggttcacgccattctcctgcctcagcctcccgagtagctgggactacaggcatgtgccaccacgcccagctaattttttgtatttttagtagagacggggtttcaccgtgttagccaggatggtcttaatctcctgacctcgtgatccaccccgccttggcttcccaaagtgctgggatcacaggcgtgagccaccgcgcccggcctcccagagtgctgggatcacaggcgtgagccgccatgcctggcctcccaaagtgctgggatcacaggcgtgagccaccgcgcccggcctcccagagtgctgggatcacaggcgtgagccaccgcgcccggcctcccagagtgctgggatcacaggcgtgagccgccgcgcccggcctcccagagtgctgggatcacaggcgtgagccgccctgcccggcctcccagagtgctgggatcacaggcgtgagccgccgcgcccggcctcccagagtgctgggatcacaggcgtgagccgccgcgcccggcctcccacggtgctgggatcacaggcgtgagctgccgcgcccggcctcccacggtgctgggatcacaggcatgagccgccgcgcccggcctcccagagtgctgggatcacaggcgtgaggcgccacgcctggccgcagatttgctttcttactctgttcgctctcatgcacttacctcttatttttttttctggaactgtttgacaatgaatgagttgcagatgtggtgccctttaccttaaacactttggtgtgtatttctttaaaagaggacgttctcttacacagccatagctcagttatcaaaatcaggacattgatgttgggacagtgctgtcaggtaacttcagaccttactcaaatctcacccacaggctgggcatggggctgacgcctgtaattccagcactttgggaggccgagatgggcagatcgcttgagctcgggagtttgaaaccagcctgggcaacatggcagaacaccatctttacagaaacaaaagccaggcatggtggtgcacgcttgtagtcccagctactcaggaggctgaggtgggaggatcacttgagctcaggagtttggggccgtagtgagctgtgattgcgccactgcacttcagcctgagtgacagcaagaccctatctcaaaaaaagaaaaagtctcacccgttgtctctgtgtccttttagcagaagaaaaaaccaactgtcttctgtgaggaatacagggtcatcctcaggctagtctggaagagagcctcagcctttgttgttcctgagtgtgaattttttgaggaccacgggccagtgatgctgtagactcctctttcatctggttctctgtggtgtctcctccgggttgggttgaggcttcttggtgcatcatacggagaggtgtgcacctgttcaactccgaccgtctggtgcgggcagtggccgcaggtgtttccactgtatggttgctgtttgtttctttgttattattaataagtattttgaggatccattaatgatgcttcttggcctgaatcagttatttctgtggtgtttgctaaatggtgattttttttaaatctttttttatatattaaattttttttgtagaaacagtatctcactatgttgtccaggctggtttcgaactcctggcctcaagtgatcccacctcagcctcccaaagtatgtaggattacaggcgtgtcactgtgcctggtcacacctgcataatgattttgtgaacagtttctcttacattttattagttggaattctacagtaacgaagagcttcactttctccttcatccgtgtgcgttcacttccttccatctggattggtcaatggctcctcctttggtccttggaatcagaccccactgctggcattgaccgtgtgatacacacatgattcttttgcaccccgtgtggcgtgacccagagcttgtgtgccggctgggccatcctcctgccccatgtatgctaaaatacacacatcaatccttaggtgagttaagacgcagggcagcggtaatagtttttgttgttggttttttttttttttttttttgggacagagtctcactctgtctcctaggctggatggagtccagtggcacgatcttggctcactgcaacctccgcctcccaggttcaagggttcaagcaattctcctgcctcagcctcctgagtagctgggactacaggtgcctgccaccacacctggctaatttttatattttttatagagatgaggtttcgccatgttggccaggctggtctcgaactcctgacttcaggccatccacctgcctcagcctcccagagccactgctcctggcctgtttttctcttattattttgtcatctctttcacatacactggagtaagcacagctgtttttcaaagtgctcgtgatgctagagtaaggaggacagtgttttctgtgcccagaagtgtgctgtggtgctgcttccctcccggacaccagggccctgggcacagcatcacttgatcctgtgggtgttcaggccactctcgggttgcttgtgaaggtccaaggaggcgatggagaatctgaaatgctttgtcaccaaccctcaggacttggatcagaaatcacagagaggggcatagaccagagtgctctatccagggcctgaccctcaccggcatcctccctgaccccctcagatgctcctggtcaggacacagtgcctgaggcagggcccttgctggtttctgtgctggttgagtcagactgaagccatgtgacttgggaggcatcaggtctgagtgaagaaatctcagtgacatccccactcctcgtcctcctgacccattttcatgctggggctccttaactgggaggctcactgttgtcccttcctctcgtagaaggcagctgttcctctgggaactgttcttgggtgcccctgtgtggggacttggacagctttgagctgccagtccagatctttgccattgtcatgttcatagttgcaaaactttgttcctgacccacttcctggtggcctctcacttaccttcagcaacaaactccttcttggtacaagaatcctttcagcggccgggcgcagtggctcatgcctggaatcccagcacttttgggaggccgaggtgggtggatcacttgaggtcaggagttcgagaccagcctggccaacatggtgaaacctcgtctctactaaaaatacagaaattagctgggtgtggtggcaggcgcttgtaatcccagctacttgggaggctgaggcaggagaactgcttgaacctgggaggtggaggtttcagggagctgagatcgcgccactgcactccagcctgggtgacaaagcgagactctgtctttaaaaaaaaatcctttcagcatctgcagggcgcagaggacggtgacttgcccctgtgtgaggctgagtgggaacaggtgtctgaacctggcccagtgagtctccaggtgtcatgatcgccagtcagacgaacccccagaggctttagcgctgcaaatggtgactggcttttttgttttcttttgttgttgatgctaaccaaaagataaagtcattcttgagtatagggaaaaaaaagcctgaagaaaatagaactgtgtttactgtagttctgttgagtggatgggttttttcctgtttgtattcacttgtcttttacaggtttctaattaatgtaactttttatcgtggtaaatatatactatacctaatttttttttttttttttttgagacaaggtctctctctgtcgcccaggctggagcgcaatggcgcaatcttggcaccctgcaacctccgcctcctgggttcaagcaattttcatgcctcagcctcccaagtagctgggattacagccatgcactaccatgcccagctagtttttgtatttttagtagagacagggttttaccatgttggtcaggctgatctcaaactcctgacttcaggtgatccacccagcttggcctcccagggtgctggaattacaggcgtgagccaccgctgtagccactatacctgatttttaaaaaagaaaccaatatgtttgatctgcagttacagcatgtgtgtgtgtgtgtacacgtacatatgcctgggccacagccctctgtgtgtgtgtgcacttgtatgtgcatatggctcggccacagccccatgtctgtgtgtgcgtgtgtgcgtgcacgtatgcctatgccttggccacagccccgtgcgtgtgtgtgtgtgtgtgtgcatgtatgcatatgcctcagccacagccgtgtgtctgtgtgtgtgtgcgtgtgcatgtgtgtgcatgtatgtatatgcctgagccacagccctgtgtctgtgtgtgcgtgtgtgtgcacgtatgcatattcctcggccacagcccccgtgcatgtgtgtgcatgtatgcgtatgcctcagccacagccctgtgtctgtgtgtgtgcatgtatgcatatgcctcagccacagccccgtgtctgtgtgtgtgtgtctgtgtgtgtgtgtgcacatatgcatatgcctcagccacagccccatgtctgtgtgtgcgtgtgtttgtgtgtgtgcgtgcacatatgcatatgcctcagccacagccccgtgtctgtgtgtgcgtgtgtgtgcacgtatgcatatgcctcagccacagccccgtgtgtgtgcgtgtgtgtgtgtgcacgtatgcatatgcctcggccacagccctgtgtgtgtgcgtgtgtatgcgtgcacgtatgcatatgcctcggccacagccctgtgtgtgtgcgtgtgtatgcgtgcatgtatgcatgtgcctcggccacagccccgtgtctgtgtgtgtgtgtgtgtgcacgtatgcatatgcctcagccacagccgtgtgtgtgcgtgtgtgtgtgtgtgcacgtatgcatatgcctcggccacagccctgtgtgtgtgtgtgtgtgtgtgtgtgtgcatgcacgtatgcatatgcctcagccacagccctgtgtgtgcatgtgtgtgcacacctccatcacctgcagctagtgacttgtgcacctctcgcaggccaaggaagcagcaagcagccccatgtgcccctttttcagtgttcttgtttcttgtcctcatcctcaggcttgtctctttcatgtacactggagtaagcacagctgtttttcaaagtgcttgtaatgctggagtaagaactacagtgttttctgtgcccagaagtaggtttcccagtcctggattgtggttctactttctttctggagggggaggacagagtgtgactctgtcgcccaggctggagtgcagtggcgtgatctcggctcactgcaacctttgccttctgggttcaagtgaatctcctgcctcagactgccgaatagccgggattacaggcgcatgccaccacgtctggttaatttttgtatttttagtagagataggttttcactatgtaagttaggctggtctcgaactcctgacttcagatgatccacccgcctcggcctcccaaagtgctgagattacaggcgtgagccaccgcacctggcctggattgtggttctaattagataaaacactgtggtacaccttctagcagatatcatctttcagaatcgtatgagcctggggagggcatcatgccacttgttctgtggccagtgctgggctgcccattctcatgtctctctctgctctagtgtgtagcccacaatgccctggagtgtgcacgagccatctacgcctacgccctgcaggtgttccccagcaagaagagtgtgtggctgcgcgccgcgtacttcgagaagaaccatggcactcggtatgtggtgggacccgcctgcccaagggtgctaatgaaacctccagctccatttgtgtagccctgaatttaaacctctcatgtctgctcatccagtcttgtgcccatttgaggtctggccctctggttgtgatgaaggattttatggcatttgggactttgcaactggatccatctttatagccccttctgggacagcaatgataccattttctagctgagaaacaaggaaccccgggggcccgtcctgctaagtgtcctgtagcctgaggagtggcctgggtatagacttgaggctggagcccgcgtggcccatggccgagcactggctgcagcggtgggtggggcagcatctgggctcaggcaggcatattttccatttaagctgtgctggctttgggttttgactggtttttgtgctcagaggaggtccttgacaattttatttaactgcactctttaattgaaaacatctttcaggtccgctttattggctgtaaatgctgattaaatttggcgttgcagtttattgttttaaatggatagctctcaagggcattgggctcgtgtccccacgcaccctctgtccgtcctctcccaggtcctcgggtgatgctccctgtaccaggtgaggacaggccctgctggtttcactggggctacagctgagaatgttgagccattgtctctttgcttttctggtgtgatttaatctcagcctcttcagggtgtctttccatgtgtcctcctgaagacctggccccctccccatgcccaccagctggtctgtgtttgggagtgatctcctttggggacgttttgaaatggctgccatggtgcccctctgtagaaggtcacctggggcagtctgagtgaagaacagggcggtgccaggtgtaggctgaggtctctcggcccgtgacctgaatatgaactgctgcccttgacccctgggcacagtgggcagtgccctccgacttccctgccttctcccgagtgcatgcttgcagggatgaggagaggcagtagtgctgggggagctggtcctctggagagcacggttgctttgctggcccttgctccacacagtgtgattgtgtgtggtcactttgtcttgctgtcgcactcactgaggcccaaaggggtcattgatgtgactgagggtggtgggccacatgagagtccaggagcatcagacctgatgcccacggctggcagttttgctcaatagtgacctgaaatcactttcttcctataagataattcttttggatgccgggagagtgaacctgggatcataatctttatcagtgggtccggggtgcgcttgtgctctgtggttcaagatgaaaaggcctcccctgtcacagactgaggttattgctgcttccaggacacacggctgtaaaaggttctcttgtgaagttcgtctctccagctctgctatttaaacaatgcattcctttgtagaaccctcttcagtagttgattttagaacctttatggagaggaaagatttccccacactctccccattgtaaaatctggtcaatcatttatagcatcgaactttggagcagtaactgtctttctggcgtgcccacgccatggctgagtgtgatgtgtgttctggtttatggccctgcctctggtgaccgtggcctcttatcttgcagggagtccctggaagcactcctgcagagggctgtggcccactgccccaaagcagaggtgctgtggctcatgggcgccaagtccaagtggctggcaggggatgtgcctgcagcaaggagcatcctggccctggccttccaggtgggtgagggttgcctgtgtggtgaggggcctgtgcacacaggagctgacctgggtgctgactggggcctgaaaatctcccacatacaatgtggcacgtgctgttgttggggtgcactggagtccaggggctgctccacaggagcaggggccgtgaaggggcccgagagcaggaaagcagcccacctggcagatacttacctctcggtccccccactcagtgtgaccacgggtaaatgtttcagaacatggaacacggggtcacacaggctgagggcgcccttatgtgaatggatgtattcagaccgcctcactgagccaggcctgagggtgcctggttgtcatgaggggggtgtgtgttttttttaagtaccttgtctttattttcacatataacatcctaatagtttataacatactttttaataagctatagaatgctatataaaagtctgttactgtagctcaggctaatatcatagagtgtgcccttctttgagcaaataccatgagaggggactggcctgggtttaacctttcgctctcagctgcctgtttgagatggcatcactcctgtgagtaactgcagcgtcccctccacctgcccgctctctgcctgtcacgtggcttccttccacccgctctcttgggcggctgtgctgattgggacgcattcagacagccctgggcaccgggctggggaggctttgagggcagagcctgcgtgtccactgggctctgggctgtgtgagcttccgtggcttgtggacgccttctccacatgtcagtggcaccctgggagtcctctctcctgcccatgtgggctcatgaggacaggacagctggcttcccttcatcaagctcaggggaaagagcgaggttgcgtgtgatgagtctaccagtataggatgcgagtgccccattcaggggctttgagagggcgtgggtggatcctgggtaagatggccctgcacctgcccccgttattgctcgagtgctttagcagcctcttcactgtcctcactgtaccagagtgaacatgggcctgtgtgtttccaggtgagtctggattcttgcactggagtcggctctgtcatctcctccctgggaagggcttggaccagactaatcctgtagcagagcaaggcctggctcagttcctgcctgcctgcttttgattaagtgtgatcaggcgctggtccctgtgttctgacccctcttgacgctgctgtacttgcccttcaggccaaccccaacagtgaggagatctggctggcagccgtgaagctggagtccgagaatgatgagtacgagcgggcccggaggctgctggccaaggcgcggagcagtgcccccaccgcccgggtacgcagtggcaggcagggctgggccgtctggggtgcatggtgtgcacatgcgggccccacgcctggcttgggtggtgatgggagtgagatgacggcaggcaaacgagaccacagcacactcatctttgtgatgtgactaaaacattcatgtggccgggcgtggtggccgggcgcggtggctcacgcctgtaatctcagcactttgggaggccaaggcggacagatcacctgagggtgggagtttgagaccagcctgaccaacatggagaaaccccgtctctactaaaaatacaaaattagccgggcgtggtggtgcgtgcctgtaatcccagctgctcgggaggctgaggcaggagaatcgcttgaaccccgggggtggaggttgcggtgagctgagatcgcgccactgcactccagcctgggcagcaagagggaaactgtctcagcaacaacaacaacaacaaacatgttcatacggccgggtgtggtggctcacgcctgtaatcccagcactttgggaggccaaggcaggtagattgtgagatcaggagttcgacaccagcctgaccaactctgctaaaaatacaaaattagctgggtgtggtggcttgcacctgtagttccagctacttgggaggctgaggcaggagaatggtgtgaacccagcaggtggagcttgcagtgagccgagatcgtgccactgcactccagcctgggtgacagagcgagactctatctcaaaaaaaaacaaaacaaaacaaaaacatatatttatccccaccttttgtgtacacaaacaggctatgaaaagcttacaaaagtacacacagtactgcaggtaacagtgttgaggatgagtgtaccatgaagcacgtaccctggagctgatgccctgcgtgacagtgcatgtctgccccacaggtgttcatgaagtctgtgaagctggagtgggtgcaagacaacatcagggcagcccaagatctgtgcgaggaggccctgcggcactatgaggacttccccaagctgtggatgatgaaggggcagatcgaggagcagaaggagatgatggagaaggcgcgggaagcctataaccagggggtacgtctctgcctgcaccctggggctgcagctgacccggcattcacaaaactgagccccctggtgcagggtcattgcccttcgcctctgaggagatgtggagggctgggggttacagctgatggagctgcagactcaggacccaaaccctggtcccctcgctgagttctgtgcttttccttatatgaagctgcacacactgctcagaagtgcagagtgtggcacacctgcagtaaaggctggtacgtacagacctgtgtgcacaggtccacagcaccaccgcacacctgtacacccacaaatgcagagtgtgaggggtgtttttccatggacatggcagccctgagggactcggtcacccactgcagatgagaagctgggcatggctgtgtcccagttcttcatagacaccacctgagctgctctcttacttgttggttgcagttgaagaagtgtccccactccacacccctgtggcttttgctctctcggctggaggagaagattgggcagcttactcgagcacgggccattttggaaaagtctcgtctgaagaacccaaagaaccctgggctgtggtgagtcctggagggggcagcctggcctctgggcacagcttccccatcaggtgggccgccgtcacccagctgcttgtgtggagtcactcgtgcagtgcttccaggctcaggggcttggggggcggtaggtgctggccatgaaaaatcacggtccctgccttaggagagttcggcctaggtactgtgacaggcctgtagatggtttgatgcagtttaatttgtgttctgatggagggcgcctgggagagggaggggttaatgatggctgggacgagggaaggatggaccccggagagccagctccacagaggaggtggcgtggagagccctggaggtggacaggagcctgctaggtgcaggctctgttcatggaggtgctgcgtccagctcagggtgacggggctggagcactgtgcaggcactgccgcagacaggcagcttctgggtgccttgtgcggccctggctctcccagtctggtcttgtttgttctggatgccttcacctgcatctggacagcgtcaggatctgaggtcttgccttggggcggttgccagtggggctggcagggatgtgggccccagcgccttgtttctgtggtggatgagctctgctgtggagggaatggagtttttgctgctgtgactgggtggagagccctttcagacaaggcttcccagaagctaccagaatatgtgctgttggtagacggctgtgggacctccgggggcctgtctcctcaggttggagtccgtgcggctggagtaccgtgcggggctgaagaacatcgcaaatacactcatggccaaggcgctgcaggagtgccccaactccggtaagggggtgccccgactccggtaagggggtgccctgactccggtaagggggtgccttgactccggtaagggggtgcttcctggcttcccagactccgcagggctggcacttcctgagggagtgggggctcaggcttcagacggactttattaaaatgtgtagtttgtgtgaatcatttcagtcaaaagtttcagctatactcggccgttaagacaacttaatgaaattcttggcctcaaaatgggagaatttgatttcatttctgaagtgttatcatttctttttcttttaaaatttaaaagaaattggccaggtgtggtggctcatgcctgtaatctcagcactttgagagactgaggcgggaggattgcttgagtccaggagtccattgcttgagaccagcctggccaacatggtgaaaccccgtctctactaaaatacaaaaatgagctgggcatggtggcgggcgcctgtaatcccagctactcgggaggctgaggcaggagaattgcttgagcccgggagtgggaggttgcagtgagctgagattgcgccattgcactccaccctgaatgacagagtgagactctgcagggtgtccagtctgtgccctcagggctgccatggttttgggtgggccagagtgctcatcctttgtggttctccttgcacaagttctgcgagccgtgtgtgggaggcccctgtcgtggtctgaggacgtcccgggttagaatctgtaggctgggcacctttccggaaccagaggctggagtgcaaatctttgttctttgtttctgaattataggtatcctgtggtctgaggccatcttcctcgaggcaaggccccagaggaggaccaagagcgtggatgccctgaagaagtgtgagcatgacccccatgtgctcctggccgtggccaagtgagtggggcccccacaggattgctgaacctcggggtcctaatgggctctttttccagagtctgtctgcctcttcctggtcattgtaaagatgcccggcagcagggtgggcttccccgatcctcggctgccgtcgctcctgctgtggtctggggcaggcgcctctcctggcagacacacctgagggtgccgtggtcagagactcactggggacgcatgtgattcacactggtgcgctggccgccgggtcacagactcactggggacgcgtgtgattcacactggtgcgctggccgccaggtcagagactcaccggggacgcatgtgattcacactggtgctctggtcgccgggtcagagactcactggggacgcatgtgattcacactggtgcgctggccgccgggtcagagactcactggggacacatgtgattcacactggtgtgctggccgccgggtcagagactcactggggacgcgtgtgattcacactggtgcgctggccgctgggtcagagactcactggggacgtgactctggaaccttgcaggcagcagcgggtagccatggggcagagcatgcagactctaggcacatgtgggcaaagacccgccaggtgtggggcacagcagggagctcagggccatccccgacccccagggtccctgtttccttctagaaagaggatgacagtctgggaaggagctgggcctgagtgtgggtcaggaggctgggaagtgaccatgtggggtgaagggagttcttggaagaaccctgggttcctgaggctgcagctcaggacgtgggctcacctggcagaggtggcgtgtctggccccaggagctctcctgtgtccggcttcccctccacctgccccgccatgggtcatgcagagacaacagccttcctagtgctggcttttgattctctccatcccttctccccagcactgggtggcagtggtgcttggtctccagaggtctgggtgccgcccccacaggcttgcctgtaggggcacctcctctcccctgcccgcaggcccccgacagatgagagaggctccccacagggaggcttgtgtctgcctggtgctaccttggtcctgccctgtgcgttcacctcccagagtgacttctgggtgacactctgatagtgcagccataaaaccttataaaaggctttgctaaagtaaataagtcactccttgctattcccaagccagtgttttgtgtgtctgctatctgggtttgtgctctttaaatcacagtttatctaacaccgggcaattaagaataccacaaggcttaaaaaacaatcaggttatcagagtgtgaaattattccgtttggcaactgagacgaacccgaacagctgcccggagtggaggctcctcgtgttgtctcttgactacggtgcctctggctccagggggaggtgaccctgaggagagggtggcagcaacgcagagtcccgggcctgccagcatgctcagcagccagcgcccgccatcccttctccagcagcgggtgggggtgccatgcacacccttacctggcctctcatagcatggacctcttcgggcccggtttttcaggtgtgcatgtgtctggcaggcacggcggtgtgaatccagtggcctgagggctgtgggctgcaggcccaggcccttgtgctgcctggagcccatcttctcagtgttcactggggttgctgctggaggccgggtggggcaggatgatccagcaggtgtctcagtgaggagctgaaactgtataactttccctcatcaaagttgcagtttaattttgtgtcaggtttagtttcatctccttgtatctgaccctaattttacggagttggaagatctttccctgcgtgtgaattttttaagaaacagtttgggacaggtgcggtggctcatgcctataatcccagcactgggaggctgaggcaggtggatcatgaggtcaggagtttgagaccaccctgaccaacacagtgaaaccccatctctactaaaaatacaaaaattagccgggtgtggtggcgcatgcctgtaatcccagctactcaggaggctgaggcaggagaatcgcttgaacctgggaggcagagcttgcagtgagtcgagatcgcgccactgcactccagcctgggcgacagagcgagactccttctcaaaaaaaaaaaaaaaaaaacaacaaaaaaaaaccaatttggttagacccgtgaagggcagcttcaagttaatgatctggggtaattatttctggatcagccgaggccctgatcctcaggccttcttgaggggagcaccagggctgcgggtcagggatgaagctgatggccctgaagccgttcccctgccccagaataccgtcctgcagccactcactctgggttcacgtccttctgctggaacaggctgttttggagtcagcggaagatcaccaaggccagggagtggttccaccgcactgtgaagattgactcggacctgggggatgcctgggccttcttctacaagtttgagctgcagcatggcactgaggtgaggcccctcgacagaccgccgctcagtgccttctgggactgtggcggggagttccgccagccctgggggctctaggaggtggccacggccagcgtgactctgcccggggtcgggaggatggaccgggtgtgtggggcacagaatcctcgacacctccccacaaggcagtctctgcctccacatccgttttctggttatagcctcacagctccacaccctggaattgaggcaccctgtccgttagggtggcctgtctgctggagtattttaacgagttatttgctggctggagcctgggctcactttaggaatgggaatggagttggcctttttcttgggcctgagcctgagtgtggctttctaggacagcctgggcagcagcccctctgctcccacccgccccgctagagccaagcgttgtctgagctgtgctggaggcagtcaggctgtcctggtcctccctggaaagtgttgccagcccacgtgaaccctaactccttgtttggagaaggcagacgtgagcacttgtgtgaggcacagacatggggagcctggctcagttcctcatctgtgggctgaggctggtggggtccatgctcctcaggaggtggggctcctttgaggaacacacctgaaagagccttgccttccggtgcagggcctgtgccctctggcccgccagttggggttggtgctgccagggccaggtctgcaggggccaggcgagaagcaggcgaggtccggggagtagcgtgggaggacccctgcctgacgtgccctgtggtccccccaggagcagcaggaggaggtgaggaagcgctgtgagagtgcagagcctcggcatggggagctgtggtgcgccgtgtccaaggacatcgccaactggcagaagaagatcggggacatccttaggctggtggccggccgcatcaagaacaccttctgattgagcggttgccatggccggtctccgtggggcagggttgggccgcatgtggaagggctctgagctgtgtcctccttcattaaaagtttttatgtctcgtgtcagaacaggcagcctgctggttttctctggggcccttctctggctcctgcttctgctgccccagtctggcctgtcctggcctgtcccatgccgtcctggggtggctgtgatcgcccttgcttggacagaagcctcttgcagacagccggtgtctcacagaggaggcactgtggaggtgcccgggttccccaagactgtggagaaggtggtaggggtgcagatgttctggccaaaagccctgtgaggacagctggagacagtggggaccaagctgcatgcaggacgcaggtgctcgcaggagcctggcagccgcctgcaagggtcttggtcaggggacagctggggcctccctggggtctgagtgcaaacaggagaacccagctctgcgcagggcctctccacacagcctcccgggcccctcaggcatgtgctgagtgacagtgtcaccagtaagaggcgttctttcttttggaggtgagttcatttttttatttttgagacagtctcgctctgtcgcccaggctggagtgcagtggcacgatctcggctcactgcaacctctgcctcctgggttcaagcaattctcctgtctcagcctcccgagtagctgggactacaggcgcccgctgccaaactcctgacctcaggtgatccatctgcctcagcttcccaaagtgctgggattacaggcgtgagccaccgcacccggccgtgagtttatctttgctaatttatcattcgcagtttaaccctaaagcccttgtaatggttctcatctccaggttgaacagtgatggttctcatctctaggttgaacgttgatcacccgagagacttggcttctcttcagccttagctgtgtaaggataaaggacgtcctcaggcctgggatcatgtgtgtgcattcagttgggagccagctggttcttgtgtaggccggggctagagacatctggctggaggtcatggctggcccagagggtgtgggtggacagtcgttgaggccagcgggcggggaggagggcgctgtcatgtgggctgaggaggctgctggagagcagctgtccctggatgttccttgtgagaggggagccctggagggtcccggcctgtcttgtggtaccgatggcagggcctgtggtggtggtcagtcactgacccacagctctgcccacctgcacatgggggcctgtgctaggccttgtggtctgcctgccctgctcctgacgagtgagaatggctggggtgggagatccctgcctgcacgtggggcggtcctggtagaccagaatgtgggtgtgggtcccccttccctgtggttctggggaccttgaggacatggtcaatcccgggcaagggacctgccacccctgtatggggtcaggaactgctggttggtctctgctgggcaggcaacctggggtccagctcaaatcgttggaatgtggaagtccttcctctcgccccgtcctgaggagcagctgcaggagcttcatgagtgttttcactggaacttgtggaggagtttcctttgatccctcatggagagacggaagcatgagggagccctcaacatttattctgaagatgaagagagtcctgcagctttttggagtttgtgaagtcagcccggccctgtacagatgtggaaaccgaggcccaggaagtttgtgagccagcccggccctgtacaggtgtggaaaccgaggcccaggaagtttgtgagccagcccggccctgtacagatgtggaaaccgaggcccaggaagtttgtgagccagcctggccctgtacagatgtggaaaccgaggcgtaggaaggaagcccttctctgacctcagagctgaaatggccagtgctgggtgggcattgaggggtcacacagaaaagaatgtttcaggccatgttcaggggatacttcctgcagggcccttggaaagttccggagcgcttacattgtccatgtgtgagtgtctcctctttcttgcctgtgtggggttttctcaaatgctttgagttggccaaaccacagttgtgcgccacttaacagtgcggatacattctgagaaaaacctcgttaggtgatgtcgtcttgcaaacattaaagagtgcatttacacaaggctggcaggcacggcctcctgcacccccaggctgtgtgcccgggtgccagagcctggggctcctgggctgcagacctgcacagcctgtcacagcatttaatcacatccaaacacggaaaaggcaaaaacgtaaagatgcagtgttacaatcctaggggactcctgtcacctgtgtggtctgttcttgactattgtgagtcactgacttttccccctgggaaactaccttaacttgtcttcaactgaaattttttcagcctgcaaagatgagttgtgcctcagaggttgctcgtgttctgaggtgcctcttcaccactgcctgtcaggctgctaaccagagtgccccagaccacagcagaagcgacagcagccaaggatcgggggagcccaccctgctcctgggtatctttacggcaggcagcagagtaacagcctcagacttacctcttcagccagagacccctcagcccaggaggagtgaggccgggccagcagcgggggcccgggaagccccatgtcttgggacctgctggggcagggccccctggatgtcaggctgcaggtccggcagctggggaggggatgagggcctcccaccagctctgcccatcagccagatccctgggagaggcagcacttgctggccacagagtcggccccagtctcacctggctcccctcccccaccagctgggccctgcactgccccagcccacgcggcgcctcacccctccttgacagaacagtatctctgggacggacaagttaatccaagacccacagtagccctggatcccctgggagaggtggctgcccagctccagggccaggttaattgaagtgatagggagtggagagagggagggggcagggctgggattgcgtggcctttccttccctctcctgctccctccctcagcttggaggagccaacttcaaaagcctccgcctggcctgcccctctgcagtcctccaggcagcctgtccagggaagcggttggctggtgttggacctggtgcggcagtgcacaccctgcccaaggaccccaggatcatgtgcgtggcctgctggcgggagtgagggagggcaagaccctgaaaggcccatggtgagcagctgtgggcctcctctagggagggggcttacttgggtggaggggctgggggtacacacagctcaggagacactgcttgttcccctgagccccaccaggaaatctccggttggctctggtcactgcgtccctgtgggtggcactgggtgcatgtgccctggcttctggcagttgggggaggggggctcctgggtgccgggcaaccctgttctaagctgggctgaggcttgagcctggaagtggtactaacaggccagttgggactcccagggcagccagtctgccccacctgggtgggacacagcaggtgctggacatccttgcagctccagctggcctgctcaggagtcaggctctggttctcgctatgacctctgacccagagcaggcagagggaatgacgtggcaattctgagcccaccaagttggctgtggcgtgtgtggttgggggggtcaggtttcaggaaggggccacagcaagccatctgctcttccagccattgctgctttgtgctctgagcaggagctgccaccgcccaccaggcccccagctctatgcaagggttggggtgctgcttgttcaggctcccctgacagggctaggaagccgagtcgagtcctcttatcttggttgggttcgcatgattaatttccagccctagatctgctgtctgactccatcctgggggcccaggggaagggttggggctggccccttttgggtggctgggaacctgggggccgtcagctgtctccttgatgtttgggctttatccctgcgggcgcaggccctccattttgggtcgggggaggcctgtggcacaggctgcccggagggatggcgtggggcggctggtacaggcagaggggccttttgcgactgttggttggggctggatgtggtggctccttcctcctctatagcttctgggtgtccccctagctttccccttccaatagggtgtggcttggagctctgagcccctgccccagttgggttgggggtacaaggagtccccagttcccacgtctctgtgagctaacccagagggcgccagtatgggaggtgtggagttgaatgggcatggccatgagtgagacaggctgtactgggacaacttcctactgtacccccaagagcctgcagaccagccccactagagctgtacggggctggtggggggccctgctctgtgcggtcctgagggtgctccaccccttgctggccccactcccacgtggaccacagagccaggctctcctgactctgggcctgccccctctatctcctgatgggttcttcaggactcagtgacatcgcctcccagccgacatcactcacccctttcacatctttgcagggagcatagaactgtctggtttgcagacctatctcttgtgtctcctgatttatcccgccaggcctgtgcctacagcctttcttgattggtgacacgtccatttcattcgctcagagatcccgtggggtggggcagggggtggggcttctacggaaacaaagtgcaggtgggctggctgctccctgtgctgggaacaccccccaggcctaaccccaacctgctgtctcctccaggtaccccctaagcctgcactctgggcgctcctgctggcgctgctggggaccgcgccaagccgcgcctattccccggcctgcagcgtccccgacgtgctccgccactatcgcgccatcatcttcgaggatctgcaggccgccgtgaagtggggcggggcgggggccgaaaagaccaggccaggctccagacactttcatttcatacagaaaaacctgactagacccgggagctcgggacggcggggacggcctcgggcctcctgtggcgcccagaaggtatggaggaggcgcccctacccaagctcgccggcctgctcctctctcagtttccccccacccccaccccgccttcctcccttccctccccaggagcacagtatcctcctgtccatctcgtccctgggtcggaccctgcgcggggcggtggccgggggccgccgcggggccctggagagagctgcttggaccgtggctgtgcgcaccgaggcggtgatgcggcgccactgcaggacgctgcgccaggtgtgcgtccctgagtgcacccagagccagacctcccttaacccccacagggccgccgcgcgtcccggggctccacggccctaggctgaagtcgggctgggtcgcgtctcccttcccgggccgggccgggcgcgggggccgtgcgcattcgctgaccgccctgtccccgacagcggagccggcggcccaagatgcgccctgcccggcgtcgcggcggccgaaggcagctcctgctgcgcgccctggacgccgtcgccacctgctgggagaagctcttcgcgctgcgcgccccggcctccagggactcctagcgcggcccgtcctggccctgcgcggggaggagaaccagcggggccgcggcagagcctggagacgcgcctcgttctgtagacttgttggtgacctcggcccctcgctcgacgcagcccgcgctccccggagggcccaggacttggagaagggagcgcgcctggccgccgctgggtcacggaggaggcccgccctccacgcgccgaaggcctcaataaacggagctggcgctgcgggtccggcactcccttcgcctgcctctctgtgggcctaggaccgccccgggatctgcgcctcggtggcggggggcggtggagggggaatgcggagacccgcacttcctgtggcacctggacggggcggagccgccgctcccagcctcgggcagcagagggcggacgcgggacgctgggcgcgctccggctctgtcagcggctcccggctgggcggagggcagagcgggggactcctggggcccctaaaacgtcacgtatccgtcctgctccactttggaccggggccgggggtggaaattgaggggaggggaaggctggacttggtgaattcggagcaaaacaaccggataaaggaaacgggcccgaagggaagcgggagctgcgggccttggctgtgagcttggccaggctatttcctgctgcctccggaggggtgaccacggcctgggctcagagactgcccagccccctctgcaggactggccaggctggggcccgctttctggcccctggaaccctccatttgctgggggactgtcccctggttcccccatctgatgcgcaggtctgggagtctgtcacccccctcccccaatctcggcccatggaggagcaggggaggtaaagtacctgacacctgttaccctccccttcccggaaaggccgcgagcaggctgtgcctctggcattctgtgggatcaggggcagcagcagaagaaagaagtaacctcccaagctgaccctgacccagccccacactctgtgttaatgtatttagtctgtgcaacgggagctactgtctctgttttatagatggggaaactgaagcacgaggaggctgagacttgccccaaatcacagccagcaatgtaagagctggcctcagacccaggcccagggcatgggatctgccacatgtcccctgcctggaggctgggggccaagcttcctggacttcagagccttggattcccctgcagagttagcacttctgacagagtccctggccatgctctgagcacaaacacctagcaagcattcccagccctagttctgcattgcctgctccgtgggggccagtgggggcaagtgtgggagggatgagggggagatgcagggtgcaggagccccagctggagccaaagcacttgaggggggtgcttggacttatcccgaggcagcggaaggtctttggtgaaagagggatgttagagttggaatctagaaaggttcccgtgacttgtgtggagggttggtgaggacaaaggggtggagagaggtccaggctgcccagggtcctggctggagtacctgggtgggtctgtggggagcctgaacatgggaagcactaaagggggagtgggtcggtttgagggccctgagggagctggggaactgtggacgtggctgggctcagctgggcgtgctggtgtatggagcataaggtatggacagccgagcatggctgggaggcagctgagttggggcctggagagagtccagggttctgggctgggctcagggacaggatggggacaggccctccatgaaggctcccactgtcacattgccccaggggcagctgacttttgcacttggacctgccccaacccctgggccatggggagggcactcctctcctgtccatgcatgacctcctgggcggccccttggctcctgcccacccgcaatgctcccgttctgctgttgagagcagtcagaggctggggatgtgggtgggcaacagaaacagctccctctaccctgactgagaaaggttcaaacaaaccacagcctcttgggggcaggaggaggaacagaggcctcaggattttggggacacatgtcggtgcctagtcctggaccacgaccacgtgggtgggtgagaagtcctgcatcctggcccatggctcctctccctcatgcagaatgggagcaaggtgggctttgggcttctgggacaaagttcacttgtccagggtggggacagcccaaccagactaggtctaggggcatgtgtggagctacacgaagcggcccagagctaccgagagccacagagactaggagagaagccgcaggtgcctgctcagacctgagaggctcaggtcctctttgggctcagcactgggaccgtagctcttctgtagctccatgaggatagaggcatgtctccctcagcatgatacaccagcacctggcccaggccagcacacgagctgctcaacaaatgtttgttagctggaactgaccagaaccaacccagagatggaaagagactcactgggcccacggctgatagggacagagccattggccacggaaccactgagggcagatcccatggactggccctgtatgtctctagaccgactggtggtgccttccctgcagaggcccagggcaggtggcctgagcctggttcttcgtaaaatactgtttctgggttggggctgcacacagtactgtcccgtcccaccctcatgccttttcagggcttggctgctccagggaggtgggggctgtgccagggtaacagatggagcctgcagggcgctggctggggttgtgcaacttcccacagcccaggagccaggcccctccatgtgccgcactgggaggagggggccgggcaggctttgaaggggacctgggtcccgaggcctccccagactgggagtctttgaaagaacatctggaactcgggcaactggctgactagtgtctggatttgcaaaaccaaaagttaatcccgactttgcctcctgtgtgttccccacccctgcccccaagctcctctctctccccagcccacctccaccccttcagcggtggggcgcgcagcctctcagggtctcccaaagcaccttcccccaccaccgccaccggcccccaccccagcctgggagttttgccgaagctgaccagagggaggtggtggggaagatggatgttttctgagtgcctgccatacccaggccctgtgagcggacgggacagaccgtcacaccgcggctggagatggctggggggcagtgtgagtggtcctcagaggaaacagctgcgcccagacctgggaggtgcccggccttgcgtgggctctgagccctgcaggtgtgcagggaggcccccctgctccagctgtggctgactcggaaccaagtccccccaactccaggaaacacatactcactggtggggggatgtcaggtgctggggcccattgtctctgccagtgccttcaggaccctagggggggcccagcgacagcccccatcctgccccctccccaggaaaagacgcagctccgtaaacacagaaacaaccatcgctccctccccgctcttcccctccccattaaaatccggaagagccagcgggaggtcgcacctgctgggggaagtgagtccttgttttgggggaaatgaggaggtcaggcctctgggcgcagggcagagccgcgtgcgctggggaggtgggcagccctggggctggacgcgggttcccgggtcgccttccggcctcgctcccgtcgggaggtcccgacacgggcttcctcgcagcctccccgcctggcccggcccgattttggccgctgcggtcaggggaagaggcggccggggctccccaccaggtgagcaggtcctgcccggcttgaggccaggggtccgggctgcggcccgagataagcgtcgcgcccgccgccgcttcctgcgcttccagcgccgccacttcctgttttctcgcgctggcgggcggggtcgtgggagacgggacgggggtcgtgggggacggggcggggtcgtgggggacgggacgggggtcgtgggggacggggcgggggtcgtgggggacgggacgggggtcgtgggggacggggcgggggtcgtgggggacggggcgggggtcgtgggggacgggacgggggtcgtgggggacggggcggggtcgtgggggacgggacgggggtcgtgggagacgggacgggggtcgtgggggacggggcggggtcgtgggggacgggacgggggttgtgggagagggagcagggtcggggaggatggggtggggtcccggggaacaggagttgcggggagcgggagcgggccagagcagtctcagcaagaatgaacctggccgggcgcggtggctcacgcctgtgatcccagcactttgggaggccgaggctggtggatcacttgagatcaggagttcgagaccagcctggccaacatggtgaaaccccgtctctacttaatacaaaaattagctagacgtggtagcgggcgcctgtagtcctagctcctcgggaggctgaggcaggagaatcgcttgaacccgggaggcggaggttgcagtgagccgggattgcaccactgcactccagcttgggcgacagagcgagactctgtctcaaaaaaaaaaaaaaaaaaaaaaaaaagaacgtaggtgagaccctgcgccttctgcacgcctggagctggctcctggggctccccacctggcctgggacagaagtggtgggtgggctggatggagggttgagccagtccctgtagggccttagttttgagggggcctgtttgggattggaggtttgcagctctggacccccctttccagggcagctgttctagcatgggttccaggtacttaacatattgttcagactttgttattagagatacgcatttttgtaattttaataaaaacacatctacacaaaacattgtacacaaatgttcatagcaacattattcattattcattatcattatcaataacactatcattattcatgatagccgaaaagtaaaaaccatcagtgtccatcagtcgctgaataaataaaatgtgatatattcatacaaggaggggatgttactcagccacaaaaggaatggaacgctgacaggccaccgcatgggcgaaccttgaaagtgtgcagggtgaaccaagccagacacgaaaggccacatatagtatattatcccacttacaagaaatatccaggccagacactgcaaatccacagagaccaaaagcagtttagtgtttatcaggggcagggggcaggaaagaatagggagtaatgggtttctcttgagggtaatgaaaagctctaaaattaaagatgggtgtgggggcgcacgcctgcagttccagcgagacagggagggtcacttttcgaggctgcaggcgctgagatcgtttctgtgaatagcccctgcactccggcagcctaggcaacatagcaagacccctctctaaataaataaataaataaataaataaaggccaggtgtggtagctcatgtctataactccagcactttgggaggccaggtgttcaagaccagcctgagaatcataggagtctctacagcaaaccaacaaggagcatagctccgaggtagagcatttgactgcaacagacagaatgctctaaaataagacagtggagatggtttccagccttgtgactacaacaaaaccactccattgtatccttaaattttatgtaggttttgtagaacgtaagtggagcggttgggttttctggggtgcttttcctgctgagaggtgggggcggagtggtggggggctaaggtcttcacatgtgccctccttgcctgccccagcaggaccttgctggggtgaaatgtgctcttcgtctggtgtgtggctgggtgtgtatgtgtgtctgtgctggtgctgggagaggggtgcaccatagccgctctcagcccccattttctctgactctgcccctgggctgcctgctggggagagttcaacacctcgctcagttcactctagggacaagctgggtcctgggcatgggggacgggaggggagctgtggccagtgccaggcagggctgctagaacttctcaccaggatctaaggcctgactcagcaggaggagggtggagacttcccttggagcctcagggaagaaggcagacagggccaggagcgggaggggtgtgcagctggtgccagggatggagcacccaggccctggggctgttcagcctttggcgggtagaggggagatagatccctgggctgggccctgggagaggccctgtaaggagaccccacccaccgctgccgaggagccgctattggaacccggtgccctcagtggaagcctctttcatgtccccttctgatccttctcctgggcatttccagcctctgggctgggacttgcttcagctcgggcccctcactagccccccaccctggcacttgggggagggacttctcacaggtacccactctgtcccctcctcacacagaccatgaggctgtgttgccacccaaggtatcttccaagctctccaccccattggcctagagggggttgcagtgggggtgaggagtccagaataggggatgtgtgctggccatgggactgccactgtggcctccccaggctgtctgtgtctgtgggagttgccggggaaggcgtggctggggagatgcccagcccaaacagggaggcactggaggccgggggcaggggctgtccacatgaatttaggcagcaggacaggctgggtctgttgtctctcctgccttggttgggggttgggggaggggcaggtggtctcatgcctgggccagccacttgcggattctggctgctgggtcgccctctggctgaggtccccatggaagggggtgcatcttgggcttgctgaccccagggctccagggggtgggccagagcaggagttggtgggcacgagagctgggtgtggcttgcattctcacaggtgtgagcatttatctcatggtatgatcccaggaagagtccatgttggtgcctcagagacccccctccccccgcctccaccgaaagacagatgtggcttgtgtccctttgggtctcaccgtctctgcctccctgctgtgtgctggcagactgcttggaagacatgggcgatgacctcggtgtcctgtgggctgtgtctgcctgcctggtgcatctctgtctacctctgagcctgtctcctgccctcttcagcgtgtctgtgtctgtcccctctgcgtgtctctgttcctttgtctttgagttctgtgtgctctgctgccaatggggtggggaaggggccccaggtgcagcccctactgggggcccatctgaggggtggcactcatgctgattaacacagaggtgacatgccctgcttgaggggagggtacctgtaaaatagccccatcccaccccctccacacacacactcaggtagcaggcacatgtccatcccgccccaggcttgctgcacatccatatgccacacacacactgtcacctgcatgaagggccacactgggagtctcattcacacgcatgcagaaccacagacacactctcagaggcgtgtgctcccccgtacctgggaggctgagccgcgagtgagtttccacaccagggcagtaaaggttcagctctccccaccgactccccacctatgcagagggggtgctggggcaggatatgcccttcccccaggagggaggtgcatgcccctcctcttggcttatacctgccaggccctagggagtgtgtctgtgtctgggtgttcacttttgggggtgattactccaaacttccctgaacacgtgggtttgaggtcgagaggaccaagaggtcagcatggaaagacggtgtccaggccgggcgctgggctcacacctgtaatcccagcactttgggaggccgaggcgggcggatcacgaggtcaggagatcgagaccatcctggctaacacggtgaaaccccgtctctactaaaaatacaaattagccacgtgtggtggtgggcgcctgtagtcctagctactcaggaggctgagcagaatggtgtgaacccagcaggtggagcttgctgtgaaccgagattgctccactgcactccagcctgggtgacacagcgagactccgtctcaaaaaaaaaaaagagagagaaagaaaaagaaagagggtgtccagtcctcctgggggctagtgagatacgactccagagttggggggtcttgggatgtgaagcctgtgctctcctgccttggccatcggacctgtctctgggcagagctggacaggtcacccgggtggggggagcgctgtgggtgtagcatggtgctgtcctccctggggtgagttagaacagctgacggagaccctggagtctgtgtctgcatgtgggctgccaacctgccagcctccctcaggaaagggggccgtactgggcagtccttgggcatggaagttttaaggtggaggcaagggcgatgaaaccctagcgggggtgtgacaggattgctggtatagtctgacctccgataggcttgagttaacctgggggtgggacaggaggggagtggagggctgggggggagtgtggacccatgcctgctacccacgctctctgggatgtgtcacggaaggatgaaggagtgctatgaggttcaagctaggagtcaggctccctgggggcgattcggagggaaggggcgtccagggctatttggggaactgcttttccctccctgcaaacaccacagatgtcagtgtgcagaggaaaggcccgaggatttattgtggcctctccgtccggggacccagctccaggctcctcctttatagaaagcaaacatctgtattcctcacattgcaaaagtctttgccacagtgacgcttctgatcactgaaacttcttggaagaaaagtttaagagtttaattaaaaattaaatatattgtattaggtatattttttaaaagggcaaagtaaaaaatattaatacaatctggttgtagaaaatacactgcaagaaaaggagcaggtgcttcaaaaatgtaaccctggcaactctgccaacaggtcctgggctcgggcttcctggaaaagccccgggacacgtgggaactccaggcaccctcgcaggggccccccgagggcaggtggcccagaagcccaggaagggtggcctgggaggtggaacgggcgcaaggccgagcatcactggctcctagggggctgtgacatggaaccaaacatacacgcgtatgagagagcagagcggcagcgacgcggtcggatcggtcgcgggggctgcgggaggaagcgctgcagggacccgggcggcgccggcggcctagccggagatgcacgcgctgtaatagaccgcgctgctggcgtccgacagcgcggagatcaggctgctctcctctgggcaggacatggcgcgcgggcccagtttggccagtgccacgtggtacgggagcccgggggcgtcgggccgagtccggctgcagttgaggtactggtcgaactcggtgaggtccacgtcggcccacagatcggcggcgggccccagcggctcggcgctctccagcggcggggcctcgggcggcggcgacagcgggccggggtacgggccgggcgtgcccagggtgccgtagtacaggccagcgagcggcgccgcggggggcgcggtcctgagcgcctccgccaggggagccccgtagcaaccgccggggtcccgcgacaactcggtgggcgcgtagggcgcgcggaagggccgcagcgcgcagtcctcgggcgccgcgggcggtgggaagaaggcagcctcgccgggctccaggccgtccagaggcgagcgctcgggcgtgggcagccccaggccgtcgaactcggcgcccagcgggggcagctcgcggaaggcgcgagccgagccagacgccgcggggaaaggctcgggcggtggctgcgggggcgctaatcccgggagcaggaggccgggctccagccgccgggccttgcgcgcctgcttcttgcggcgcggccggtacttgtagttggggtggtcgcgcaagtgctgcacgcgcagccgttcggcttcctccacgaagggccgcttctccgccgcgttcagctccttccacgctttgcctgcgggccgtgggcgccagtgagtggaacgccgtcgggcgggtgggcgccgagccctccgtgcgcccgggacgccccgcgagggtttggcgcagcccccgcaccccgcggcccgggacccctgccccccccgccccaccccggcccgagccccccccgccctctcccccttctctgccgccctcccgccgctcacccagcatcttgctgagcaccgcgttgtgcaggtccgggttctgctgagccagccgcttgcgctcgtcctttgcccacaccatgaaggcgttcatgggccgccggatgcgcgactcgtctgccgcctggcgttccccgcggccggccgggctgaggccatagcgccccggctcggggctgcgcgggggactgcgctgcgggctgggcggcgaggcgggcgcggcgggcgcggcgagggcggcggggccggcggcgaggccgcgcgtgtcagcggcggccccgtgtcccggggcccatgcacagtcgcggcgggcgggcgggtcgtcctgtgcgccgtagccgggcggcgatctctgcattccagctgggcgcggcctgggcggaacggagcgcgggagcgcggcgggcgggcggcgggcactggggagccgggcgcaagggcaggccaggccgggagggcggatggcggtggggacggcggtggcctcgggccgggcgggcgcccagatatagcggctcagggccaatcggcggcggggcgggcgggcgggggcgggtcggggccgcctcctccccgggggctccctttcttctcaggccgggcgggattccgctgaggcctcccccgcgcacagcccccccacctcccccgcgacctctcagaaggagagaccccccgggtgggaaagaaagggctgctgatgagggccggtgctgccagactttcggaggcgagctgccacccacccacggagtcggacccccgggcagtaactgggggagggcggcagtgtcccgctggttgccgttccccgccccccgctgggaggctccatggggaggagagggccctttttcacaccaagttctggggaggctgccttcccaacagccggtaagtccttcctggagtgcagcgccttcagaaaaggccccgtctttggggaggcgctctgagtccccaggggcgcccatgctggaaactctacacccatgtgtaaccgtcagcaccagggactttgagtgcctttatgggacaagatggtcttctgtcctcactcccaaaccaactctggcacaaggcaaagctgacacagggagggagagagcagaggccctggacggagcccacaaagagaagggggagcagggacgcagaggctgtggcgtcctccctgccccccaagggcccttggggaaggggctgggaccctcagtggcttgctggctcccctgcccagcccaggccaccgctgcagcaagaggcagggcctacctgggtccttcccactggcccctccctggaccctctgacctgggcgggggcgggttccggaggagcgtccagcttcctgaattttcactgtccccttcctactccatcaggaggggatctgggctccagagctgagggtctccctctggaggtcctcccctcccactgccacgcatggttctactggagaagggttgggtgtccccagcagccctccaggcagggtcagaatctcgccacctcgcggcacatctcctcatagcctggaggctccccagctccccccgccacactatgccgggagccccatgggtagaggccacaggtcttgtgaccctgagcctgtgtggccagaagctcttggttctctgtccctgccagcctcgctaggccacatccagcctgtgttatgaatggggtgggccccacgtgggccttgcagtgccccttagaggctgttcctgaactgtccccaggggcactcctgccctgaggccagcacccccacaggggcactcccaccgagggctgtcgcggtcggtgtccagccctccccaaagccccacatcacagtctgtctcgacgcccatcgtcccagcatacggggctgggtctcccagtctggtctccagatctcccgtccctccagtttgccccacgggcctagcacctcgttcacagacactgagccagtgctggctaatggggggcccgtggggcaccaggaggtgcggcccctggcttttctggggaggcaggcagggttgtggccacagggatggaggggctcacaggcctctgccggatgctgctagtcctcctttaatctcagtatgggtggctggacccttggccgagtctcagtgtgggtgggcctcctgggcagctggcaggagggtgcagggggggtggggagccgtgcgaagaccccaaagggctaccacttggcggaagctctctctactcacaaccttagggttgcagtcaggggtcaccagggcctggctcagcctgggcagtggctggtcactgcggcctgggaaagaggtcctcggggtcctctgcagtagccctcacacgtggggaaggatttgcagttccctgggggccctgcttggtcctctgccacccccgagagcccagagtcactggagctgctctaaacatagtggcaggcagtgtccggcatgacctcatcgcctccacgtcccccacaacacccaccagcagccgccttgcctggcgccagccagtgacccaccctcttggctgggctgtggactcaggtgtccggctgtcatgtcctgtgagtcggggctgggcggggagcctcctgaggtgctcctctccctctgcgtggcagggaggaggctggcagccctggcccagtgtccagatgggacaaagtgggggtagggaccacagccagggtggcgtgatctggagccgcagggctggggggacttgccagggctgtagaggggatggtgtgggtgtggccagctgtgctgagggaggggcatccgatgtgtgtctgtgcatctgtgtgtggcctgtgtctgtctgtctgcctgggtgtggggtgagggggactctagtgctggaggctgcccagggccttgagagccaggcaagctggacgttcccaggaagagatgaggacccataataggtccaggaccaggggtcctgctccgtgaagtttggagggtccccaaggcttctctggccactgagcttgggccccagcattctccaaaagagggcaggcagttcatgagtctaggggcattcctctgcctctggaaccccacctcagtctgtcctggactaggtgggctatggcccacccttgggaaggagcctatctgtagcccccaagccccagtcagaaaggcagagtttgggggcaagctttctctacaagggtggggctggcctgggcactgagtggacactgtcctcctgcctgccacctgcccctctccctcagcttggacaggaaccccggcctctgagtgaggtccgcaaaggatgctgggtagtccccctccgtggctctgggtgggagcttggcttggcgcggctctgggccgggatggcaggacctcccagccactgcctgggcacagacctcccaggatcccaccagcccagcccctgcggctgcaagagcagcgaggctgggaccaattaccgagtcccgcagggcctggaccctcctgctcctcaagggtgaaggtgggggttcctgttggatgcagtttcaggtggagggggctctctggcctcccgaacctcggctctctccagttcagatcctaccttctgcccacagctgaacacctcttcctacagggagcccccgacctcccagccactgtcctccagaggccatagcatcttggtctccttctgtctgctgcctcggtaggcttcctttgggacccgtggaggcatgtctgactcctcaggagctctgtatttagtgggccttgtcctggggtggcggctccaggcctagtgagacatggcagaggccagggcagggagaatgtgaagctggggcgagggtctgtgacgaggccgcctgacgcctcagcaccaggtggacacagttgtgtgcatgtccctcttggccaatgacaggtccggttcaggtggcccttgcccagggacagaggcttctcctggctccgtgccttccagctctcagtcctggtgtgcacagcgtcaccgggcttccgatagctgccggcctcaactctgggagagggcaggtggggcggcaggaggtgcctgtgctttcctaggcatgagcaggcatgagaggtgcacatgctcctgctcacctgggcggcgcctctcaactgttaggtgtggggttagggttcacctgacgatttgccgcagtccagcggacccgagagttgcatgcagagctggggttgcggtgcgagtggggaagggtctgaaggtgtgggtgcagggggctgtgctggggcctgcaggctggggtgtgcggtgtgagtggggtgcttttgtagtctaaggggtgatgtgccagtcgtcgtgtggtgtcaggtgtcagtcgtcgtgtggtgtcagggtctcttctactcggtgctaagggccagcaggaccgagaggggtaggggcttctctgggtcgagggccacagggggctggtgggggtgggagtgctgaatgcacagggtgatgctgggcttcgggtagcagatgtgctgtggacagtcggggtcgggtcatctgcggcgagcggggcttctgtaggtgctcccagggccctggtgatgtggaagctgttctcaaattctggggtgttgtgctgtggtgggcatgtacctagggtgttatcaagggctgtgcccacttttaggggcactgggcaagagtcggggtgtcagagcagctgcttgagctccgtgggggccattgtgtggcccttggggtgtcctgccctgggggcggctgcagggccgcttgtgtccctgggtgttgctgcctgctgtgcggccttcccagtgatgtttgtgtgtgtgtgtgtgttgggggggttccatgggaagcaggctggggggctgggctgctccgggtttctgaggcaacagcagggaggggccaggaaactgcagctcaggaaggaaggccggccttgcaggagggggcctggggccagcttgggctgagcaggcgccagacattctgtgctgcggccccggcccccactggctgggagctcctgcccaagttccgctggccccacccttgtctccacctccatgcttgtatggctgcctttattcagaccgtggtgacttgggcttgggtctgtgggtgacctggtcctgtgcttatgtgagccccagtccatttgtggctctgtagaggcccagatggggctctcagtgtaccctgcaccgtggggcatgtgttagcacactccggtccccagggtccctggagggcagtgtccactctgactaccctgtcctgggctggcccagcctccttctcccctgccaggctggtaagtcgggagagggagaacatcctcaggggtcatctgtctcccagccacggaggggcactgcagggccggatgcctgaagctgtgtgtttctttttgttgcttgtcctggcattggtgacagccagctggggctgccacataggctggagggggcaggcctgtgttctgggggctcatccaccccttcttgctcagggacaggcaacatctatccatccatttgttattgagcacctgttgtgtagtagaccctgttttaggggttaggaatttggcagagaacaaaacagacaggtccctgcctgtgggaagcttccattatggtgagaagagacagacaatcaacaaatccacaaacaggtgtggtgactcatgcctgtaatcccagcactttgggaggctaaggtgggcggatcacctgaggtcaggagttcgagaccagcttggccaatatagtgaaacccctgcctctacttaaaaaaaaaaaaaaaaaatacaaaaattagccaggcgtggtggcgcatgtctgtaatcctagctaccctggaggctgaggcatgagaatcgcttgaacccaggaggcagaggttgcagtgagccaagatcgcaccactgcactccagcctgggtgacagagtgagactctgtttccagacaaaagcaaaaacaaaaaacaaaaattagctgggcgtggtggcacatgcttgtaatcccaggtagtagggaggctaaggcacacgaattgcttgagcccgggaggtggaggttgcagtgagccgagatcgcaccactgcactccagcctgggcgacagaggaagactgtttcaaaaaacaaaaacgaaacaaaacaaacctaaccaaaaacaaatccacaaacaagccagaacttggggtgccaggtgtagggaggggggctgtgtcagggccacacatggcttttgcccttgggggttcatcaggtatagggaggggctgtgtcagggccacacgtggcttttgcccttgggggttcatgggaggagtcttttcacagagggaggagcatgtgccaaggccctggggcagggaagtctgctggtgtgagcagagcagggggtgcagagaggaggggatgaggctcagagggaacaaggggctgagttggctctgggagggtcttgcattttctgagtgaggtgggaccttgggaggttctgagtggagtgtgatctgcctcagctcagctgctacgtgaagacggggctgtgcggggcaggagggacgggcagtcccctgccagaaggcagggggctctgcttctgccgcggcgggagcctggccaaggtttgctctcagaccccatctggctgccccaggagtctccctggtctctctctgggaggcctgggcccctgggaggtgccgcctcagggaaccctggttttgctgccctgtgagtcaggtctctaggcttcacccatagccccgaccccacggctgcctggggcctctggggaaggggagggtggagtggccgccaggctggcgggctggcagggctgcatttctgggaattgtgtgggggaagtgcattgttagagcaagcctggagcaggccgccagggccgccactggcctctggggatgcctcttgcctcccccagcgttgcttctgtgggagggagctgggactgggccaaggctatgggctgggctggggactttccgagagacgctgccctgggcaggtggctcttcccattctacagactgggcgactgaggtccagagagccgggtgctgcagtggcatagccaggagcagtgggcccagtccccatcccctgccctcctctgctggcgcatgggacaggggagcacttgctggacctaagccccgtcgctgccctgctggtgggggcatccaagggaggcctgggtggggtccactggggtcacagctcggcagagcccccaaggtgggctggagggtctgatggaaaggggcgcagagacggctcctaggtgcttgggctgtgggagggctgcccatggggtggcagggggtgggggctcctggggctgcaggatccccagcccccgctctgtggttgcaggaagcaaggggggctccgtgtgagtttggcagcgggagccttcccaccacggcgctgcctcagccagaggggaagcatggatagcggccactggggtcatggccggctttgggcgggcagggggcaggggacacaaatagaaaaataaatggcctgagtttccgacgtttcctggactcaggatgggggaggggcaggcctttgggccaaaggtgcggctggccctgtggggtggaccaggggtttctccccagacgcctgttggggccagggctgccccctcagacctccaaggtgggtcacatctcccccttagagccctcaggacagggccccgttgcccacagagaattcctaaaggcctatccatatgtccctgtccataaagacgtcgagtgtggaggacaccctggaggaggagatggaaccctcctgtttgctggggctcggcccccggtgaggctggctgcaggtgaccacagagacctagcctggtgtcgtgcggccgctgggtccgtgaaggggagtgaggcactcctcaccctgtggcagctcctagtcaggaggcctctcccctccacctgcacgtcatgtggctgtggctcccaggaccagcgcctggagcgggtgagtgaacgtccctctcctccgtgggcactgcctccgctgtgagccacccttcaggctacgtgcatttccgcctgttctcagggtttaaccgaaaccgaacattaaccgtagccctaacgcggctgagggatccaggccttgcctctgggccgggtgagagacagacactcgccaaccagtccgcagtggctccccgtgtgtgcgaggctcccgcctgcgtgtgtgcgtgtgcatgtgtgcctgcgcacaggggagggaaagttcttcagctgccgagggcgggagtaggggctggagcagcaccctgcggcgaggccccacaggagaatcgatggttctgatgctgtcagcctctgggtgcaaattctgagggcccgggagcgtctggcggccctgagcagcttgctggggaagctccgtggaggaggaagtccggaggtcggtaagctccaggaggggtctgctggggggcgagaatgctctgagcaaggtcccagaagtccagagctcctgagggacccgggaccaggggcactggggagtttcagggttggtcgccgccacagccctcacaaacgaggccactctctaggactggccaccttctcacctcggccacttcacagtcctggggggcagctgtggctcttgctgggaaccacctggacctccctggggcttgggggtggggtggtggtgaagtgaggcccacccgtccgtggctcactcctgccacctagaggccactgttcctcacaggctctggggccagtcacctgcctctgcccgggggcgggaccatcccaccggattgcaggttccctgatcaccaggatgggcctacacctctccgcctgcagtagttgcttccacgcaggactagagcatgtcagggttcggggctcctgtcatagcggagtggctgcggcccgcaggtcagaggcacccgacctcttctgctaacccccttccctgcctgtcccgtccgctcctttctctccatcacctgcccctgccatgaaccaggccaccagtgaccccatccacacctgtccgaccaggctccccacgtgccctaatgcagccccgtaggctgggcccacggctgacaccccttcctgagggatccccgacctgccagccgttgtccttaagacgccacagcatcttgacctccccgtctgcagcctctgtgggcctccactgggacccactgagacatgtcaggctcctcacgagctctgtcttgtgtggccatgcccagggccccaggacgtagaagaccacctggcatctcatggaggaggaaacagggcccagagtgggacctccactcaggctcagcaagggccgagtcccagttcctggagtcctagttgaggcccctcctacacagagcacaaggtggaattcacggggtcataaaggcagccagttctaccaacacacagttatgcaaatattttcttaaagtgtgatatcaaaacccaagtgcttctttaccaatctgctgaacaagatgtgactcactgaacagcctctgcagtcccagcagcagcgagtgtgggggtgcgaggcagttcccatctgtgccgggtcagccacgggcccagctgaccagatttggttcatggcctcgttcataactgaacgaacgacacctttctgctagaggtcggtataaaggagatgatgggccgggcacggtggctcacacctgtaatcccagcactttgggaggccgaggcgggtggatcacctgaggtcaggagtttgagactagcctcaccaatatgatgtaacctcgtctctactaaaaatacaaacatattagccgggtgtggtggcgcatgcctgtaatcccagctacttgggaggctgagacaagagaattgcttgaacctgggatgcggaggttgcagtgagccaagatcgtgccactgcactccagcctgggcaacaagagtgaaactctgtctcaaaaaaaaaaaaaaaaaaaaaaggagatgatggtttcttcccaccagtttattttctgtcaggggtttggtctctgggtctctgaccccctggattgttgagacgcctcgcactgttccctcccatcttgcccgaccgccccccaccagctcccaggcccagtatgtctctgtcccaccccatcgtctctataggccctgtcctgcagtgggttctgtccctccctgcagcttggtaaggttgttgaggcttcaatacacactccagaccacatccctctccctcccaactctgggacactctctgcacctctgaaaagaaactcccagcccttcttgtgcctctcccttcctctgggcaccccttgttccttatccatcctggctggcctgtggcctgtacttctgatctgcacacaggtatcacagaggacagagaccccagggccccagcccctggtgggggcggggagtgcaagggggcagtcgtctttgttctcgaccagctcccagctccctaggtaatgctttaagagttaccgtgctaggggatctttgtggctgaaaacattcagatgaaccagatatttaaaagcatccctcatgcaaagtccctccactggttgggccggcctggggagggtcaaggctgggtctctagtctggttttccgggggcgtctgtgtgcactccttccccagaaccttgcgcttgtccatcccagggagaaatcaggtggggagcggcctcactgctggctccttgatagtgacttgctccagaggtccgtgctgataccccagaccccgccccaccaacacttcaactgggactgcggcgtatgcacaactgcacagcctcctctggcagctccttgatgcttctgggacgttgaccctctctcctttgcacctccactcttaggaacttgcagctctctggggttagttctcctctgtgctgtctgggctgcacctcctgcccaggaggggcctctctgtgctgcagcccttaccagcatctcaggatctgcagtcctgatacttggaggtctcccccccacccccagcttgagggctggcttcctttcggtggtcttcaaatcaactcacactcggccgttggagaagcctatgtgtctggccaggcaggctccatggatgtggccagtgtctttgtggacggtgggaaccagctttgaaaccctggccgcccggacctccgaagccaaactttctggggttcctgcacaagggcagttccagtgtggcttctacaggaccctgaccagctccttggtctggctgtcagccattgagacagtggttgaaggctgggtggctctagcctcccctcgtgcctctgatgaggctggacccttcaagtcttcatatatgcccaaaccatgggattctgaccacgaggacttgcttggatggtctaggctggaagctatgtccccagctcactgtgaggggcagaatcagtcagtatggaaaccgtgttcatctattaataataataataatataatatcgcggggcctctgtcttagaaaggctttgctcctcacaaggaattctatgctttttccctatgattgagctttttttttttgcgacgagtctcactctgttgccaggctggagtgcagtggcatgatctcggctcactgccagctccgcctcccggattcaagcgattctcctgcctcagcctcctgagtagttgggactacaggcgcatgccgccatgcccggctaatttttttttgtttttttgtattttagtagagacggggtttcaccctgttgcccaggctggtctcaaactcctgagctcaggcagtccacctcccaaagtgctaggattacaagcatgagccaccgcgcccagcctgagtctttttttttttttttttttttttggagacagtctcactctgtcacccaggctggagtgcagtggcacaatctgggctcactgcaacctccgcctcctgggttcaagtgattctcctgcctcagcctcacaagtagctgggattacaggcatgtgccaccacgcccggctaattttttttttgttgttgtttgtttttgagatggagtcttgctctgttgcccaggctggagtgcagtggcatgatcgccgctcactgcaagctccgcctcctgggttcatgccattcttctgcctcagcctgcggagtagctgggactacaggcgtccgccaccacgcccggctaattttttgtatttttagtagagatggggtttcaccgtgttagccagtatggtctcgatctcctgacctcgtgatccgtctgccttggcctcccaaagtgctgggattacaggcatgagccaccatgcccggtctaatttttgtatttctagcagagacagggtttcaccatgttggccaggctggtctggaactcctgacctcagataatccgcccacctcagcctcccaaagtggtgggattacaggggtgagctactgtgcccaaccaagatgagtctctctctctctttttttttcttttgagacggagtctcgctgttgttggccagggctggagtgcaatggtgctatcttggctcactgcaacctccgccttccgggttccagcaattctcctgccttagcctcccaagtagctgagattacaggtgcccggcaccacacctggctagtttttgtattctttgtagagacggggtttcaccatattggccaggctggtctcgaactcctgacctcaggtgatccacccgcctgggcctcccaaagcgctgggattacaggcatgagccactattgcccggctaagatgagtctcttaactgaccatattttccttttcattttggctgcggggaagctcagttatatgtgattagtgccacagacagcccaagaaatgctcagcccattccacctgccacctggcctcatagttcgttggcctgaacttgaatgactacaggctccttgatccacaccctcccccaggattgtgccctctccaggaaaccacccagcatctgcattactggggagctgccaggcagtggtggggatgctggccctgcacctgtccccgtcctcaaccctccctaggcctgggccatctctctggctgcctgcagtctggccctacctagggacctccaacaacaatgtcaatgaacactaattgtcatgctccatcccctctctgttctcaggcatgtgatgtgaatcagctgacatcatcttgacgggagccctgtgaggcggacacttaactccagtttcacaggtggggagactgagacacagtggtcaacgtgcagagcccagaatctgctccctggtagctgactttgcaggcaggggccttgcccacgcagcctcggcagaggcccccgcacttcgcgaaccccagcaatggccccttccagacgccacgtccagctaccgcgcgctcacacctgcagggccccacaagaggcctcccagtgtgcgcgggcctcttgaagaagtaactctactcagaagcccgaatgacccaaactgggctctgggaggctggggacggccttctaggccaagtggggcgcgcgcagggctcagcggggcccaagagaagggctgagggcactgggtcctgagccacccaccgaaggacgccgcgggacagcaaggcccgaagcaggaggagagaagggagcagattcctgggcctcctggggcccggtcgctccgggatgtctgagctctgggaggggcgtgcccggggcgcctccctcgcggggtattgtgggatcacgagtcactggcgacggtgggtcaggactacacttcccaggaggctgtgcgcgccgcgtggcgcctgggagttgtggtccagagcgcgggcgcggcgggcgcggcaggcgggcgcgtggactacgcatcctaggatgccgcgcgcggccgcggggccgagggtttgaaccgggggtctgtcgtccgcggcggggctgcgtcggctgcggcgggtgtgggaggtggcgacggccggggccggggtcctgcccggctgcggaggcgggcgcgacgggcgcgggggtcgctgctcctgaggcgatgatgggcaaggaagaggagattgcgcggatcgcccggaggctggacaagatggtgaccaagaagagcgcggtgaggggcgcgggccgccaggaccccgggaaccccgccccgccgagaccccgtcgagcccgccgacccccgttagggccggaagacgacctgaggggcaggacgagacccctccccggcagagactaaccgggacgcaggggagacccccacccgtggccgagacccctgccccgggccagccctgccgttcactcccgcaaccccggcagaggccgcgatcaggcctggaccttgtcccgggagagccacccgctctggactcagacccctccctcgcccgcagtcacaggctccgcacccttccctgtcccttaactccagacccccagcctggcccgtcgactccttccttggccctgtcccgcctctcggagcccccggggtgttcgggcctcctctgcgggccgcgccagccccttgccttcctccatcccggcctgggcatcctcacaggccgagccccgccccccaactcagccctctcccacgctccgtctcttacagcgtttgtcaccctccgtctcccatagcatttgtcgccggcaacagtttggagtctgaggttggatccccttttcttctggagcttccgtgcctcccctgcctcttcccagcccttgtcatcctccttcacaggccagccagatacctgtcttgcctgtgggcccattttcttccctgtctgtccccaccccacaagaaccaggtttctctaataaattctctcccttctttagccaggacttagcccgcagcaacttgggttgtgggtagttatgtggacaccctccgaaaagagccggtgtgcttatataagagccaggaggtcgggcaagcctcctctgggagtgtctgggcgctggagcctctggccggctctgttcactgcggcctgggcctctgttgtcttgcggccacagcgagactttggaggaggctgtgtgtgaggactttgaaggggccaggtcagtgggggtccagttccagcgtcatgaccttggcaacctctgcaccctcccacagaagcatctttagaggatgctgcctgcctcctggggggtggggaggggtctggccgcaggtcatttggagctcctggctggctcaataaacgtgacctgtgctttcccacccagactgtgaactcctggggcagggccagctgtgtgtctgccaggccagcccagggcggtgaaggtggctgagtcatgggctttgggtgatttgtgcagccaccccagggctgtgtgactgcagtgggggtttgggggaagctttttgggctgagcagggttgagtctgggttcctgtgaccagcgttctggactggggtctgccctgggaaggggtgggctcccactcattcctgctgggtgcagcacccccatcattgcgttcacacacaccccggaaaactggtcagcacaaagtaggggtctgcgaaccattcatagctgtttccagagatgacccgagaatggagttgttccccttcttaaaggagacaaaacacaaacgataaaagctgtaggtgggagaagcaaagatgggtcatggagccaggggagggctgggtggggctgggcagaactgatggggggtttctggtggaagaacagcttgagtagaagccccaggggagaatgaggaggggaggcgggcgctgtgcagtggggagtgggagccagcagagcctcctgggggtcccagtgcctgaggtcccctcggggacctgggggccaggtgtgggggtttttttgcctctggacctgagcccactgagagccacgtaagcaggtgcagggctttcaggggacagtggccttggctctggctatcacctcaaggctggactctgtacagcccaagaggcagggcctgcctgggagggctcaggaggggctgcagcgtgagcagactatgccacccggattgctggggttgtgcgggcggtaggtgggacaagcccctcccatggcctgtgggtcgtgggactctgatcaggtcaccttagggcagagggaatgatacacacgtggaaacacatgcacgtgttacagaggagatggggtgttgcagggcacagttgcagttttaaacaggagaggccttgctgagaaggtgttgttgaaataaagcccgggagggagggagggagggagggagacgttgtgggaggccgccccaggcggtggagctgcaggtgcagagggcctcggtggcggctcagcgcccttggggagcactgagttgccgggcctggtgtggaaatgtgaccggtttgtgcctggcctcgtcagtgttgaggacctggaggaaacgcagatcttgggtggggagacaaggcggagagaacgaggtgcattggaacagtccaggcgaggggtgctggcctgcttgggggcaactcagaggcctggaggatagatgaggaggggggctgtgggccttgtaggtgttggctgtggccgtgcctggagtggagggacccttgaaagtttggcctcagctcgggacactgatgttcccgggttggcccttcatgagagtttggcctcagctcgggacactgatgttcctgggttggcccttcacagctggtgggcggggggtgctttggggagaggctgccctgcgcatcagggcatcaagacacaggggagtgaatgaacctggggctgcagtttcacctgggtgtggccctggctgctggggaggggccgtggctctgaagcctcatgattggccaggggagctggcatttctgttctggtttgggtcagtgacctgaggtggttacaacgaagtcagtgaggtcattgccacggatgtgggttacaacttggaatgcttgaggctgcagaacccctccccttcttgactgagcagtaagggttccctgctgtggtgcaggaacatgtgggcagagccctgggtgtctccaggtagaggaattttggtttctttttgaccccaggttgaatctccaaattgtcactgccttgtgttctcctccagtaggcagaaggaggtgatattgtctgttgagatctaaagtcctttatgaaggtcctccttctccttccaggagggagccatggatttgctgcgggagctgaaggccatgcctatcacgctgcacctgctccaggtaggtccctgcctgccccaggtccaggacagctcctgggtgcagcccaggggatggcagttctgagggcacctggcagggcttccccaccctccccaccaggccttagttggcacaaatgcctgttcctgaggagagggtctctgcctttctctgggctcagtgggacagggaggggagtctgaggataacccatcttgtcctccgtggctgaggctcctgggttccaaatgggacagtcgccattgggagaggcctctacctccctgggaggtcccgggctcctgtcctgtgggggccaccaaggctctgccaggagaatctgacccctagggtgggcccctgcctcccccaacccagaccacttgcctcgtagtccacccgagtcgggatgtctgtcaacgcccttcggaagcagagctcggatgaggaggtcattgcactggccaagtctctcatcaagtcctggaagaagctcctgggtgcggctcaggcggtgcccactgagtgctggggcaggggtcccagaagtgctgcctcttgctggtcagcacagtgtagagtgctggcagtgtccaccctgagccaggtcgcttgggagtggggcagtggcaaacccagaccatgaagcgcccagcttggggctggcagtggatcagtgggtgcctgtcagcattggctgggaggtgtggcctaggaggccagggtgtgtgctgggggcagggttccaggtagaacaaggagagaagagagttgaggccaggacttgaactgacagcactgagagactggggtgagttgggaggtcacacagaggggaaggtcatggccaggaggctgggaagtgccgggagaggggaagcgggagggagaaggcagggccacctcagctactcagagggaacagaggggcagccccctgccagggaagggaagggctgggctgggctgggctggactgaaggctgcctcttcctggagacagtggggtgactggggttgcaaagatgctgctgtctgggatggaggcaaccctcctagctctgtccacacccttgtgaaacagtctctctccagccctgtgtggccctcaggctgtgcatggcacaagcatgtcctggtccccagcccttgggcctggctctgggctttcaggaagagccttcttggggacatgcttggtctctctggccaggacaggcaggagggtgggccccagagaggccccagaggtggcctttgtgagtgggtgcttgtacgggaaagggttctggggaggcagcctcaggactgcagagatggacaggttgctggggagggtgaggacctgttcacagaggctgggcagcctcctggcccctggctcccctggctgggtgaggggctgggggcgggggctggggctggggccgtgttggtggtcgggctgaggctgtaccttggtggtggtctgtgcccctccctcctctgcctccccttgatcagcccatccccgatctttcctgcagatgcttccgatgccaaagccagggagcgggggaggggcatgcctctgcccacgtcctcgagggatgcctcagaggccccggatcccaggtagcacacctggaaggcaggtgcacacacttctgcttcccagcctgtttccttgccagagaaagggtgccagtctccatgtgcctaggcactgctttgaggctgcacacagagtcggtcagcctcatgctggacaccagccttgtggtgtgtcccgcctgcactgaccacttgagatgtgggtctgtgtccacctggctgtcagccagccatcctggcctcttcctctgccaagagctgctgtataccctgagtgggcctgtgggagccccctggcctcttcccccaaggccccctgctgggtctggttcttgctggcccactctggcttccccctcagcctcactcaacgacggtccctccttcctgcaaaattctgcccagaaccaaaggcgggggccaactcccctcctgccctgcatgtgcacgtgtggtcactgctgccagggggtgataagggctctgtggcctgcagctgggagctgggggtgcttattgtggcaggctatagccgagagatggctttgcccttgaccacactgggttgtggtgactgggccaccaggagctcagggacacctttgcaagttgattttcctccaggaagctgcctgcttctgccaacttccacagaggggatgaggggagggctaggtggatgcagcctggtcgttgggcagccccatgttggggtccagccctgaggggcatccttctcccattctgtacgtgcccaggggtgtcgtctgtgacagcagaacctggccttgggcggccccgccttgtctccccccagacagctgtgggtctctccctctccctgaccaggcagcagctgcagctgccctcagcagagtatttgtgttgcggcccagtgggtgggcaccccagaggtggcaggaactgccaggttcattctgatcgactggtaatgctgcccagatgctgactgctgggtctgggatcctgttcccacctggagagtacaccctgacccactggggacctcatggccctctccctcctggctgctgggcacaccccatggacatctgggctggactcaagataggcagggccacaggccactgttggactctggcagagtagaacaagcaggggttggtgggggattatgctgtggcacctgctgcttctaggaccagtgtctcgctggggtgcctgcagccttgagtctgaacccagctggccctggctctctgcagccgcaagaggccggagctgcccagggcaccgtcgactccgaggatcaccacatttcctccggtgcctgtcacctgtgatgccgtgcgcaacaagtgccgcgagatgctgaccgctgccctgcagacggaccgtgagtgcggccggccctggctcctgacacccgctgtggttcacagggtggcccgggcccctgcctgcccgcagaggcctgcttccagcggggtgactgtcctcccccagcccattgctgtggccctggcaggggctaggggcctgtgcctggatcgtgggcctcttgcagggacccggatgtgccctctaagctgccagggtgttttgcaggcagaaggggtggcaggtggagaaaccagtgggggaagctagtcagggctccctcttgcagatgaccacgtggccatcggtgcggactgcgagcgcctgtcggctcagatcgaggaatatatcctttgggtaggggctgtgggcctgggtttctggtggagtcaggaggctgcctggcctggtgccctctggtggctgctggatgccactgcccagctgtccaggggtcacctgcctgggtggtcacctgcctgggtggtcaggctgtctcacctcaggagggcccccggaccagctgaagggctgattctgtctgcttgtggggcctaggtcccctggggctgtagcctgaagctgggtctcagtcaggaatgggcctggggcaggcttggccctgcagcccttcacctctccaccaggtgtgggtgggcagaccgacccctgtgtggctgggcagaacctttccagcccccaccccaacatggcccccagcggggcaggtggtaggtggagggcagcgacgttgtcctcaggtgggtccttaaaacacttgcacgcatcttccgggacgttggaaacacagacatgaagtataagaaccgtgtacggagtcgtatctccaacctgaaggatgccaagaaccctgacctgcggcggaatgtgctgtgtggggccataacaccccagcagatcgctgtgatgacctcagaggtgagcccctgttggaggggctggagggctgctccctcggagcggtgggctaagccactggccccgtgctccaggagatggccagtgatgagctgaaggagatccgtaaggccatgaccaaggaggccatccgagagcaccagatggcccgcactggcggcacgcagacagacctgttcacctgcggcaagtgcaggaaaaagaactgcacctacacacaggtgagcggccgctgggcaccctcccccgggcccggtgtcttcagggcatctggtgcccctccttggagcccatgcctattcccgcctctgctgcatgaatttcccgagcctctcagtccctgagtaggctaaggcatgatggccaccttcagggaccactcccctctacccaggacctctgggctccacggggcggcgtcttgggtggtgggacccacttgttgcggatactcaagtcagagggcctggcctggcccagcccagcctgaacggagggccctcgaggtgttgatgttggtgggagggccgtgctgcctgctgcctggcagtgactgcaggaccctcagtccctgccatggaggtggacactgagtgtgctggggagactgtggatcccatgagatggcagggaccctgttaagaggggagtgcggctgggtgcagtggctcacatctgtaatcccagcactttgggaggccgaggcaggcggataatgaggtcaggagttcgagaccagcctgaccaacatggtgaaaccccgtctctactaaaaatacaaaaattagctgggcgtggtggcgcatgcctgtaatcccagctactcaggaggctgaggcaggagaatcacttgaacccgggagacagaggttgcagtgagtccagatcgtgccactgctctccagcctgggcgacagagcgagactccgtctttaaaaaaaaaaaaaagaggggagtgtgtcgaggcggccgctgcacctggcagatgggactcgtgaggggctgcaaggacagcctttccttcccctcgaaggctgcatggggcctgggtcggtgcagagcctgcctctctcctgctcccagccactggtcagaacaggctctgcctgtggccggaggctcacccttgggccttccggaaggcagccgcgggcactggggacccctgctagttccccccaccattgggaccctcttgccctcagccaagtctgggccctcctggtccccagccaatgtgagctgcttcaggctcacacaagggcctctgccccgataaactctgtctccctcccccggaggctcagctttggaaggttggagtcacgaggcggcctcggatcaggtcacctgtgggagctcagtggctgcgaggcccgcactgcccatgttgaggggatgccgtctgcagcggagcatggaggtgaccctgggttcacccagccctgttcacaggtgcagacccgcagctctgatgagcccatgaccacctttgttgtctgcaacgagtgtggaaaccgctggaaggtgggtgagcaggctcaggctgcccctcccagctccattctctggaggtggggtgtctcagcctctgtggggtctgtggtgtgaactggggatggccctgcccaaccagcctcctgggagtcttgggcatggtgggtggagagcccagccttgggtgagcctgtgcggccttccactctgggggatctcatgtggccacaaggctggaggcctcaccccctttctcgcagttctgctgacccctcgtgtagatgtgctgcagccttgggccctccccggcccacgtcctccgttgacacagcttctctggagaccctagaaggcggcatgtcctgccctcaacctgcctgcctggattgcacctttctgccctttccccctcattattaaatgtttctttttgccatcttgttctcctcagccgttactcctggtgggcccctgtcccccatgtttgacccgtttccactgctgtggacaaggcccctccctggggttgggcagtgcttgggtttggccctggtgggtcagccccaggagaggagcttggctgaccttcagagatcacctggggcggctctgcctgtgagggcaggtggggagagggtcttgtgtgcgtcctgtgcagggcagtgtcctccccaacgcctcaggcatgggcagctcgggacctctcggcacttcaggacagcttgtccccatgctgccttctctgttcttgtgggagttgtggtctcagggccctgagccaatttcagcttcaactcacttaacttcccagaaatgcaggggatgggctggtgagcactcaactcatggggcctgtgagatgagaaagatgacattgggcctggcaccaagtggcccctcctgccccagccagcctgcctctggggaccccgtccggctgggcctgggcggcacctcctgttgcctctcgacttctgaggtgctgtgggtcactgttctggcccgactttcagctaaggaggctgaggccgagggcgtggagctcatgccccgggcagggttaagcacagccacccactgggaccactgttctgaggaggggtctggtggaggccagggcatgggaagagggcaagcacacggctgtgtgtcccctccaaggggcactggagcccctgccctgggacaaggacacttctccccagccctgagtctggggccactcattctccagtctctccccagacttggacaaaaatgagtagagactttgctttaaaaatatcttcaataataagacatcctatttttggggggttagggatagagataaatatgaaaacttttttttgataaaacacctagtaaggacatgtttccaggtttaaagttcatgaacatataaaacagaaattgggtcctgccaccttgagtgcaggattctgaggtcctaaatctggttctgaggttctgtgtttgattctggggtacagacagctcaagtaggaggtctccttatgtcacaaaactacacgatgcggaggttctgttccccaccaaaggcttgtctggggcccattggctgcctggggaggaggccccagcgaggctcatgggtccagcatggctcctggggggacccctactctcaccacgcaagagcccccagccaggagcactgggccagccagctgcgggccgatgagggggcttctggcccgccctgcacctggaggcccgccctgcacctggagttcctgcttggccacgggtgggcagacccaggagacacagcactccccactgggtctaggaccgtctccgcgggtggggaccccagccggccaggcatgtgccctgacagccctgccgacaacaacacctgaagggaacccagagtcggccgtaggaggcggcggggtctgtgctgctgggggcggcctaggcctcggaggaggactgtgatggcccctgcagcagcagggcacggtaggtgggagagctgaggaagcgggggtaggagtcccggtgcatgagcgtgtagatctgcagctgcgcgtcgtcgaacgtgtgtgcggacggctcctgcatcttcttgttgatgccctcccgcacacgggagtccaggctcacctgcaggacaagacactgaggtcagggggtgcgggagctgccttccccacctagtgcctggagcaggcggcccccggcctgttctggtgtctggcgcacctccttgggggacaggatggatacgtagtcctcgtagatgagcctcgccttctcgtctaccacatgctggttggcctcggccttcagctcctcgcaggccaaccagaagagcatgttctcctcgctgtactctgtccgcaggaacgcccggaacacgctgcgtcccgctgggctgtgcatcagcttgtcaaaagactgcgcccagctctgcacctcctcaggacttggcgtggcactgtgggcacgggggccaggctatgtcaggcccgagtctcccggtctggggcccccccagcacgcacacaccagccggctggactcaccatacttcacagctggggaggggctgcagcttgctctcccgggaggcctgccacgcgcgccgccgctcttggttcctagtggcagagaggaagcagcgctgccgtgggcacacacgcctccacggccacacaggccctcagcacatgggcaggcacctgacacacatgggcacccactgcaggagggcagcccctgcaggcacctgacacacatgggcacccactgcaggagggcagcccctggagctggctcttcccacactctcccacactcccaaattccccacagaatctgcagtccaggttactgtccctgccacagtgcccagaccacagactctgccgtcttccattccagcagtgtgacccagtgcccgcgagtctctggccttccaggaggggcccttcggctcctggtgtgctcctccccatccctggcccactgggcaacctcctccacccacccatgcccaccccacatgaggttgagaagcaggtatgccacctccccttctgcctctgctcccctgggggagatggggtggggcaagatgaggggccacaaggagctgggagatccctgaacacctgggaggccagaagggtcatgtgcctgggaacagggccacccatgggaatgtgcctgggaacagggccacccatgggaatgtgcctgggaacagggccacccatgggaatgtgcctgggaacagggccaccctgctcctgggcctgatcttggcctgtccctgtcccaccgatggggtcacacgctgcaggtctggcgtgtcagcagtgtctctcgtcggctgacgcaggtgagagccccaaacccgtgtccacactccttcaggttctggagcctgatccccggttgtctcaagggaagcagcttctttgccttggctcctagcatcctgtcagtgctggacccaaatccatacccggctgacctctctccagggcacttggatggctggcagacatcgtgcacccaaacgtcctgacagaactaggcccctgggctcctcccaccccctttcccgactgccccctggccacccccagcttgcccgtgggtcagctgacgccaccttggatccagaagcgctgtcctctcatcagccagggcctgaagcctgaatagggccaggcttctgcaaggtgtgaaaacatccaccagctcccctacactcctaggaaatctgttaccatctgggagccccactcccaccctcacagggatgcccagagacgtccccgccaccgccccctgctcttcttcccccacgcatgctgtccgggaagctcttggccatcgccccagggccagcagttcccttattggggtctctgttcaaacgtccctccaccccacacactgtatggggtctgtgcctgtctttctttctttctttctttttttttttttgagacggagttttgctcttgttgcccaggctggagtgcaatgacgcgatctcggctcaacgcaacctccgcctcccaggttcaagccattctcctgcctcagcctcccgagtagctgggattacaggcatgcgccaccacgcctggctaattttgtatttttagtagagacagggtttctgcacattggtcaggctgatctcgaactcccgacctcaggtgatccgcccaccttgccctcccaaagtgctgggactacaggcatgagccactgcacctggcctgtgcctgtcttactccaccgcaggcccccagggcctagcctgggctggctcacagcagcatggataaagcacatgccgcgtgaacgggcacatgcatgtacacagcacacggacacacccttggcaagacaggtacgagagccatacatgagctccctggggccaaggcaccggccactcatcaccagggcccaacagaccctggacaggacagtgctgtgaggtggcaggggcatcctgcctgcggggatgcctcggaagccaccactgggtcccctcctgggtctgcttggccccatgccctcgaccccctcgccagctgggcaccccaggccctactcaccaggagcagctacagcagcagcaccagcacaggcagcaggggttgcggctgggggccgctggagaggctgtatcatgactggacattgaagggggccggtccgcctcctctggccctgtgatctggggaaaagtggggctacctcagctttcaggtcagaacccaccagactctccacctctcccccaccttcccatgggtagccctgttcccaggcacatgacccttctggcctcccgggtgttcagggatctcccagctccttgtggcccctcagcttgccccaccccatctcccccaggggagcagaggcagagggggaggtggcatacctgcttctcagcctcatgcggggtgggcatgggtgggcggaggaggttgcccaggctccgtggtaccagctctcagaccctcaccacagcctgggggtctggggagaggggccaaggttctgactgagaacctgaaaccccagcccctgcctaccccttaggaggggtcctgagagggtgtctccctagcggggcctgctcctgcctctggacccagctctgcctagggcttctaccccgaccccaagcttacagcagggctgggagggggtccaggatcattgaggagggagctgcagcagcttctggcccctcctcccaggctgggccccagatgaggcccccactggaggttccgagacacccccatccgctcactccctgggaagccggaagcctgggttcctctttcttggtttccggctcccagcccctcccaaaggggccccgagagtctggggctaccaactggtgcgtgcgggtggtggccagactggcttctagggtgtctggggtggggagtgggcagagtggcttcccaccaagagtccaggtctgtctgtgggtcccagaggtctcagccaggggcagcaggctagacctgcagcagtgaggatttaagtgggactcaggctggacttgctgagggtgtgggaaggggggcagggccccggtgaggagggacatgccccccaaacatggttctttggtcctgctacctcccacccaagacttccctccctccttgcccactgcctctaggctgtgaaactgctgtggaaccaaggccctaccacagggtgcgccagccagggaagtgggggtggcaggggtggggggcaccctgctccccagtcgaagcctcggagtccctgaggggggtgtggtgtggtgcatgtccctcccagcatttggttgcaccgtctgcaggggaggtgcaccaggagcgccaaagctgtgagtggccctcatgccacctaagatgccacttcgaatcccaagtctccttgggcgatggtacaggggggccaatcagtgccccggaggcagttgtgaacacctgcgcccacttctgcccagggcagggaggggcctccgtgcacatccgccaccctcctcatgtgccgccaccctccctggccaggaagctcacaacttgattctactttattttctcaatcttcatccccccgccacgcctcccctagctcgtggcctttgaatgcttgtttctggctggttggcttctcttggcctcctgggacggtgtgtgaatggccctcagaagagacagtgctggagttctgcactcttagggcccccaatacccccgaggcctgggcatgcagaggccactgccctggcccaagtctggggcaggtgcagcatcccctgggaccttggcccctcaccaccggcccagtttcctctgagactgggggtcccacgggctcctagcaagtagatgaggagaccgaaagtagccctgcagctgggctttctttcaggggtcaagtttctagggaaaggaaggggcgtggcaacctgaggtttggtagctgtacccagacggggctgtctgtggcttccccaggcagcagttcttcctcctctctgtccccacccagggtcctcccccacactctagcacccctgagactgtccccctgggctaccatctccaccccagctctgaactggaggaggggacgtgtttaggggtgcagggccggggtgctaggggctgcatttgctgcagagcagggagccagccccttctttcccagttgcaggccctggacctggtcacctgtccctggacctggcttcctgtacccttctcaggtcaactggggcaacccatgtccccaggctaccctccccccgtctctcctgggggatacagagtctcaactagggtcctcctgcttgtcaacctggcattggggacccccttccccagcctcccaggctttggcccccaagtctgggatgggataggctggataggcggcacgtctgctctctggggatagaggatcccttgggagtggctgccgctttgctccacagaaggaaaaagaacgtcccagagcctgcccagtccaaaaaaagaataagaaaatgtgacaatcccagaaaaaaatgtcataacctttgggaggggggttgaagaggggctccattctcagtccttagctcctacccagggcctttcccatctgccaccctccacatctggctggtgggcgagccctggcctggcccctccagggaaggccagctctccccacctctgaaatggtggtggtggcccacccaccacgctcctctctctgctgttagggtccagtctggagaagcctgtgttctcctccaggtgcctctttcttcagcctctgacgcccccacccctacctcaaagctccctactcaccagcgacccaaaggcggggtgggggcaggaggggccaggttgggtctgggccccaccctggctgccgaaggggcgtgcactgcagcagcagggactcaagtcagacggcaggagggactcctgcggcgctctggagggaggctagcgccaggagcccccgatcggctggggccgggggcgcagcgcctcccctacagctcgaagggctgagtggctgccagatccagcggggtgggggcgggggcggacagggtgtcccgccccggcccctcctcaccgggctgagagggggagggagacgcggaaacctgggttcttccggcccccacctttgagcaatcacttccccaggctttgagctccagaaaaaggggaacccggctgcggcgccccctcccccacgcgcggggggcgggctccacttccactgcggcccagggtccacgtggacctggcggcgggagcccttggggttcgagtcccgtgcgccggctcccgaagctcccgcccagcacggtccccgggcccgggccgggaggggcagggccgctgtccccggcgctgcgcgcgcgcactcaccagccgcgctcccgagccactcgcgccgccgccggcccgcgcgctccaaggtccggcccgacagtcggggagggggcgcgggggcgcagtgcgcaggcgcctcggcggcacttccccaaagccaggggccgggacttcctcgcgccggcggtcgccgggcccgccccgcccgccgcgccccgccccgcgctcggccggctccgcaccccacccgccccgcccgcgcgtcggcccccacagtcgcctgggggtggcccggagagtcgaggtgctcatagtggagccctggctcccgggcggacggagccgcacggtagtagatgggggtgtggccgtggcccccgactctgctcggcggggccgttcctgctttgccatccgtgtgggacttccacgacagtggaggcacgagagctgggccccatatgctgcttgcccagcttgggaaagaggaggctgctgcaaaggaccgatcggcgggtacgccagcccggcccacccctcgcctccgtgagccgcgtctgtaaaactgggttaagagccgcctgtctgtgctgtggggggttcccaaggaagggggagattcctgtgctgcggggctggggagaactgggggtgcgggttcttgcatccggagtcatgccgaatgtctcctgtggggcctggcagagtccctgctgacccgtgtgtcccaagatgtcctaaagcttaaggccacactgtcccctttgccacgaacgccctgtccctttggccgactcttctcatcctttatgactcggtacagacgtgggttaggcttctcatcgcagcatgctttggccctgtgtcagggtggccctgaccctgctctggaagtgtctgcagagcatctgtgccccccgcccctcccctggcccggctgtgtgcagctcctgtcctccccagcacaagcactccacccggatagttcccagtgtcgggatctgttcataaaatgccttccagttgcacaggtcaggtgcacaccttacaccttcacagaactctgaggggtgcaaaggcagctggagattctacttgtattcctcattcaacggacaagtatcagtatctgggtgcccctgtgggccaggcagtaggaccagaagccagcaacatagatcagcctggatcttatgctggggggcgcagagtgagttgtggggagcaggcagggaaggcctgggtgagaggggggagggctgaggaggggagggtattgcgctgctgagcgggggcgggggcccgaagggggaggtcagaggtcagagggccctggaggacagacaggctgcctctcgaagctgtacccagaaccctgtgactgccatgttgtcaggccaggcaaggaaaggcaggggccaggaagcccacagggacaagaggcaggctgctacttattcagcccacataacactcctgagcggtgggcacaggtgaggtcagggaagctcaacgaagatgggccagcacctggcccaggccacacacaaccaggctgaccccgctgagccggcctgttgtctctgctgtgggaaaatgcagctgtgggcagctggcagggggtgaaggtcagtgccctccctgccccctcgggtcactctacaaccccccagtcattcccccgtctcctctggccccttgggcctgctctccaccgccctggcttctgcctctcggcacacagcatcctgaagtccatgggtggggccaggtgagctgggcagttgatggcggagctgggatttgaacccaggaccctctgcgccctgacagccctcaatatattgggctttggaccacatgccttccttcccatagagctttctacaggcaggcgtccctccaggccccattccccagcctcctttgcacatccagcaccccctgcgccttttcatggggatcaaagggcccgagtgccggcctgaccctggtgcagtcactgaggtcactgtcttgctggccttctctgggtgctgggtctgctgtgcctgtctctgcccctcttccctcttgcctgtctgatgcagagtgacccatcccctttggagcacttgctgctgtggggtactgcaccaagacccttattttaaagataaagaaatggagtctcagagaaatggtgaaataatatgtgattctcccagtagatgaactcattctaggcactcagtcaatccccaagacacagaatcctggggtccaggctgcagggagtttggccagacgacaccagggctggctgtcatcacatgtcacaagcacatcagggtgtgagtggctgccactcctggacagactgcctcccttccctgtctgtctgcccctgctcaagccccttctccctggcctccttcctctctacccttcccttcctgaaacccctcctgccatctctctgtcccctccttgtcagctgacttctgagctctgtatacagtctgggcttgggtcaaggccaagggcagcaacagcccagaaagagtaaagtgctcggtgcacggggagaagggctggctgaggggcgagtgcgcagggctccaccccctggccggggctggggagaaacactggctgccatggagcaggatcccttctggaccccagttctgacctctgcccctccttccagtcagctggagccccctagcaggaggagcggtttgtctgagttcctgcggtcccgcttctgtgcagcctgctgggcagggggctgggagggaggaaaaggaagcgggggcctagggaagccccagcgtctgcaaagagctcacgtcggggagaaaagtaaggtctgcccagaaacctcggggcttttcagagtccagggattttgtaggtcgtgggcctgtttgtcagaatgggacaggggtggcttccttttgtactgcatgcgtgagtgtgtgtggggtgtgtgtgtgtgggggggtgggtgtgggggtgtggcatggggcattaaaggggtcacaggaggctattcaggatggaaaggaaggccagagggtgggatttttgtctgggggccgcaggggttccccttgcccagtctcttggtcctcttgggcacagctgctgcttcttcaaaggccagcttaggtcacttccgctgcccacagcactgccctctccctggccccctggtgggatgactcgcactcgagaccactgcagcctgaggctacccttacatctgggggtgacttctgctgaaacaggctctttctccgtcctccccaagactgggggcctcccatagacccacagaacgccaggttgccagtggggggcagatcgggattaggggtaggcgtgtccctgacctgttactttcacacccacccacttgcgtctccccacttttttgggagaggccccactctctgtaccctgatgtctgtgaggtgcatgggagaggcagcgtccatactccccgcttccctcggggtcctggggagtggcagcaaaaagaccagcgagccttcggagaattataactttatgtgggaggctggggcgcgtcgcacactctcagtcgccgtcaccgcgggaagatggtgccatccacgttctcctccaggatggtctccacgcgcctccgctgccggggagagaggctggggtccggcgtgtgcggaggcgggcagggcccctcccctttccccgcccctaccggggcttgtctgcacctcttggcggtccagggggtccgggatccgcgcgggcttcagctgcggcggcaggaacagctccagccggatggcggcgcgcgcggacttctgccgctggatgagcagcgcgatctcctcggcctgcggggcccgggtagctgagcgcgcgccgagccccgccccgccccgccccggccggctccgctcaacgctcccggtgcgccccctctgccctccgaccccctcgcctcacccgcatgcgggtgtagcgcagccgcagggcgcggactcgcccgcgggcctccgctgccttgaggacgccgaggagccggttctggcgctcggcgggcagctcgagcgactgcgtccacgggcgcgggtcgggcatgcggtaccccggttccaccgacccgcacgggaaggtggaggccgccgcgcccacgtcctccagcaggtcgccgaagagcagatggcggtggcgctgcgcagggagcatggccgccagtccctgcggcgtcagggcccagcccggcttggggggctctgtcgcgggcgcccccttggcacgctcctcaccctgcgccgtgcctggcgcgctcttcccgcttcgctcccgcgggcccttgcgcccgccctccttcgctggcggcggcatcctcccgccctgcggagggaggagggcgtcccgtcggtgccggggctggcaccgggccctgcccgcccctcggcagggccccaacgtgcgccccagctcccgcccgctgggctctccgcagtcggttttgagttccgcacccccagcctctgagctttgcccaggcgctctccctctcccaagcgcacgtccccagcagctctgccatcggctgatcctgctcagtcctgcagtcaactaggactttctgatcaactcagttgtaggaaatatctttcctacccgatggactgttctgtttgaattgagaaaatgctgagaccccactgggttgatctcaggccctgccacatggagagctctaggtgacgcctgggggaccttcgttgtgcccctatgtctgcggtccccgacagtcagggtctcccaccagacagctcgctcttgcccttcgaggcctagatggttgtggggagcagagcctagagggcaggtgacagaggagggagggtccaaaagcccagctggctcctcccttcccggccccagcctacagctgccaccttgtccagccagggctgggctcgctgtgccagaggcagagccacggccagccccagcggcggctaacgcccccgcccctccttagctcctgcagccgaggcccagcccccacctcttggtccctacaccccctgcttgctgccttctctggtcggaagaacctccgccgtagcccagactctttgggcttgttgacgcggttgcccagcaaccgggagtcctgcccctccctcgaccaggtggggcgggtcgtggcggggggcagggtcccctccggagggccctgggttagagtctgggcgtggacgcgcccctcataggggtcattggggcatagaggcatagagccggcttctccagcttgggtgagcgtcctttccaggcggccgcagacgcgccatcctaggggttgtgggcccaggttcctggcttgaggggtctttggggttagttttgtgggtggggccctcggctatgaggagacctttgtggttaaggcccattcccttctgatggccagggggctctggccccagccactggtgttcacagaaagggataatggggcagaactcaggacccctcacctcttctagggcaagtttggggtctcaggggtcctggtgtccccaggactagagctgggttttgctgaacactgtgtcttgggatcttgggtcctagatactagattttggaaatctatttgtgcattcctttgttttgtaactaattctcaattaactacttaatcattttataatttcttcaggcactcataagtgtgttctagaatttcctaattcacgtgcttattccacagtttaaattaggcaaaaattagtgcaaaaagtccaatctgttacgtatctattacttccacgagatgtctgtactctctctatattcacagacctgccgctgggacaccttgctgggagtttggaacctgtgagtttgggagtagggctgtcccagctgaggagcagggtcttagctgagcttctggccttttggcaggaggctgttgggtgttcccattgtttttgggagactgccctggcctctcagtaagagggtaaattttgacattcagccctatgtcccagagccggcaccccatcccacagctaggcccatccttccagccctcaagcttttgctgctccccaggaaggcccttcctggtgctgttccctcccctcctgcaggtgcctttggggtcctgcctgggctgcagcaccagcttggcttgaggaaggtccctggtctccagaagcagcagtgactgcttagggatgctcacccagcagccgctttctctgggcagcctttgtgctcccataggggtgagtcctttgagacagggacctgggccatcctctcagcttccctgggtccaggccagggggacacatgggtggggcactttctggctcttggcgtttgtgggggagtcacgcagggagtaggggaatattcttctgttctgcaagaaggggcttgtaacctctttttataggactggaaaaccttgacaccccctagtccataatttgcagcaggtactcccagggcctacctggctcacattcctcacccctactgtttctccacacgtttgcagttctgcaagaagggaggtgttctctgtgtgtttggggtccagcaactgtgagggacccagcaggccgacacctcccatctgtttctgtccccaggattcacgtgtttttcaagggctaacggaaatgctgagatctaaaagcatgtttattgctgccaaggcctgacgatgaaacttcaagtcaaattagtaagctttattaatgactacaaaatttaacatgatattgagaagctacaactcaattttttttgtcattgtatatagattttgtaaagttaaaatcacaaggacaaagtaatttattttgatgaaactcagaattgttaaaaattctttcacttttttaatagcacaaatgtgcggcctggtgactggcttccctgggggatggctgctctgtgaggggctgccagaccctctgccttgattcctgttcttggccagcccagggtggtgagcctgtggaaggaggagggtagactgtgcctgccctgggggtgggagtggggaggacaaaagacagtgttccagctgccgtctggcgtttgctgattctgagtcactggatgagagtgaggtgtgtgtatttgcctgctgagtgggtgtgaatctcaccccggaacccaggcctgcccaaatacccaggagctccaagagcagcctgtgtcaggctttaatctgtggacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatcctcgcacacaagctctgtgctgtcattcgcgtgtcatcgttcgtgtcttgggctatccctagtatccttgcatattgtttcgcctgcccagaacatgtgtgtttgaggttgtcttgctctctcatataacatgtgcctcttgctatctcttgtgtaacatatatgttctatataggaccctgattctaccttcccccttctggagggaccaccccacccttggcaggttgggggagggcaggactctattaggggtctagagatacctgggccatttcatctgcaccaccagttctcctccgtgggagcgtttctgggtccagggctgggcccctgccaaccccagggagcactgtcagtgtcacacctggccaatcccctagccaggtgaccaggcctgtctttcactctaagactgcgcctgtgaggggccaggtgcctgcctcctgcggggctctgctgaccacactctcagaggatatctgctgagaccagagctcacaggcctagcctggcagccgtattactgaataatggccaagttaggaaggttcccagggctgggggtcctggggtaggcttcttggaggaggtaggactggagctggctggggtggggcaggatccatgcaaggggccagaatctgcacatgggccaggatctgtgcattgaggccaggatctctgcatgggggcaggagtctctgcggggaggacttttagggggtaacaggatctgtgcagcgtgcaggatctttgcagtggggccaggatctgtgcagtgggtaggatctacattgggagtcagtgtctgttcaagggagtcgggggacaggacccgtccagggagggcaggatctgtacagagggaccaagatctacgcacggggatagcatctatgtggggtgggggcacggtctgtgccaggttttgggggcactagatctttgcaggtgtggccaggatctgtgcaaggggtaggatctgtgcagagtggccaggatctgtgcagagtggccaggatctgtgcagggaggccaggatctgtgcagagtggccaggatctgtgcagggaggccagggtctgtgcagagtggccaggatctgtgcaaggggtaggatctgtgcagagtggccaggatctgtgcagggagggtaggatctgtgcagagtggccaggatctgtgcagagtggccaggatctgtgcagggagggcaggatctgtgcagggagggcagggtctgtgcagagtggccagggtctgtgcagagtggccagggtctgtgcagagtggccaggatctgtgcaaggggtaggatctgtgcagagtggccagggtctttgcaagggggcaggatctttgcaggggggacaggttgtgtgcaggcaggtgcgcagggtcaatgcagggggcaaggtctgtaccgtgggctaggggtctatgtgggtggggggcaggttctgcgcagggggcctaggctgttcagcatgccagggtctgtgctgggggtttgccgcaggcacaagggagggagaagctgtcctgggttctatggttatgaacatgtcagggcagaatgacacagaacacacaagaagttcaagggaacacattatgagattgtgaacacctggactggggaggccacggccttctgctggaccctgaacggctcccacagagggagttgaggtctctattgactcctgaaaggccaggcaaggcagagctgggagctgccttggtgggggtgcaggtggctggttgctattgctgggtgagaaggcttggggtcaaaagaggtgggggtcagggagctaggtctgacctcgtcccccctcctttcttcctgtcctcctatccccagcgtgttttcctccctcttctcccatccttccttacccatcctctctcttgatctctccatacttcctccccactcctttccctttcctcctcctccccatcccaacccctcatcctccctgtctctgcctgtagggaggaagctgtggggtgacccaggtggaagacagacatgcgaagggagaggtgtctgcagtagcagggatgaggtgcttgtgtcccacactctgccctggcctctgacactggttcctggtccggggacatcaggttgggctcctttgtccttcccttacgaggtctctgctctgcccaccctcagtgcctacagtgcccaggctgggtcccaggctgggaggcaggctcaggaagctcgggtaggagggtctagggtctcctgctcagacgttggtgagcccagctggggcggagggctgcaggagtccgagcctgcctggattcctgccccctctcggctcctgaggtcagggggctcaccctcgagctttgcctggagagcgtgtttgtgcatgtgtgtgtcctctgggtgtcggagggccttggtctgtgtctgcctgttcccaaaggtgtccatgcacactctaggtctacccatgtgcctgcgtgcacgttggcgtcatcttgcatgtgtgtggcccgtgtgtttgtgcatccctgtgagtgtctgcatttctgagtgtgtacccatccatgtctctgtgtgttcacccgtatgcctgtctgggcatctgtgtgtgtgtttgcaggaatgtgtgtccccatgtgtcccttgagtgtctctgttgacgtgccccgtgccttcacacgtgtccctgagtcttggttgccgtgaagatgcagggagaaatcctgggggacagcgagggatgctgggtcctggggcatctgcctgttccgtcctctcctgatttgccaggtatcctagcaacgctgctgccagttgcctagcaaccaggtccccactcatggagaaggtgctcggagcagggtctgagctgtgtggggagaggtctggttttcctgcaaagctcgtgcaggaagtacaaccccatgaccgggagggagctggtgattcagctcaggggtcacccacacagccttgacctgtgacctttcatctcagtggatcaggcatgggacccccgtgctgagaaggaggcaactctgaaggggccattcagctgtgtgggtgccaggggcctgtctgcaggagtgatgctcagccactgatctggggcccagctgtggcagaggtgccctgggcactgatctggggcccagctgtggcagaggtgccctgggcactgatctggggcccagctgtggcagaggtgccctgggcactgatctggggcccagctgtggcagaggtgccctgggcactgatctggggcccagctgtggcaggggtgccctgggcactgatctggggcccagctgtggcagaggtgccctgggcactgatctggggcccagctgtggcaggggtgccctgggcactgatctggggcccagctgtggcagaggtgccctgggcactgatctggggcccagctgtggcagaggtgccctgggcactgatctggggcccagctgtggcagaggtgccctgggcactgatctggggcccagctgtggcagaggtgccctgggcactgatctggggcccagctgtggcagaggtgccctgggcactgatctggggcccagctgtggcagaggtgccctgggcactgatctggggcccagctgtggcaggggtgccctgggcactgatctggggcccagctgtggcagaggtgccctgggcactgatctggggcccagctgtggcagaggtgccctgggcgtgtctccaagtgacgaacagacccgggtttcaccccgtctctgccactgtgacaggtggcctcacacctctgaggcttcgtgctctcagcagtggccgggtatggtgggggtgactgagctccaggagcacacagcaggtgctgggccagtgccgtgtcctggacccaagcatcttacccgcttgtttacgacgaagctttgatctgtcgagagctggccgggtgggggcatttcggtgtgccgggagcccagctggggggtccgggccagtctgtccaaggctgtgtctccgtgtgagtcgtggtccccgtgtctgtgtgtccttgtgtgtgtctctctgtcctgtgtctccaatcctgtgtctgtgaacccgtgggcatctctgtccgtgtgtcctggcctgtgcgtgtgtgtctgtctggggtctgtgggtctgagcctcctttttcatctctgtgtgtcctggactgtgtgtctgtccccgtccagtgtggggccggcgcagccctgggtgcggtgacccaccttcccgcagcccccacctcctccagcctgcatagcccctccccttctggagctgcagcctcctccccctcccccccagcttcgggctgccggctcactcggctgctgcgtctggtctggcgtctgctgagaagatcctcttctaccctgctctgcacctgtgctcgactgccagccggctgagggcgggggtctccacggtggtcccagctcccaaggaggttgcagaagtaagggcctgagccgctggaggtcgggtgggggtcctgctgacagactgcagcaaagcagggcgggtggagggggcaggaggaagctgggtcccaggcgtttctgggtgtgtctcagtctcttttgtgcctgcgtgtgcgtgagggcaggtttgggcatttctgtgtgtctgtgtgtgtgacttgtgtccctgcatccctgtgcctgtgaacacgcgagtggctgtgtgttcatcagtccctgtgggtggacacgtgtcctggggtgtagctgcctccaggcaccctgtgtgtgagtctctaaaccaaatgggaccgtgtccttgcgggtgcatgtgtgtctttgtgttctgtgagtccctgtctgtgcacacgtgtcctcgtgtctccatgtgtccctgcatgtgcatgtgtgcctgtgtgttctggtgtgtgtgcccgtgtgcctcagtgtctgtggctgcccagcgtgggggtccatgtgcctgctgggctgcacgtgctgggttgtgaggcctccgctgggcgtgtgtctggcactgcagccacttgtctctgcgctctgtcccaggtaccgtacagagtggatttgcagggcagtggcatggagcccctcttccccgcgccgttctgggaggttatctacggcagccaccttcagggcaacctgtccctcctgagccccaaccacagtctgctgcccccgcatctgctgctcaatgccagccacggcgccttcctgcccctcgggctcaaggtcaccatcgtggggctctacctggccgtgtgtgtcggagggctcctggggaactgccttgtcatgtacgtcatcctcaggtaggctgggccccaaggttcctgtctggtgagtcccacacggctgcagagggggaaactgagacggggtctgttctggatgggcctgagcaggtgttgatttcctgcttcccccattcaatgtttttgaccctgtccaggaggcagggtcagtcctgaggccctgggtgctcccctccacagggaggggaggggagggggctggccctggcccaccgcgctctgtcccaggcagagacgtcaccaccctgacctctggtttgagctgtggaccaggctctgtgtcaagctgtctgcttgaatgacctcatgagatcccacagcggccctgggagagtcttttttcagcccattccctagatgggcgaagggaggcgcaggggctggagctcggaccgttctgaaacccctctcaggctccagggctcctgctcatggcaggtgtctgtggctgagcccatgatctgttggtgctcagagatgggaaaacttgtgggggccattgagagagcagctgatagttgagattgagggggcagtgtgggggcagtgtgtggggggcggtgtgtgggcagtgggtgggggtcagtgtgtggcagtgtgtggggggcagtgtgggggcagtgtgggggtcagtgtgggggtcagtgtgggggcagtgtgggggtcagtgtgggggcagtgtggggggggcagtgtgggggcagtgtgtgcgcagtgtgggggcagtgtgtgggggcagtgtgggggcagtgtgtggggcagtgtgggggcagtgtgggggcagtgtgtgggtcagtgtgtgcgcagtgtgggggtcagtgtgggggcagtgtgggggtcagtgtgggggtcagtgtgggggcagtgtggggggggcagtgtgggggcagtgtgtggggacagtgtgggggcagtgtggggtcagtgtgggggtcagtgtgggggcagtgtgggggggggcagtgtgggggcagtgtgtggggacagtgtgggggcagtgtggggtcagtgtgggggtcagtgtggggtcagtgtgggggcagtgtgggggggcagtgtgtgggtcagtgtgggggcagtgtgggggcagtgtgtgggtcagtgtgggggcagagtgggggcagtgtggggggcagtgtggggggcagtgtggggggcagtgtgggggcagtgtgggggcagtgtggggggcagtgtgtgggtcagtgtgcgggcagtgtgtgggggtcagtgtggggggcagtgtgggggcagtgtggggggcagtgtggggggcagtgtgggggcagtgtgtgggtcagtgtgggggcagtgtgtgggtcagtgtggggggcagtgtggggggcagtgtgggggtcagtgtgggggcagtgtgggggcagtgtgtgggtcagtgtgggggcagtgtgggggcagtgtgggggcagtgtgtgggtcagtgtgcgggcagtgtgtggggggcagtgtggggggcagtgtgggggcagtgtgggggcagtgtgtgggtcagtgtgggggcagtgtggggggcagtgtggggggcagtgtgggggtcagtgtgggggcagtgtgggggtcagtgtgggggcagtgtgtggggggcagtgtgggggcagtgtgtgggggcagtgtgtgggtcagtgtgcgggcagtgtgtggggggggacagtggggagcagccagggacataacgggggacagcgtggggggatagtgttagggacagtgggggcagccagaggaatagcagggggatagtgtgggggacagtggggagcacccagggggatagcgtggggggatagcatggggggacagtgggggtggccagaggaatagcggggggatagtgtgggggagatggtgtgggggggatagtgtcggggagatcgtctggggggatagcgtgggggagatggtgtgggggggatatcgtgggggagatggtgtgggggggatagcatgggggagatggtgtgggggggatagcgtgggggagatcgtctggggggatagtgtcggggagatggtgtgggggggatagcgtggggagatggtatggggggatagtgtggggatagttggggggagctggggcgatagcggggagatagcatcggggggatagtgtgggggatagtggggggatagtgtgggggagatggtgtggggggagatggtgtggggggatagcgtgggggagatcgtctagggggatagcgtgggggagatggtgtggggtggatagtgtgggggatagttggggggagctggggggatagtggggggatagcatcggggggatagtgtgggggggatagtgtgggggatagtggggggatagtgtgggggagatggtgttgggggagatggtgtggggtggatagtcgggggggagccgggggatagcattggggacagcatgggcacagcatggggggcagcgtgggggtgggcaaggaacccttcacgtggattgtggattgggcaggtagaagatggagatgacttaagcagaaagggagggttttctgggcagaggaaatgatggacctcaaatctatccagagaagagagaactgaaggggctggggacagcaggtgggatcttgaaggcccggttgggggaactctgttcttcaggcagtggggggttatgggtggtgctttagcaggaaaatgactgacagctggaatgaggtttcttattggtccaggatgtttgcctggacccggaaaaaggtgattctgaagaaagtgcccagggatctaaagcaagtgttccctccttacaacctcaaagggccccaaccggaggtgttatgtaggtagaggcgggacagggtagtgggggtgttcaagctgccaccatcctagccctgtcctcttagtgtccctgagaaaagctgttcccctctgggccttgtttttcccatctggaaagtgagcaaggtggaccatgcagccacgtgtatatgtatgtgtgtgtacatgtgtgtgcaggtgatgcgtggtcagacgagacagtgggaagaacagctgtccctccccactgctgactcctaagggaggctcctggggaggttgcctcgtgatgtgcatgtcccattgtggctggcgggcgtgtcacggctgaggagtgcggcagcctggggaagtccctgggcttgagcacctttcctgatatgatcgcttctctactgtgtttctcctctgcattgaggcatttaatctctcagaggcacttcctggattagagcagacagggaaggtcctctgctggccagagtccccagagagagcaatgctcaggagctgccgtggccacactggcccgagaggccgcatgcagcatgtttccagccagtgggctggggtgaccatcttgggagtcaggacactccgttctgagccctgctctgctttttaccagctctaaggccttaaaaaaacaacatagatcctcttggcctcagtttcttcctctatagagtggggatcaaagtagtatttttgcaaatcttcaatgacataaattccccctgaagagcttggcacaggtatttgccatgatcattgtcattgttgttgtctcttcgtaattgcggcctctttgtgcttattcataatccctctctaacaggcagaatggagccccatatttcctcacggcagctacactgacacagaatagtgtcatcttgggtgctgctgccactgccaatatcgccgccaccatcatcatcacaatcatcaccatcaccaccatcatcaccactatcatcatcaccactatcaccaccaccagcaccttcattatcacattcaccatcctcaccatcctcaccaccaccatcaccaccatcatcaccatcatcatcatgaccatcaccaccatcaccactatcaccaccaccaccatcattaccatcatcatcacgaccatcaccaccatcatcaccatcaccactatcaccaccaccaccatcattaccatcatcatcacgaccatcaccaccatcatcaccatcaccactatcaccaccaccaccatcatcaccatcaccatcatcacagtcatcaccatcatcaccatcatcatcatcaccactaccatcacgctcacagtcatcaccatcaccaccatgatcactgccatcatcaccaccaccatcaccaccataatcccccccaactattacaaccattaacttatttaacaaaaatttattaatcaccaacgattttcccagccctttccagcaccatttcaggtgcttggatacactcataccttattagcatccctcctgtccccccgtcaccattttcggtctccattgctaggcagcagtgtggacttggaagccttttgatatgttcttacagattctggagccctcagaaacctctggcaactgtagggtcagcatttgagtctgtgaggggtcatggaggggactcaaaagcaaggggagcagactctttcccttagggctctaaacctttgctcctgtgcagaatccggggtgtgttctggtagcctacatgccctgactcctctaaagtagacctgtgtttaaggcttggaatccttctgtgtgtgtcagagtcacttgaggagctggttaagacgtttgaccccaggccctaccccctgagactgactcatgagtctcaggttgggtccaggagctatcacttaccaagcccccatgggaactctgatgttaagggactcagggccactgtagcttgtggtggccaagaggagccccttgccctttgctgcctggtccagccagcatggccaagtgaagcctttcttctccctctactccgcaggcacaccaaaatgaagacagccaccaatatttacatctttaacctggccctggccgacactctggtcctgctgacgctgcccttccagggcacggacatcctcctgggcttctggccgtttgggaatgcgctgtgcaagacagtcattgccattgactactacaacatgttcaccagcaccttcaccctaactgccatgagtgtggatcgctatgtagccatctgccaccccatccgtgccctcgacgtccgcacgtccagcaaagcccaggctgtcaatgtggccatctgggccctggcctctgttgtcggtgttcccgttgccatcatgggctcggcacaggtcgaggatgaaggtcagtggggtgtcccctcctcccctcaccaggctccctggctcccgggtggctcctctgggcccacgtgccctccacgtctcctgggcccactctgaccccgtttctctccctgcagagatcgagtgcctggtggagatccctacccctcaggattactggggcccggtgtttgccatctgcatcttcctcttctccttcatcgtccccgtgctcgtcatctctgtctgctacagcctcatgatccggcggctccgtggagtccgcctgctctcgggctcccgagagaaggaccggaacctgcggcgcatcactcggctggtgctggtggtagtggctgtgttcgtgggctgctggacgcctgtccaggtcttcgtgctggcccaagggctgggggttcagccgagcagcgagactgccgtggccattctgcgcttctgcacggccctgggctacgtcaacagctgcctcaaccccatcctctacgccttcctggatgagaacttcaaggcctgcttccgcaagttctgctgtgcatctgccctgcgccgggacgtgcaggtgtctgaccgcgtgcgcagcattgccaaggacgtggccctggcctgcaagacctctgagacggtaccgcggcccgcatgactaggcgtggacctgcccatggtgcctgtcagcccgcagagcccatctacgcccaacacagagctcacacaggtcactgctctctaggcggacacaccctgggccctgagcatccagagcctgggatgggcttttccctgtgggccagggatgctcggtcccagaggaggacctagtgacatcatgggacaggtcaaagcattagggccacctccatggccccagacagactaaagctgccctcctggtgcagggccgaggggacacaaggacctacctggaagcagctgacatgctggtggacggccgtgactggagcccgtgcccctccctccccgtgcttcatgtgactcttggcctctctgctgctgcgttggcagaaccctgggtgggcaggcacccggaggaggagcagcagctgtgtcatcctgtgccccccatgtgctgtgtgctgtttgcatggcagggctccagctgccttcagccctgtgacgtctcctcagggcagctggacaggcttggcactgcccgggaagtgcagcaggcagcttttctttggggtgggacttgccctgagcttggagctgccacctggaggacttgcctgttccgactccacctgtgcagccggggccaccccaggagaaagtgtccaggtgggggctggcagtccctggctgcagaccccgagctggccctgggccagccgcacctctgaaggttttctgtgtgctgcacggtgcaggcctcatccctgactgcagcttgactctgggcccaacccccatttcccttcaggagaccagcgagaggccctggcccattccctccagcggtgcaatgaactatcatgctgtggaccgtcaacccagccctgcttctcagtgtggggcaggtgtctcaggacgaaggcgccgcgtgaccacatgggcagctctgttcacaaagtggaggcctcgttttcctggtcttgactgctctgtttgggtgggagaagattctctgggggtccccacatcctcccaaggctcccctcacagcctctcctttgcttgaagccagaggtcagtggccgtgctgtgttgcgggggaagctgtgtggaaggagaagctggtggccacagcagagtcctgctctggggacgcctgcttcatttacaagcctcaagatggctctgtgtagggcctgagcttgctgcccaacgggaggatggcttcacagcagagccagcatgaggggtggggcctggcagggcttgcttgagccaaactgcaaaggctgtggtggctgtgaggacactgcgggggttggggggggggcgtctgtacctcaggggatgccccgctgtggtcacccagagaatcacccttcctggtctacagatggaagctgcaggttggtgactttgcaaatgcacttcctacagatgaactattaaaagacctgcaacattgaaaaaactcattttttccaccaaaaccttggccaggtaacctaccttaggcacctgcaaagaacaggaagtgatggctgtctcgcaacagagcctgggctgctcctcctgctctggggagtctaggccgtggggactgttctggggaggctcatgctgtctccatgacgtctgtggcaggagtccctgaggacgggagctgcctagctacagttttcttgccaaggcgaggtgttttgtgaatctgtgctgatgtaatgtgcaccttcacgtatttatgcatgtggcaagcgttacttcctgtgcacgtagccagccctgggtctgtctctggggtaatgaaaaaggaccctaataaacacctgctcactggctgggtattctttgtaaccagtgtttctggctcctgccacctggggatttgcttctggagtgacttttctgggattggcacgtgggtgggaggaggctatgggtttaggctgaattcttgtacctgtcctgtgctgctcaacaggctgggctctgccctcagtgaaacgtcccccaggaggctgcaaccctggggagagttgaagccagttaatggtgtgttggccgggctgttaccttttcttcagcacacacggtttctctctaaacaaccgatggctgcacctctcccctgccccctggaaagagaggtttcctgaggatacagtgggagggtgctgctcccacccaggttgcagggttttcttacccccatttcatctcagaagaacccctgctcctgctcatttccccttccttgagcagatctgaggggagttttggtgaaggatgagcagacggcctcctctagggctgggtacactcttgccatggacatctgcctcctggttcctgtttggcccagttcagcccaggccgacctgcaaaacagagcagctttggagggtgggcacgggcacactccagtccaagtactcgtctccagggcatgggcagatgggcaagttctgtaggattttctgtaggtttgaatgacagacactgtcttatcctggactgctatagcaaagtaccatagactcagtggcaatagagacatcagatgtttatttctcatggttctggaggctggagatctgagatcaggtgcaggcacggtcaggttccggggaagacccgctcccaggctgcagagggccatcttctcactatgtcatgacatgggtttgacagctggagagcgtgcctttcctaaaggcactcatcccattcaggagggctctgccgtcatgacctgtcatctcccaaaggcccccctctcctgataccatcagcttggggggctgagatttcaaaatgcaaattttggaggaacacaaatagttcataacaaacacattgccatcaaagcaaaaatatagcatcaagggacaatttgggagggagaggctgcaccggggcagttactgtgcccttgggcccgggagatggtatggtcttggtagaggaggctcacacatggtgcggactgtcctgtcttcgggtgggtgtggatccagggctaagcccacagctagtgtcttccagaaggagctggccagacaggggccaagggccgtaggaggagttggggggcgttggaagctgactagctcccttgccctccaggactgggttccaccccggcccactccacccctcctctgaccgcaccctgggtctcctctccagcccccggctcccccagcccacctctgctgtcgggcttggtcaagtcgcctggcttttctgagcctcggtttccttccgtgtgcaaaggggaccgcagaaccctctttgtggggttgtgggggaaggctggggcgcccgggagggtcccgggtcgcgtccgacctcaggaaggcggggcttcagcagcggcctcggaccctccctccagggggcgctgtgggctcacgcgggcccagccttgggccccggggcgctgcggcgggaaccgcggtgactagcggggtcttaaagcgggtggcggggccgggctctcctgggaccaggagcccagagcgtggagacgtggcgggctgagccgctcagtgcggcccctgccccgcgcccaccccgccccgtgtcaggaggtccgcggagcgggaggacccgcctcccggggagagctcgcccgcccctccctcccggctggccgcggggcggtctgcagaccctttggccgtgccggatctgcctggtccccggggagaagacgctgaggatcccattgctggtctgtggatggggacaggagacgcccgaggtaagaaggggtccgggttctttggaggaatcctggttggcgccttctctgcagcagagacgcccggctggggccggagggcaaactgggggcagggtgggagacctcggccctgagggctgtaggggctcttgcctgggcgctccttaagctcccccgccccctccgccccccaccccgcggtgctcactctcagtcctgccttgcgcacattcccacgcccgggcctctcctgcccgcccctcgttgttcacttgctcattacgcctcacacctggctctgccgcgggcttggagcgggtgtctgggaaacacagtctcacttgtctcctcaaggggctccggggcaccgtaacagcgtgcagagcgcagtcaggctgccgtgctgctgctttgcgaggtgtgactgcagcgcagccaggaaacaaatccagggacagcttgttcttcctgcggtgtcggtgttggtggtggcttaaaaattgcccacagactgggctcatgcctgtaatcccagcactttgggaggctgaggcaggaggatcacttgagcccaggagtttgagaccagcctgggcaacatagtgagaccccgtctttcaaaaaaaagaaaaatttgcctggcgtggtggcgcacgcatgtagtcccagctactccagagcctgatgtggggggattgcttgagctcaggaagtcgaagctgcagtgagccgtgaccccaccacagcactccagcctgggcagcagagtgagatcccttctcaattaaaaaaaaaaaaattgaagcaaaagaaaaataaaccgtctacagcccccgagtgtgggctggacatgtgacttgcttccaatgcacagaatgtagtagaagggaaggcaagtggcttcggaatcttggcctcaaatgtattgaggcttcctcttggctcccccctgggtcgctggctcctccctgggtcgctggctcctccctgggtcgctggctctgggggacccagtgccatgtttcgaggacactcagcccctgaagcatccatgtgttgaggagcagaggcctcctgcccatagccatggaaggaagacttctcagaagaagataccccagcccctgcccagccttcagagggtcagggcctgggccaaggtcctgactgcaacctcaggagagaccctgagccagaaccacccaaaaagccactttaattcttgaaccacagaagtgaaatagtagaagttgtcttaagcggctaagttttggagaaatttgttattcagcaacagatatctaatacaatgttgtcagggaggataagtggatggagatggccgtggcgtgtttggctggctagcacggaggaggggcactgctgcaggcctgagccgagtgggctggaacgctggagtatttggtggatgggtggaggtgggcatacaccctgggacacctcgtggggcggtgaatggtgggtcctgtgtgccggctggacagattgatcagagctctgggtcatgaggactgaaaccaacccagaacactcacacctcactgccaggctggaatgccaggcatggaaccagctgagagccatggggccaagagtcggggcctggccacagcacacctgggaccaacccctggcccctcccacctgacagtcagcggtctctgaactgcctgcatttcattaccacccctcaccctgcccccaccagagtttcagcatgcagctcctgctggctgattacaagcccctggccacaccccgggagagagagttccaggtgccagcctgtccaagtgatggatggtccctaggctgtggtggcccagaggtcctggcaaaagggccctgtagcctctagtaaagtatgagaggagcatcggccacagcaggggtgtacaggccatggcgaggaccgtcggccacagcaggggggtacaggggagcacaggccatggagaggaccgtcagacacagcaggggggcacaggggagcacaggccatggtgaggactgtcggccacagcaggggagcacaggccatggagaggaccgtcggccacagcaggggagtataggggagcacaggccatggagaggaccgtcagacacagcaggggggtacaggggagcacaggccatggagaggaccgtcggccacagcaggggagtataggggagcacaggccatggtgaggactgtcggccacagcaggggggcacaggggagcacaggccatggtgaggactgtcggccacagcaggggggtacaggggagcacaggccatggagaggaccgtcggacacagcaggggggcacaggggagcacaggccatggagaggactgtcggacacagcagggcgggtacaggccatggcaaggaccgtcggccacagcagggggaacacagcagcacaggccatggcacatgggcacggcggggctgggcctcctgctggaactccacttgggcttcaggccacgagagtggatttctgggtctcatgcggtgcaggtgtccgcctttgcagcaacacagcatcgctgctgcctgaggtgcccgcacttaccaccccccggccccatcttggggagagactatgtaacgtggcccaggtcaagatcacagttcaggttccctcccctcccgaccactgtcattagggatcctgagtcccagagccttccaaggggcttgtccatctgtctgtctctcgtgggtaagtgggcccgggatgcttgctgtgtgggggcctctgccaggacctggatccctgctgctgtccacccaggggctgtccaggaagcagagacatgggaggtatatgcccacggctgtctgtaggtctggtggccagcgtgtgagggtctgtgtctccttgcgtggagaggacagcactgggatgtgaacaggccgggcgtcccctgaaagagacagccggaactgggtgggggtgggcgtgatgatgggggtgatggtgggggtggtggggggggtgggcgtgatgatgggggtgggggtgggggtgggggtgatggtgggcgtgatggtgggggtgggggtgatgggggtgggcgtgatggtggatgtgatgggggtgggcatgatgatgggcgtgatgatgggggtggtggtgggggtgatggtgggggtggtggtgggggtgggggggggtgggcctgatgggggtgtgggcatgatgatgatgggcgtgatgatgatggggggtgatgatgggcatgatgatgggggtgatggtgcccaggcccttcagcaccgcaatatgctgcggaagttcttccggaagttgtcatctagaaaggcgtagaggaaggggttcaggcacgagttggcgtagctgaggctggtgatgacgtaggacatactgatgaccagtggggtctggggcaggtccgtggtcagggccacgacagaggccaggtggaagggcgtccagcagaggaggcacacggccagcacgacgaggaccaggacggtcaccttccgcctggccttgcctagagccttggctccagagcggagccgcacggcccgcagcctgcgcaggaggtctgtgtagagcacacagatggtgcacacgggcagcacgaagcccaggaccaacgtgtagacacggctggccttgaaccagacctgctcgggccacgggaagctcagcccacagcttgggacctgcagctcgttgctgtagacgccagcgaaagagaagaagggcagaaccaggaccgtgacgcccagccagacacacaggctggcgaccttcgccccccggtaggtgcgccagggcatgtggcgggacctcacggtggccagcaccaccaggtatcggtccacgctcatcacggctaggaagtagatgctggagaagatgttgtagtggtcgacggccagcaccagcttgcagagcagctccccgaagggccagtactgcagcaggtgctccgcgatgttgacgggcagtaccagcgtgaagagcccgtcggcgacggccaggttcaggatgaacacgttggtcaccgtcttcatcttgggcgcccttaggattacaaggatgacggccgtgttgccagtcagccccacagcacagatcccggagtacacggcgggcaggagcacatagaggaacggcagtggctcggagaaggtggcattgtggccagtgccattgtcctgagagacgttggcacccatcgtggggagggagaaggagcccctgctgtcaaggggctctgggtgcccagcggcctgcattgtagctgggaccgttgacgatttgcgccctgggcaggtgggaggtgccttggagttgggtatctggttgggggcctccttgggctggattctaggaaagaaaaacaaccagagactttgagatccggccgtctgttagggcacagccactccaggttctctggcagagactgcggccactttgccaggtcaaggacatggggccagagggagcctggtggggtgtgtgggggcctcctcccgcctcttcctggtgagacttcagcagatcagttccctcctcccgcagagagcagctgctggccaccctcctgggaagagatgtggatccgtccctgccccagcaacccgcagatgcacgggctgcgtagaatcaagcggtccctttggaaacacacctcccaagctcatctctggctcccttgaatctgaaggtccttccctcaggggtcttggagtctgcaccctccctcacaccctcccgagagatgctgcagaccctgctggtccagctactcttctctccactgacctgtccagtgcttcgagtccagaagttggtagccttggtgtgttcctggttttggccagtacaggcagtcgcagggatggagggcgaggtgtggtcctcactgacagacctccagctgaggtttcaggagtttcaagacctgccctgctggctgcctcagccccggctgcgaggttcccagcctggtgtcagtgctgatgctggtgagggagggaggcggatcccccttgctgacgtggagcccggaaggcaggccccaccttcccctgagctgcagtagcgcctgcagtcggctgtcccagggtctcctcagcattcacttacccaggcagactcctcagtgggcggctgaggcacgtgtgcgcctgtgtgtcaggaagggactccatgcaggggcctctgggtgtgcccaggtcttcgggcagagggcactgaaggcatctgtgcctctgtccgggagtcactgtgggcctgggcacccttatctgtgaacatgggtgtcttggtgggtctcctgccccaccctgtgtgtgtacatggtgtgttcctgtgtgtgtgtgccagttaggacatgtacgtgtgtgggcctgtgtctgcctgtatgggggtctctgtgggtgagctctgcgttgtatctgagtgggtctacatgtccttggctgagtgtgggcatctggggggtctgtatgccctcatgtggaagcagaacttgttggccataggcaacccaccttctttttttgtcttttgctaaaagaggaactcagcctaggcaagctgtgaaaggctgcagagaagacgttctcacgctgacacgtaactctcccgccgtcctgcagaggtggtgagcatcacactctgctctgggttggtctttaagtccttcccttctccctgcttttcttccttgctggacgcaccctggcttatccaacccgtgtgtgtgcagctcggccgcatctggacctgctttgcaggcaacgccacagctgacacgagcagtcgccagtctcagagccgctcctcagcggagacgtgttgggtcagagggtctgtgttttctttcctttcttcttttttgagacagggtcttgccctgtcacccaggctggggtgcagtggcactatcatggctcactgcagccctgacctccctgggctcaggtgatcctcccacctcagcctctcaagtagctgggactacaggcatgtgccaccatgcctggctaatttttgtgtttttttttgtagagacggggtttcaccatgttgcccaggctggtctcgatctcctgagcttcagcctctacctcagcctcccaaagtgctcaggttatagccatgacccaccgtgcctggtcactgtgtgttttcagtctggggagatgtgtctgcccatcgagactgtgcccgctgcctgtggggttgcaaggatgtcaccgcacactcatggtcggccttctttcctgagagttgctctgtcaagtctattggttaggacaggagcctgggcagtcgccctgagtaccctgatgtcgccagcctgagggtacactgtgggtgggccccgagctacccttctatgggctgtgccatgtggatgttgagtccggggtcagggaaccctgctgagatatctcacactcctcttcagccagtttggggatggcggtgggggggatctgtgggtgtgtctcgagggagcgtggggcttgtagccacagtttgtcacataagtggagcttgacgcccacaaggtcaggggatggtgattagcagccgtgaggagagggtgcattggggctgaattttgtgatttggggtgttcgtggggtcgggaggggtcagttcacagctcctggaaaccagaggcgtgacacagagaggccaggcctggcatgtggtggcccaggcattgaccagggtgtgggctgggccaggcggtcactggtcttggctggggagcggccgaccatggcctcagcaccgggcactgggagaatgtcccaggcctgctgtcaccgagctgctgtcctggggtggggctggccacgctggcctgattctgggcctccctgggggcctgctgtcaccgagctgctgtcctggggtggggctggccacactgcctgactctgggcctccctgggggcattgctgggggcctctcccttccatgcattttgggaggggcccaggctagtgccggtgccttcctctgccccccagggctggctggcagcctgcccagtgacccccgtgtggcctgagctctgggcacccctgctggtctttgccctgcaggataccgactgccacccacaccttcttcagagcagggtgttccaggagggtcttcccttaagcctcagtagtggggagcccagtgtcagaggcatccctcagagcacagaatcttcccatgcaaagatcccactgtgtgtctggcttcctctgaagccaaccacgagtctgggtcctcttccctccaccggtatctggtgagtctgggaatcggagcccctcccagactctagctctgctctcctgagcctgtcctgaaggctggtctggcaccaccgcccgccggtcacattggaggtggggtgcgcatgatggaagggatggggaccctgagggcagtggggatgggggagactgccaggtgctgagctcaggaccccggggaggccggctggaggtgtcaggtcctcctggccacaaaagcagcagccccaggggccttttcctcctcccagaagcacctcaccgatgcccgctgcaacaccagggcctgagccgggggtgctcccccgtctgtacccccagcactcagggctcagaaaggccctttgctctgttcgtgggctgggcattgttccagccagctgtgagcttgtgagagcatcgttctgtggaaatggtttccattttcagaaataaattggccttttcaaatgaacctgtgaggccctttgggtgaagagaggagaggccagggagggagggagccgtggtcagctctgttgggcagaacggtggtgggggcctgacagcaaggccactgacatggcacatcctctgtctggggtgtggggtgagggagtgatgggtgccagtcagtgtgcatctgagcattttgtggggctgcgtgtgggggtcttgcagggacctgaaggagacccctagggcaggggccagggagaagcgccaggaccctgggacagcctgagcaacacacaacatagctgtgctggcttcacgcttgttgccgcttcacataggtgtggcagctgccctccacctgtccccctgtgtgcagggacacctgtccctcagtccgtgctgcgacttggatcttcacacgggcatgcatatgtgtagcaggcatacagacccagagattcatacagactccagtgtgcttgttgaccatctcatctccagccaggcaggccctggtaggaggggtggattctgccctgtggccagagtccaggcctgtctgccctgctctctctcctccatcagctctccaagatgagcctcaactgtagctgtggccctgcaggttaagtcctcccaagaggcctaggccattaagaccagtgagagggccgggggcggtggctcatacctgtagtcccagcactttgggagaccaaggtgggcagattgcttgagcccaggagttcgagaccagtcaaggcaacatggtgaaacctcatctctacaaaaaaaatacaaaaggccgggtgcggtggctcacgcctgtaatcccaggactttgggaggccgacgtgggcagatcacctgaggtcaggagttcaagaccagcctggccaacatggcgaaaccccgtctgtactaaaaatacaaaaattagccgggcgtcatggtgggtgcctgtaatcccagctactcgggaggctgaggcaggaaaatttcttggacctgggaggcggaggttgcattgagccgagatcatgccactgcactgcagcctgggggacagagcgagactctgtctcaaaaaaaacagaaaaacaaacattagctgggtatggtggtgcatgcctatagtcccagctgcttgaaaggctgaggtgggagaatcgcttgagcccaggaggtcaagactgcagtgagccgagatcgtgccactgcactccagcctgggtgacggagtggggccctgtcacaaggaaaaaaaaaagaccagcgagagttccaggcctggtgttctctaagcaggtaattgggcagcttagctctctcgaaagagataagtaattcagggccagtttccctcagagtgggaggtgaattctccagggaagctgggagaaaacacactttatttataaaactgggaaggggccatttctcatttaaattcaggattccccaccatacctcggggcacccgctgcctctctctttccccgtccagtcagcaatgaactgtccccaggggaggtcatgttagacaggaccatagacaccgggcaccttagctcagggcaggtgagaggggccagggtagccagactgggtcctcagccacctcccaaatacccgaacttaggccctgagtcattcatctgctgcacaaacacttgcccaggaggactgcggtgagcacagggaacaattcctgctctcgtggggctggccctttggtgggggaagcagatggtagatgaaatagtgcagtgcactgtggagcaggaggaaggggagctctgggggcagcaggaggccactgggccttgcagagaaggcaacgcttgtgctgaaacccggagtgggtcggggaggctgggcgagtgggggcaaggcccctgggggaaagagggcccttgggaccaggtcctaaagccagaggttctggaggtgacagctgggggagcagaggcctgagcaggttggggaagtggctgttgcagggaagccggaggtcacggtggcgtgtaggtctgcctgcctgtgggcagcccccaccctgaccaaggccttctgcaagtaggggtttacagggctactggggctggggcaccgaggcctccctctcatctctgaacctcatctgctaaagctgtgcctgccctacccacatgcctcctgccgccccaggcgcgtgtaggcggcaggctcagggagcctggtgcaaagatcccatcgtgactgaagcacgcagacaggaaggagggcgactgttccctagggcccaggcctgtctcctcttggggctgggagggttgcttaaatcaattatcaaagcgcttgcagcctcctgctcactcacaaagacccgaatccaagcacaggacagcaggcccccaggacagtcttccccagtggtgactgctccctgttctccttgccttgtccagtcccaggccctaataaccaggcataggccctggaatgggcccgccctgagtttggaagcttccaggtgctctctggaggcacaatcccagagggcttcactgaggaggtgtcactgtgcctggcctcagggccgtgtccctgggtgatctcagtgtgtctggagatgtaggagagggctggagggggtctcactctgtcctcagggctgggagcagctgtggccactcggagatcgtgggcagagtgggcaggcaggtgcaggcgcctttgagtctccaggggagggggttattcaggtgtgtcagtgcgtgtggacacacatgtggctgggcgggagtgtgtgtatgtcctgtgacatccttcaccggtgcctgcagtggcagagcgccctgagcccccatagagggcccaggagtgtccgagacctgacgtggactatgtctggctttctcgtcaggccgtgaattcttgctgaaggatcctcagatgggaaaggctgatgcatgcccagatctggaggcttttgactcgcctgttggctcctggcctggagacaaccctgtaggccggcagtccgtgtccctccacaggaggaccgtgcctacgtggctggtttctgggcctggggagtatgggctgcagctctgggatgctccaggggctagatttgttgaccttggaccgggctctccgtcgtgggcagatgaggaggggtgggaaggttggaggagaaaggctgggtgaggcagcccccaccaccctttctggatctctcaccttggggacatccagacaggagagaacagatccaggctggcagctggtagggtcggaatgatgggccctgttggaggtgagggagcttctgaccttgcccattctcttccccttctaacctgcctggcacaaaccccgacctcaaaggatggatagtggcctgagcctgtggcagaagcttcagctacccccggggactggctgatcctcgtgctgtgactgcagtacacacacacacacgcacatacacacctgctcacagattccagcacacacagaccttagcacacacatacacacaagcacacagatgccagcacgtacacacctgccctcccacacatggtcacacgcttacactccattgttgcatgaccttctccagatcagcacctgccatgtcctgcctgccaggtcgtcttcaggccaggagccattgcttgtgggtggtggggtggggctctcttgagctgattgctgtgagacgaactgggctggggaaggctgggtggcggtgtgggaccaggccctgctggagaggggtcaggggtggggtggaatgttagagttaggggcagtggccgggtcagggtcagagtcccacagccacatgcttgctgccctgcatccttgcagcattggcgtcggtgcacacgcatgtttcattccccgtgttcatggcatccagcccccatgtgtcatgttcacatgccctgtctcatttgctcatgcaaggctaacatcgttgtacccacacacgtctgcatgcatgactcgatgcacttttgggccccacttcaggcttcatgtgctggctgcacacattcctgctcacacgtcccgtggacatgccctgagtctctctgataaggttcagagcccaggagggcacctctcactcgggggagcctgttcctgaccctgttctctgctcgaggagcctcgggagggtcactgggcaagcatctaggaggagccagcagctgcagggctggaagggccatggcccacgcctttctgtggccagtgagcagggatcctgctgtgatgaaatctcaggcaggctgtggcacgggggatgccgaaggtgaatctgtgtagctgtgaggaccctgaagaagagctttgccgggcgggcagctggggcagtgctgggaggtggcacctggctggtgcatgttgtatcctctgtctccaaatccccgttctctgcacagagctagacattttgctgcaccggcgaggactggagtggagtcaccctcagctctggggaccccgctatgggccaactcctccctggacctcctgctgatgggctgccctggttcctatctccacccctttgctcccagcacctctgctggtccatgtaaccaatgtgccctgcatgccaggccctgggctcagtgctgggggctcagactgggctgggacctggcaggggttggggtggtacctctgtccagggcttgtggatgggactcttttgctactgccttggcagcagccaggagggggcccagctgaggactgcagctctacccagtccagaacgtttgaccatgcagggggataggctccacttccagagtctgtgatggttttttttttgtcagaggaactgagctagaaagagctgtgaatgatggttcagctctgagaagcagataaacctttataagtcagaaggggcctcagtttctccatttgtcctggccctgtttgtcacatgcccttcaggacacacacatctgtctctcctgcatagccctccatggagtcctgggccaggttccgggtccaccctgtccccatcccagtgtgctcagcccagggcagtaggccacatcacaccaggtcttcagtggcctccctcctccatccccagggatgtcgcagggatggcaggtggaggaggcttttaccaggagaggcagcactggcaggagcaggtttttaaagtcttgaggttgtcatagcaactgcatccctgctgaggttctgaggttcggtggctgtgcagacgtccatgtgctggagctgggcatgtacaaaagccacgtggtggctccaggctgctgctgtggcacaggtgtgccttggcgttggtgaggtgtggcacggctgtgcggtggcgcaggtgaggtgaggtgtgaggtggtatacgtggccttgcggggcagttttccttgcctgtgacctcagcctatatccagctccaaaatgtggtctgcagtggggaagggcaggagctggatctggccctcccctgtgctgacctagattctgcccggcctgcaggtcctgcagcagacgtgcctgtaatgagtctaattgtgcaggctctgtggtcaccatagctttcggtacccaagggggtagacagaggtttgaatctaggactgggcagctccctcaccttccacccccacaaccgtggcctcagtcatcaacggacgaggccaagtcagtagcggaagccgggccgtgccctcggctgggtcctgtggccttcgggctgccaccctgtgctggggatggaggtgggggcatggggctgctgccaacacccggctggtgcttgcagctgtggtgccaacaattctcacgccgcgctgtcgtctttttggcttctggaattttgagccaattcgggctcaccgggttgatgccgcccctcatctggccgaggcttctgggagcctgagggagtcgggaccccaccctcagcggggcatggcgtgggccacgtcaccatccgccttgtgtttatgggatgatttaaaagaacacggcagtcttggaagagtggtgatggcgtttagcttaatggcttttgatgcagaagccaaaagcgtggtctgggccagacctaggcagtcagggctctgggctgggcaagggcaccgtatgaaaggctgggtggggatcaaggggagccagggttcaggctggaggccccctgaagggagatgagggtctgcaggggctgtggcatgaggatcttcatggctgcagtcttggaggagagcaaagtccagacaagcctagggacgggacagaggaggtggacagaggtggacagaggtgtgggaggccggccacggcccactgcacagggggtcttggggacgccagctcagccccaggcctcagctgaatggttgcctcccgcccaggtcgggccccacttcttgtgcccagggccctctctaaactcttcatcatggcccctctccgcctccccccggactccaggccagcgctgtgtctgtgctgtgcgtcttttgagctttgtctccagccctggaccctggggctcctccttctcgggcctcttcctgaagcctgaggagccaccctctgctgggggaggctgagtgtccctgcctagtctgggtgaggggagtcacagcccggcccagaccccaccccgcttacatgtatggcaagccatggccttgctctccagaagccatggcagccgggtgaggatactgtgagcacaggacttggtgtccatcttggctgtgccctctcaggagcatcagcctggtgaccttgtgacctcttatgtcccctctgcaggaagggtgaccaacagtctggattggcccaggactgtccaggttttagcactgaatgccccacatcccaggaaatctcttggtcctggacacactgtttatcagtagggcctacccgggggacatatgagaaagtgttccctccaggagaagctgtgctgggcatgagggcactctgatgtgtgtgtgggtggcctgggcaaagctgtgcggggcatgagggcaccctgatgtgggggggggcctgggcaaagctgtgcggggcatgagggcaccctgatgttgggggggtgtctgggcaaagctgtgcagggcatgagggcaccctgatgtgacgggggggcctgggcaaagctgtgtggggcatgagggcaccctgatgttgggggcggtctctgggcaaagctgtgcggggcatgagggcaccctgattttgggggtgtgtctgggcaaagctgtgcagggcatgagggcaccctgatgtgggggggtgcctgggcaaagctgtgcggggcatgagggcaccctgatgttggggggggtctctgggcaaagctgtgcggggcatgagggcaccctgatgttgggggggtgtctgggcaaagctgtgcggggcatgagggcaccctgatgtggggggggttgtctgggcaaagctgtgcggggcatgagggcaccctgatgtgggggggtctctgggcaaagctgtgcggggcatgagggcaccgtgatgggggggtgtctgggcaaagctgtgcggggcatgagggcaccctgatgtggggggggtgtctgggcaaagctgtgcggggcatgagggcaccctgatgtggcgggggggggcctgggcgaagctgtgcggggcatgagggcaccctgatgttggggggggtgtctgggcaaagctgtgcggggcacgaggtcaccctgatgttgggggggggtgtctgggcaaagctgcgcggggcatgagggcacgctgatgtggcagggggtgtctgggcaaagctgcgcagggcatgagggcaccctgatgttggggggggtgtctgggcaaagctgtgcggggcatgaggtcaccctgatgttgggggggtgtctgggcaaagctgcgcggggcatgaggacaccctgatgtggggggggtgtcggggcaaagctgtgcggggcatgagggcaccctgatgttggggggggtgtctgggcaaagctgtgcggggcatgaggtcaccctgatgttgggggggtgtctgggcaaagctgtgcggggcatgagggcaccctgatgtgggggggggtgtctgggcaaagctgtgcggggcatgagggtaccctgatgttggggggggtgtctgggcaaagctgtgcggggcatgagggcaccctgatgttggggggtctgggcaaagctgtgcggggcatgagggcaccctgatgtggggggggtgtctgggcaaagctgtgcggggcatgagggcaccctgatgtgggggggtctgggcaaagctgtgcggggcatgagggcaccctgatgtggggggggtgtctgggcaaagctgtgcggggcatgagggtaccctgatgttggggggggtgtctgggcaaagctgcgcggggcatgagggcaccctgatgtggcgggggggggcgtgggcgaagctgtgcggggcatgagggcaccctgatgttggggggggtgtctgggcaaagctgcgcggggcatgagggcaccctgatgttgggggggggtgtctgggcaaagctgcgcgggtcatgagggcaccctgatatggtggggggtgtctgggcaaagctgtgcagggcatgagggcaccctgatgtggcgggggggcctgggcaaagctgtgcggggcatgagggcaccctgatgttggggggggtgtctgggcaaagctgtgcggagcatgagggcaccctgatgttgggggggtgtctgggcaaagctgtgcggggcatgagggcaccctgatgtgggggggggtgtctgggcaaagctgtgcggggcatgagggcaccctgatgtggtggggagggcctgggcaaagctgtgtggggcatgagggcaccctgatgtcgggaggggggcaggcctgggctcagccagaagacagccccagttcctccagcatggctgggccccatcccacctcacttccttccatctccacctttgccgactcctgggatctgagcctcctcctggtctgtctctggttctgaatgcctcctatgtgccgggtgctgacagctaaagatacatccgtgtttcattttgtctccacaatggccaggggcagtactactgtcatcccatctagcagatgggaacaggaggctctgatggagtttccctggagcgtgcttgctaaccgtggagcaacagggcactcagcttccgcacggagcttcccagagcctgtggcttcctctcagggctccggcagtgttgaatgtggggagctcacactctcaccagggagacctcatacctgctgcttatcacctgggagatgttttctgcccacagaggctccgtcacatctctggctgctcggggaggtgagtggggccctgctcactcaggacaaaggaggctgaggtggagctctaggcccctcttccccacccacttgagtgcaccccgaaggcacgtggagttcctggggtgctgcctgtggtcgggccagagactgctccactgtccaaactgtgctcataggtatgtggcctggggactgttgccgtggaaccgggtaaagagccctgtggacctgtgctcccaactcaggccagtcaagggtgccactgtggcctagatagtctcctgaggggagcagaccaggtggaggtcaggagtacaggtctgggactggctttttccttgctgtgtggcccagggtgagttacccaacctctctgagcctctgtctcctcacttgtcaaatggggatcgtaattttcctgcctcaggctggaggcttgcacgtgttgggccagccccatctgaggtcccacctgcccgtgctgctctggacctggtctggggtttcggccttgggcctgggcagctcaggtggatgcttggagggagcactgacctcaagtcagctgtgagtaggacgggaggctggtgagcggcagcaagctgcaagccacaggcagggagaacttcccggaggtagagagagagagagagagagagagagagagagtgtgtgtgtgtgtgtgtgtgtgtgtgtgtgtgtgtgcgcccttcttagcctgggcaaagaattgggagaccagcaggccagcgctggctctgccatggaggggaagcactttgaagccccactgttcctggactagctctgctgaaccacagaggggccgccgttttcccttggctggggtagaggaacagggtccttcctgtggctcctggctgagccaggttctgtgcgacgcggaccaaccctgacccccagtggccagttccgagaactgctgcagaggaaaagggaccattcagtagggtgggggtgggggcttgcgcggcattcattttcgagtggacatgggggcaggcaggccagtctctgatgatttaaggatgctgtggtttgaatatttgtcacctccaaaactcaagttggaatttaatccccaatgtggcagtattgagaggtggggcctttaagaggtgattgggtcacaagagctctgccctcatgaatagattaatttatttatagattaatgggttatcataggagtggggctagtagctttataagaagagagagacctgagccagcacgctcagcccctcaccatgcgacgccctgcactgccttgggactctggggttcccaccagcaagaaaacctcaccagatgtggcccattgaccttggacttcccagcccgcagaactgtaagaaatacattttgtttcttttaaattacccagtttctgttataagcagcaggaaacagactaagacaaggggcaagccagcctctgcccacaaggagctccattctggtgtggagagacccaaacacacaactatgctctttgtcttgctagagacttgttttgtggtggccccaacctcaacttgccagcaatttgtaaaagaaccaagtcaattttacacagcaaattaaaccccagggtaaatgtgtgtacctggattccaatagtaggtaaagattcttaatggtgaaaactatgactcctgttaaaactcttgtgttctgttcttaccactgagtttaaacaacaactctgtgctaatcgtataaagaatatttttgtctggactgtctacggccaagttctccaccctggatgtgcacagaatcccctggggacttcaggagctcactggagctggttccacccccatgcccaggctctgatgtgcttggtctgggctggggcctgggcaccagtgttgtcctagttttgtgttgctatgaaggaatatctgaggctgggtaatttctttttctttttcctaggtgaggagaaggatagaggctgggccattataaagaaaagaggtttgtttggctcacggttctgcagggtgtacgggaagcacggtgccggcacctgcttctggggaggcctcagggagcgtgcactcatggcgggaggtgtctcatggtaagagaagaggcgagagagaggggcgatgccaggatttttttaaaacaaccagctcgtgtgggaactaatagagcaagaactcactcatcaccatgaggagggcactaaaccattcattctggatccttccctatgacccgaacacctcccaccaggccccgcctccaacatcggggattaaatttcaacatgaggttcggggacaaacgtccaaactatagcaggtatttctgaagaacacccaggtgtttcaaagctggggtgaagccgtgggttaacactgtttttcagacatggctggagacctggggttcctacaccacagagtctccctgccagagttctcagctcctggggaggctgaggtgggtggatcacttgaggtcaggagtttgagatcagcctggccaacatggtgaaaccccgtctctactaaaaatacaaaaaatgtagccaggcgtggtggcacacacctgtaattccagctactcaggaggctgaggcacgagaatcacttgatcctgggaggcggaggttgcagtgagctgagatctcactactgcactccagcctgggtgacggagtgagacactgtcaaaaaaaaaaaaaaaaagaaagaagaaagagaagtatcatgataaaagaaataatattttaaaaaaagacagtgtggtatttgcatcaagatagacagatcaatagaacaaattagagataccagaaatagacccacaaatatgagcaagtgattttcaacaaagctgcaaaggcaattcaataaaggcaagttttgttctcagtaaatgatgctaaacagttggatatccatatgcaaaaaaatgaactttgatccataccttgtactatattaaaatattgtcaatatggatcataaacctaaatgtaaaagctaaaattataaaacttctataagaggacatagaagaaaacctttgcaaacttagatcaggcaaaacattattagataggatatcaaaacataatccatcaaataaataagatgtttcatcaaaactaagaacttctgctattccaaagacactgctaagaaaatgaaaagacaagcccaaggctgtaagacaatttttgcaaatcacatatttgataaaggacttgtatccagagtatatcaagaactctcaaaactcaataacgttaatggaaaaaaacagattctgtaaaatattttaaagaggtttattctgagtcaatatgaatgaccatggcctggagaaaacagtttcgagaggttctgagaaagcctggagaacacagtttcgagtttcctgagaaagcctggagaacagtttcgagaggtcctgagaaagcctggagaacacagttttgagtttccttagaaagcctggagaacacagtttcgagaggtgctgagaaagcctggagaacacggtttcgagagctcctgggaaagcctggagaacacggtttcgagaggtcctgagaaagcctggagaacacgatttcgagaggtcctgagaaagcctggagaacacggtttcgagaggtcctgagaaagcctggagaacatggtttcgagaggtcctgggaaagcctggagaacacagtttcgagtttcctgagaaagcctggagaacagtttcgagaggtcctgagaaagcctggagaacacagtttcgagaggtcctgggaaagcctggagaacacggtttcgagaggtcctgagaaagcctggagaacacagttttgagtttcctgagaaagcctggagaacacagtttcgagaggtcctgggaaagcctggagaacacggtttcgagaggtcctgagaaagcctggagaacacggttttgagaggtcctgagaaagcctggagaacatggtttcgagaggttctgggaaagcctggagaacacagtttcaagtttcctgagaaagcctggagaacagtttcgagaggtcctgagaaagcctggagaacacagtttcgagaggtcctgagaaagcctggagaacacagtttcgagtttcctgggaaagcctggagaacatagtttcgagaggtcctgagaaagcctggagaacacagtttcgagaggtcctgggaaagcctggagaacacagtttcaagaggtcctgggaaagcctggagaacacagtttcgagtttcctgagaaagcctggagaacatggtttcgagtttcctgagaaagcctggagaacacagtttcgagaggtcctgggaaagcctggagaacatagtttcgagaggtcctgggaaagcctggagaacacagtttcgagaggtcctgggaaagcctggagaacacagtttcaagaggtcctgggaaagcctggagaacacagtttcgagtttcctgagaaagcctggagaacacagtttcgagaggtcctgggaaagcctggagaacacagttttgagtttcctgagaaagcctggagaacatagtttcgagaggtcctgagaaagcctggagaacacagtttcgagtttcctgagaaagcctggagaacacagttttgagaggtcctgagaaagtgtgcccccagcagtcagattatactttggtttcatagttttcagagaggcaggagttacaggcaaagacagaaatcaatacatagaaggtagacattggtttggccccaaatggcagggtatcttgaagcagggtgtacaggttatatgttgattcagagattctttaatttgcaactggttaaaggtataaagtttaattaaaaaattggagtcagcagaaaggaatgttttgagttaagatataagcttcttaacccataggggtgtgtgacttaactcctgtctggcacagccttaggtcctgtttataatttgatatcttattgtcacaaatagtttgttttgttggtcttatgaaatctattttaacattaatgcctgagatgtatgatgagatgtgtccaacttcccttcccatcatggccagggattcagtttttaaggttttctggggttcccttggccaagagggggtctgttgagttggtgggggccttaggatttcattttttttttttttgaaacagagtctccctctattgcccaggatggagtgcagtggcgctatctcggctcactgcaacctctgtctcctgggttcaagcgattctcctgcctcagcctcccaagtagctgggattacaggtgtgcaccaccacacccagctaatttttttgtattttcagtagagatgaggtttcactgtgttagccaggatggtctcgatttcctgacctcatgatccacccaccttggcctcccaaagtgctgggattacaggtgtgagccactgcgcccggacacactttgctagttttttttttttgttttgtttttttagtagcagtgctgggattacaggtgtcagccaccatgcctggctcaaatactacactgtcttgattactacagctttatactcaaatactacaccatcttgattactacagctttatactcaaataccacaccgtcttgattaccacagctgtatactcaaataccacaccgtcttgattaccaaagctttatactcaaataccacactgtcttgattaccacagctttatactcaaataacacaccgtcttgattaccacagctttatactcaaatactacaccgtcttgattaccacagctttatactcaaataccacactgtcttgattaccacagctttatactcaaatactacactgtcttgattcctatagctttatactcaaataccacactgtcttgattaccacagctttatactcaaatactacactgtcttgattactatagctttatactcaaatactacactgtcttgattactatagctttatactcaaatactacactgtctgattactacagctttatactcaaataccaccctgtcttgattaccacagctttatactcaaataccacaccgtcttgattaccacagctgtatactcaaatactactgtcctgattactacagctttatactcaaataccacaccgtcttgattaccacagctgtatactcaaatactacaccgtcttgattaccacagctttatactcaaatactacaccgtcttgattaccacagctttatactcaaataccacactgtcttgattactatagctttatactcaaatactacactgtctgattactacagctttatactcaaataccacactgtcttgattaccacagctttatactcaaatactacactgtcttgattactatagctttatactcaaatactacactgtctgattactacagctttatactcaaataccacactatcttgattactacagctttatactcaaatactacactgtctgattactacagctttatactcaaataccacaccgtcttgattaccacagctttatactcaaatactacactgtcttgattactacagctttatactcaaataccacaccgtcttgattaccacagctgtatactcaaatactacaccgtcttgattaccacagctttatactcaaatactacaccgtcttgattaccacagctttatactcaaataacacactgtcttgattactatagctttatactcaaatactacactgtctgattactacagctttatactcaaataccacactgtcttgattaccacagctttatactcaaatactacactgtctgattactacagctttatactcaaataccacactgtcttgattaccacagctttatactcaaatactacactgtcttgattaccacagctttatactcaaataccacaccgtcttgattaccacagctgtatactcaaataccacactgtcttgattaccacagctgtatactcaaataccacactgtcttgattaccacagctttatactcaaataccacactgtcttgattactatagctttatactcaaataccacactgtcttgattaccacagctttatacgcaaataccacactgtcttgattactatagctttatactcaaataccacactgtcttgattactacagctttatactcaaataccacactgtcttgattactacagctttatactcaaatactacactgtcttgattaacacagctttatactcaaatactacactgtcttgattaccacagctttatactcaaatactacactgtcttgattactatagctttatactcaaataccacactgtcttgattactatagctttatactcaaatactacactgtcttgattaccacagctttatactcaaatactacactgtcttgattactatagctttatactcaaataccacactgtcttgattaccacagctttatactcaaataccacactgtcttgattaccacagctttatactcaaataccacactgtcttgattaccacagctttatactcaaataccacactgtcttgattactatagctttatactcaaataccacactgtcttgattactacagctttatactcaaataccacactgtcttgattaacacagctttatactcaaatactacactgtcttgattaccacagctttatactcaaatactacactgtcttgattactatagctttatactcaaataccacactgtcttgattactatagctttatactcaaatactacactgtcttgattaccacagctttatactcaaatactacactgtcttgattactatagctttgtactcaaataccacactgtcttgattaccacagctttatactcaaataccacactgtcttgattaccacagctttatactcaaataccacactgtcttgattactatagctttatactcaaataccacactgtcttgattactacagctttatactcaaataccacactgtcttgattactacagctttatactcaaatactacactgtcttgattaacacagctttatactcaaatactacactgtcttgattaccacagctttatactcaaatactacactgtcttgattactatagctttatactcaaataccacactgtcttgattactatagctttatactctgttttgaggtcaggtagtgtcagtccctctaacttcatttttcaaagttgttaggggattataggttctttgcaaatttctatgcaaattttggaatcagtttgttaatttccagaaaaaagcctcttgcaattttaattgcattaaatctatagatgagtttgggtagaatcggcatatggagttttctgatgcatgaacacagcataactcctatttacatctttaatttctctcagcagttttacggtttttaatgtatggcttctgtcagttgtatttctaggtatttcattttttgatgctattataaatagcattgtttttaaaaatgttcatttgattattcgtttctaggatatagaaatcccatagatttttgtgtattgattttgtatcctgaaactttgctgaagttgcttattagttctagtagcttttttgtggattatacccaactttctacacagatgatcatgtctgtgaattagacaattttttatttctaacctggacaccttttatttctttttcttgccttattggtttggttagagtgtccagtacaatgttgagtagaattgaacatccttgcctccgtcttgctctgaggagagacatggattaagatttaacttgggtttttcatatcaggctgacacattctcctattcctagtttgctgagagtctttatgagggatggattttagattttgtcaaatgctttttctgcgtctattatgataatcatgtgtttccttttttagtttgttaatataacgaatcacactgattttgttaaactaaccttgcattctggaataaactctgcttggtcatattatagtattttttcaaatattgatggattttgatttactaaaatgttgttaataatttttgcatctgtgtttatgagggatattggtctgtaattttttttcttgtggtgcttttggtatcagagtaatcttggcctcaatgaatgagttgggagacagtccctcttcttcagtttcctcaaagagttctgtgaaattggcattcttttctttttggagacagagtcttgctctgttgcccaggcaggagtggcgtgggtcacatcagggctcattgtagcctcaacgtctggcaaagtgatcctcccatctcagccttccaagtagctggaccagaagtgtgagccaccacacctggctaatttttaatttttagtagagacggggtctcgccatgttgcccaggctggtcttgaactccccacactccagggatgacaccttcactcaaatcacagcccctctggctgttcgttcctggagccccttgtgctgcgttggcccctgcttggtcctggtctgtctggccaccctcaggctcctgcctggtgtgtcacacctcccgcatctactgtccctcctggctccaggcacctgcccagatgccactccaccgtctcccctcctgtctgagatgcagggcatgaccacgggtgctgctcttagagcttcatgctccgtctgccccactgggaagcagctgagacctcagtcagccaccttgggggcccagattagtttgagacacttgagacctgttaagtcccgttccacagacccctctgagcctcctccatcaccacacatgtgggaagatccaggccagtgggacctggccaaactggtgatggggagcatcccaggggcttggggacacttggtggccaaaggttggagagggtggaggatgctcagccagagccggagcagcccctttggtgggacaattgcagaaaactgatagtaacgcaaacaattcttgttctagaactgcaaaggagttttgtccagaggaatgaagtagatgagtgttttgtggatgtctatttcacaccctggattgtcgatcgtggtttgggtcctccttggaactgggctcctaacgctcaacaggcttcttcattcattattgttgggggttgagttgtgtctcctaaaagatatgttggagcctcagccgggcgcggtggctcacgcctgtaatcgcggcactttgggaggctgaggcgggtggatcacgaggtcaagagatcgagaccatcgtggccaacataatgaaaccccgtctctactaaaaaaatacaaaaattagccgggtgaggtggcaggcgcctgtagtcccagctactcgggaggctgaggctgaagaatcacttgaacacgggaggcgggggttgcagtgaaccgtgattgtgccactgcactgcagcctggcgacagagtgagactccgtcaaaaaaaaaaaaaaaaaaaagttggagtctcaacccccagcacctgtgagtgtgaccttgtttggaagtggggtctttgcagatttaattagtccatttgaggccatggtggacttgggtgtccttacaagaagagggaaatttggacacagaagatgcagaggacagtgctgtgtgaagacagaagtggtggaggctggagggatgcgtctgtgagccagggagcatccaggattgccagaaactagaggaggtgaggaacggtcatccctggagtcttcggagggaatgcagccctgacaatactggattccagacttccggcctccagaactaagagaataattttctattgtttaagccagtctgtggtcctttattatggagccctaagagaccatgcagtgtgcgtggaaggggctgctccagacagaggaaaccacacacgcagatgtcccaggaatggggggtaggggaaggaggtgctgggtcatggagaacctttgaactgttttcctaaaggcaatgggaggcttctttaaaaagcctaattctggaaaaggttaaagcacacattttgaagacgaaactatgaccctcaggccagaggttttatttaacttgtgttggttttaacccctgggcctgagaacagagaacagggtgagtgtgacagaggcatgcccgcttctggggaggccagtggggcctctgcgcctcctggcaggggtcactcaggaagaacaagaggtcgagtggaagactatgctggatgttaaaggtggaattttggtgcatttgtcctggaccactgacgctttcttgttcagcacaagggcgatggcaatggccactggcaatcctgggctccaggtgtgtgcatgtgtgtgcgtagaggcactggagtatccaggcatgttcatgtgtgtgagtagaggcactggagtacactggagtatccaggcgtgtgcgtgtgtgagtagaggcactggagtatccaggcgtgtgcgtgtgtgagtagaggcactggagtatctagtcgtgtgtgtgtgtgagtagaggcactggagtatccaggcgtgttcatgtgtgtgagtagaggcactggagtatctagtcgtgtgcgtgtgtgagtagaggcactggagtatccaggcgtgttcatgtgtgtgagtagacacactggagtatccaggcatgttcatgtgtgtgcatagaggcactggagtatccaggcgtgtgcgtgtgtacgtagaggcactggagtattgacacgctaggggtggacatgcccagtgtggatgccctgcagtgctaccctgggaagcagatgatctgggccatctggtggccacactggtactgtgctgctctgtgtttagctgggcatgtgctctgggctgggcatgagacaaaatgaggatagctgctgggctgtggatagttgttcacaggggtgcaggctgttgtaggtgggccaggaggggctgggcagcccatgagggtgaggctgagactccacactgagcccaggtttaggggacctggtgggggtcacagcctcccctgtcccagacttctcctggcctctctcatgtcctatgagaccccctcactgtccaccctcatgtcctgtagagaccccctcactgtccactctcatggcctatagagaccccctcactgtccaccctcatggcctgtagagaccccctcactgtccaccctcatgtcctatagagaccccctcactgtccaccctcatgtcctatagagaccccctcactgtccaccctcatggcctgtagagaccccctcactgtccaccctcatgtcctatgagaccccctcactgtccaccctcgtgtcctatagagaccccctcactgtccaccctcatgtcctatagagaccccctcactgtccaccctcatgtcctatagagaccccctcactgtccaccctcatgtcctgtagagaccccctcactgtccaccctcatgtcctatgagaccccctcactgtccaccctcgtgtcctatagagaccccctcactgtccaccctcatgtcctatagagaccccctcactgtccaccctcatgtcctatgagaccccctcactgtccaccctcatgtcctatagagaccccctcactgtccactctcatgtcctatagagaccccctcactgtccaccctcatggcctatgagaccccctcactgtccactctcatggcctatagagaccccctcactgtccaccctcatggcctatagagaccccctcactgtccaccctcatggcctgtagagaccccctcactgtccaccctcatgtcctatagagaccccctcactgtccaccctcatggcctgtagagaccccctcactgtccaccctcatggcctatgagaccccctcactgtccaccctcatgtcctatgagaccccctcactgtccaccctcatgtcctatagagaccccctcactgtccaccctcgtgtcctatagagaccccctcactgtccaccctcatgtcctatagagaccccctcactgtccgccctcatgtcctatgagaccccctcactgtccaccctcatgtcctatagagaccccctcactgtccaccctcatggcctgtagagaccccctcactgtccgccctcatgtcctatgagaccccctcactgtccaccctcatgtcctgtagagaccccctcactgtccaccctcatgtcctatagagaccccctcactgtccaccctcatgtcctatgagaccccctcactgtccaccctcatgtcctatgagaccccctcactgtccaccctcatgtcctatgagacccctcactgtccaccctcatgtcctatgagaccccctcactgtccaccctcatgtcctatgagaccccctcactgtccactctcatgtcctatgagacccctcactgtccaccctcatgtcctatagagaccccctcactgtccaccctcatggcctgtagagaccccctcactgtcaactctcatgtcctatgagaccccctcactgtccaccctcatgtcctatagagaccccctcactgtccaccctcatgtccaaagagaccccctcactgtccaccctcatggcctgtagagaccccctcactgtccaccctcatggcctgtagagaccccctcactgtccaccctcatggcctatagagaccccctcactgtccaccctcatgtccaaagagaccccctcactgtccaccctcatggcctgtagagaccccctcactgtccaccctcatggcctgtagagaccccctcactgtccaccctcatgtcctatagagaccccctcactgtccaccctcatgtccaaagagaccccctcactgtccaccctcatggcctgtagagaccccctcactgtccacccatatggcctgtagagaccccctcactgtccaccctcatgtcctatagagaccccctcactgtccaccctcatggcctgtagagaccccctcactgtccaccctcatggcctgtagagaccccctcactgtccaccctcatggcctgtagagaccccctcactgtccaccctcatggcctgtagagaccccctcactgtccacccatatggcctgtagagaccccctcactgtccaccctcaggaccctctgcatttgctccttgggttcccggaacttgagcttgggtcttggtccacagcagctttgggaagggccctcggctgctttttgcttcagcagctggggagcagttaactttcagacccggccctcccccaaggcagctcagggaggggctggacactcggttatttatgtatttacttatttttaaatcaaagcacagcaaacatgaccatgtgggggtggcccagtggaccctcacagtgagccctgggccacacagaacatggccctggagcacccctatgaggttttaacagggttttgggggaccttggtgcttcctaaagtttcgggatgagtccccggggtctccagactgcgtctgcctcctcgtgcaccagagggtggcagtaactgttcatgtttgccccatccaggggtttttaccaggggtacctcatcctttctggggagtggggagagcacctgagggggtcggcctggaacaggaggttgcagcccattgcctgagtcttaaagtgtgcccttccccacagcacttcaggatcactctgggaccatcctaggattaggaattttaaaacgtttaaaaaaaattattttcctttttttgggggaaattggttatacatccagatgattcaaaaagtaaaagtttaaaaataaataatagtttaaaaaatgcgcaaaacaaaaaaactgcatacagtgaaaaggaagcatttctttttttaaaaaattttattattattatactttaagttctagggtacatgtgcacaacatgcaggtttgttacatatgtatacatgtgccgtgttggtgtgctgcacccattaactcatcatttagcattaggtgtatctcctaatgctatccctcccctctccccgcaccccacaaaagtccccggtgtgtgatgttccccttgaaaaggaggcgtttctgcttctcctctttccggtccttgacagtgattccgtgcatcacaaacacacacgctccctcagttacacgaatcacaaacacacgctccctcagttttgtgcatcacaaacgcacacgctccctcagttttgtgcgtcacacacacgctccctcagttttgtgcgccacaaacacgcgcactccctcagttatgtgcgtcacaaacacagacgctccctcagttttgcgcatcacaaacacacacgctccctcagttatggacatcacaaacacacacgctccctcagttttgtgcttcacaaacacacacgctccctcagttatggacatcacaaacacacacgctccctcagttttgtgcttcacaaacacacacgctccctcagttatggacatcacaaacacacacgctccctcagttttgtgcttcacaaacacacacgctccctcagttatggacatcacaaacacacacgctccctcagttttgtgcttcacaaacacacacgctccctcagttatggacatcacaaacacacacgctccctcagttttgtgcttcacaaacacacacgctccctcagttatggacatcacaaacacacacgctccctcagttttgtgcgtcacaaacacagacgctccctcagttttgcgcatcacacacacgctccctcagttttgtgtgtcacaaacacacacgctccttcagttttgtgcttcacaaacacacacgctccctcagttttgtgcatcacacacacattccctcagttttgtgcgccacaaacacgcgcgctccctcagttttgtgcatcacaaacgcacatgctccctcagttttgggcatcacaaacacattccctcagttttgtgcatcacaaacgcacacgctccctcagttttgtgcgtcacaaacacacacgctacctcagttttgtgtgttacaaacacacacgctccctcagtttcgtgcatcccaaacatgctccctcagttatgtgcgtcacaaacacgctccctcagttttgtgtgtcacaaacacacacgctccctcagttttgtgcatcacaaacacacacattccctcagttttgtgcgtcacaaacacgcgtgctctctcagttatgtgcgtcacaaacacagacgctccctcagttttgcgcatcacacacacgctccctcagctttgtgcttcacaaacacacacgctccctcagttttgtgtgttacaaacacacacgctccctcagtttcgtgcatcccaaagacgattcctcagttttgtgcatcacaaacacatatgctccctcagttttgtgcgtcacaaacgcgcgctccctcagttatgtgcgtcacaaacacagacgctccctcagttttgcgcatcacacacacgctccctcagttttgtgtgtcacaaacacacacgctccctcagttttgcgcatcacaaacacacacgctccctcagttgtcaggggactttgcactgtgcctttgcatgaaacaccatggcttgaagaggtcccgcatcgttagggcccccttgcccatggtgtggcgtcccctgaccgatttagccgttattgagggacatcgaggttgcttggtgtggcggcccctgaccgatttagccgttattgagagacagccaggttgctttcaacgttttctttttcacagacagtggtgccaaaggcgtccttggacatgagtcgtctcccagtgggtgagcacatcttagggcagatttctgaaggaagatgtgccaggcagagggggtctgaagttttaactttgaagggcgtattgtcacactgccctccacagagcttgtaccacggaggtggtggcagtgtcttgctgcccatgccttcctaatgtgtgtgttgtgaagtctctcgttctttctttttaaaaatttattatctttaattttttaaaatgtagagacagggcctcactatgttgctcaggctggtctcgaactcttgggctctaatttttgtatttttagtagagacaaggttttgccatattggccagggtggtctcgaactcctgacctcaagtgatccgcctggctcggcctcccagaatactgggattacaggcccttgacccatttttcttattgtgttgttggattttgtcttattgatttgtacggggcgtttacatattaaggaacttacacctacatacttgcagatatttttttcatttttttcttaaaaaattttcttttgagagacagaggtctcactgtgttgcccaggctggtctcaaactcctgagctcaagggatcctcccatctcagcctctcaagcagctgggtccacaggtatgtggcaccacctcccctggtttgttatttgacttttgtctttgcttaaggagttttgccatagagaattttctttttattacatgaggtaattaatctttttcataatatcccccttcccccatgctttcttctagtactatttaaattaaaaacttttaaatctttttaaatctatccaggctttattttggtataagagccaaggtcgtgattgattggtgtcagttagcatccatggaggagacagatgtcaccctcaacttgggaaatttgaggagagatgaataaagggactaagatgtggttggcatgtagagaaaccactaaggctaatgctgggtgggacccctcaggcctcggaggacacagggaggctgcaagggaggtggtcctgcaggagcagagacctgggtgtggggagactcgagtgcaggaccctacagggagggctggggaagcaaacacccactcccagttggctccctgcaggccagtcccacccagcagcccggagtcaggcagccgcaggtggccctgcaggtcacagaggtggaaagtggggtgggccagatgctggacaggtgcagcacaggacgctgggatgagctttgccagatgtggctccattactgaaccaacaacaaccgacttgggggatgggcacttccagaagctccccagggcacctggactcagcccccaggggtgcagtgtgcggttgggtgttggaggcctcaggtctgggcctagtggaggccaaagggtagggccagtgtggaatgagctgaccacaagctgttctagacaaggctgtaatctgcctttgtgaccccagggctgtccatggggagctctatggacctctcaatgtcagcgttttggggtaagggtgggggtcaggtgatgctgggatagatggggcagggtctgtgggggtggggagggccggggaggctgttgtcattcattcatccagtgcacacgggtgaagccctgctctagccacgccctggaacaaggccatgaggaatcagacactagcggttacttttaacgagcacctactgtatgcaggttccttgtgttgaccttcaggagctcatttactactcacaacaaccctgccgtctaagtgaggagactgagtttcagaaaggttaagtaacctgcccgtggtcacaccgagctgggattcgaacgcgggactggctgactccaggcctcaagctgtgttctgctaagctgtgctgctgcctctgggaagtctcacagagatgaaggccagcctgtctccacttttggggaattcaccctccattgggtgggcagaggcctcattatcaaataaggacagcggagagattcgtgctgagccacatgcgctgtcctgcactcacccattcttgcggcacgggaactgagcacgtatgttgagctcctgccaaaaagttatgatgcttcttttttttttttttctttttgagacgcattcttgctctgttgcccaggctggagtgcagtggtgcagtctcggcttactgcaaactctgcctcccgggttcacgccattatcctgcctcagcctcccgagtagctgggactacaggcacctgccatcatgcctggctaatttttttttgtatttttaggagagacagtgtttcaccatgttagccaggatggttttgatctcctgacctcgtgatcggcccgcctcggcctcccaaaatgctgggattacaggcatgagccaccgtgcccagccaagttatgatgcttcttgacataaaatctttaagcattaaaacaatattaaatcataaaatcagtataagaaagtctaaaacattgcagattttcctgaggtcaacttaaacacttaaaaaaaaaagccaaattcttaaaacaattgtttttggtgtcctgctttgatggttccctaaacacttgctctgactattagaaattctgtacctgggtagctggggcccccgtggagagggagcagctcgcccagtgagagaggcttggccattgtcctgcagggactctgctgttgggggagcgggcagggcatgtgcagtgtggggtgtggcattcagagggagtggcctccacagccctgtggctggggtagggagcccaggggggccatccatgtttctcttgaggtacctggcagaaggcgggtggggggggtgcggggggtggtccttgacagcagagcagagagagatggtggtcagaggcccaggcgggctccgattaggcccaggccagggtccgggatccataggaacccctcgaccaccaacagggccttgagcaccctggccagggcggaggtagtccaggacagaggacagttttgccagtggtgagtggaatttgggttaggggtagggttagggttaagttcaggcgcttgggaacagacagtgaccaggaagcctccggcagctgtgggccccagggctgacctgctgctcgtcctgctgctcgtcctgccccgtgctccaccgtcctggtttgcccaggtgaaggggtttccaggactctccgttttaaaaccagcacaatctgggccaactgggacacactggtcaccttgctaatgtgtccctgttcctgagggggaaagcggataggcagttgtcccccagggcccagggaaagaagccaaggcaaggtgcagacagatttccctgccccagactaagggagctgtggacagaggcctttgctgggaggtgctgggtcctttcctccaggcagcgctgggatttgggccccgagacctcgtgtttctctgacccagggaagaagcctctgtccactctgggccttgcccttcttttgttttccttggtggagggagggagaggaggtcgccagcactgtttgcccgagtgaggctcatttctcctttgtctgcacaaggctggactgccctgcattttcatggtaagtttgtttcttcaagccgttgttaaaatcctggaggcagagaaaatgcatttgctccatcaccttccctgaggtgacaagtcctataaaacctgttaaagcctttaatgaaatccctgctcagagctgctctgtgaatgaatgtggaatcagaatttaaattaaaatgttgctcttgttgtctggaggctttgcctgggaagaaatgaaaggggcagctcacctttctgccaccgttctcaggccgggtgggcgccatgactagccaccctctgacccagggctgggggcccacctgtgactcacgggctgggtcaagatgctagctggatttcaaggcagtggctctccccacacctgagactgtccctgctgcaggccccacagaaaatcccactgagggggaaggtgggtgtgcctgtggaccaggtagccacttgggactggaggttttatgtactcagaagcagagtcagtccctgagctcacaggctgatagcaggggtgtgggcagacagccgccctggaagaggaaagaagaaagtgagagcgactaaggggctctggggtgtgtgagtgggttggtgcaaggtggaaaggaggcagggaatgtcttcccaaatgaagggagcaggtgggaggccaaggcaacgggcatgaggcctggaggcctcgtggcttggctgggggcagtaccagccccgctcctacctgttcagcctccccgctgcagctcttccctctttccttcacggagtcctgctctttggacttaacacactcaggagtctgttgttaaaaaacaaaccaaaggctctcttagcctcgaccccatcacagccaagttctggagagctctctgctccatctcctcttgtctccccctcctcctccctctccacttctgcgtgtcccggagagacagagacccccaggcacccttggctggtgggagagacagcacaaacatgaacggctcacgggccgcacatagttgccttcactgcggggcgagacacagctgtgtggaaccggcccaggccctgagaggtgctttcctctcctgttttccaagttggcagcgctaccctatttcttctatgatgaaaaggaactctaaaagcattcaaaacatttaaaaagtgtgtgtaagaagtgttttcatccctgcatagattacctccagtgaaaaatcagctatgccccccccgccacttaaagtgctgtgaagctgttgcagggagggccccgggtcccaggaggaggccaggggaccctcggggagggcagggaaggtgctgcagggagggccccgggtcccaggaggaggccaggggaccctcggggagggcagggaaggtgctgcaggtggagagacttcgggacacgtggctctgggagcaggtgcaaagggttatagctgaaggaaggagaggagccatagctgattattcattgacggtaatgctacacagggattaaaatcagtcaacttgaataaaccttaagaataaggctgaggcggggcgcggtggctcacgcctgtaatcccagcactttgggaggcggaggcgggccgatcacaaggtcaggagatggagaccatcctggctaacatggtgaaacccccgtctctactaaaaatgcaaaaaaattagctgggcgtgatggcgggtgtctgtagtcccagctactcgcgaggctgaggcaggagaatggcgtgaacctggcaggcggagcttgccgtgagccgagatcgtgccactgcactccagcctgggtgacagtgagacttcgtctcaaaaaaaaaaaaaaaagaataaggctgaagctggtagggcgcagggtgcgtgcctagatttagtcccagctacttgggaggctgaggcgggaggattgcttaagtctgggaggttgaggctgcagtgagctatgactgtgtcactgcactccagcctgggtgacagagcgagactccatctctttaaaaaaagttgagctataaaaacaagttgtaaagggttttgttctgtatgatcacatcaatgtaaactgaaaaaaatagtatgtgttgttattggatgtgtatgtagatacaaaaactgtgaaaacatgcagggagatgatacaaaccaatttcagagatgcccccgctggggaggagggcacaggacaagcattcttcattgtctgtctgacagtgtgttttgaatgcgtgtttgaatattttcatgcttaaaaagtaaacaacaaaagatgatgggagataggatgaggaggcagcgtgctgaaaagggtccatttctaggtggcgaagagagtgagttggggcagtgggctgggcagagggagggcttcgaggattccaggaagaattctgtaggaaaaggagccaggcagaagggtgggagagccacaggggctggaagcggggtggtacttccaggaacctgaagcccaggtgaggacaggtgcttgtgccatgccaccgtgggggtgagaacttgggcagaagaggccgtgtgtgccgagggaggggtcgggagagggatgaagatctgaattgaatggatgctgagaggaagcttagtcatgcatcgccaaagacggctcatggagtaaatagagcactaaaggctggctcactcgcggagagctgtttcctgtggctcaacaagtttataataaacacagttaaacttttatttatggcacagctgctaattgcaccataaacacttttcatcaggcaattgctgtttactcatttgccaatcagctcattatccagctacctctccttgttcctgccttcccacttcccaaatcctactgcttctagggcgtccctctgcaactgtacccccacccaactgcctggcctgactcctggcaggtaggccccctctccagtccgcccaggctttggtaggtgtgcctgcccaggctaggctctgttctgctgctgaccatggccagccccgactgtccagcatcctagtgtttgaggccctgaacaatgcccctgctgggctctcctgaccactcttttctctggctcccaaacctcacggcccctggggatcctcgcctccctcttttcctgcgtttatcccagccccactcagcatgcccagaggtctccccacccatctctctcctagaccaggggttacataaaacttaagccagtgttcctgagggtccttcctttccttaagagggagcgtgttccgaatactcaactcctgccgcttgtttgctgggttcagtgtggcccctcgctcaccattacctcgcagagcactgagacagagcttacacttactcataccttggttcattggttcacccgaccatggccacctccacacaggtcatggtgtgagtcgcctccccccatgttccctctgcagagctggctccaggatgagcctgagctgggagatcctctggatggaaggaagttccaccctgtatccagttactgtgacacctgcccccctatgagctaacaggcccccaggtgggtggggaccagagtcttagggtgtgtgctctgtgtgctctgcagcacccactttgcagacatcagcgttagcggacatgtgtgtgagtgagaatgctcatgtgagtgcatgcatgtttaggtgagtgggcatgtacatctacgtgtgaatggtgtctgcatgtacacacatgcacaaaagtatgtatgtgtaaacgtgtgcatatgtgaatgacatgtatatgctcatgcagatacgctaatgtgtatgtacatgcgtgcatgtgtgtatgtgtaagtggtatatgcatgtgtgtacatgtaggtttttgtgaatatacaagtgtatatgtgcacataagcagtgtgtatgtgtgcatgtgtttgcacatgtgaggggtgtgcatatatatatgcatgtatatgcatgtgggcagtgtgttcacatgtgtatatgtgcatgtgtgcatgtgtgtgcacatgtgaggggtgcgtgtatatatgcatgtatatgcatgtgggcagtgtgttcacatgtgtatatgtgcatgcgtgtgcacatgcgaggggtgcatgtatatatgtgcatgtactcacgtgtgtatatgcatgtgggcagtgtgttcacatgtgcatatgtgcatgtgtgtgcacatgtgaggggtacatgtatatatgtgcacatgcatgtgtgcatacagctatgcacattgtgtgtacatgcacattgtgtgtacatgtgtatatttcaggatgtgcatatgtgtaaaagttgtgtacatgtaagtaatgcatgtgtgtgtgcatgtgttcaagtgatttgtgtgtgcatatgctacacatgtgtgctttcatgaacatatgtgtgtgagtggtgagattaagtgtatgtgcacagaggcctcagactgagtctgatgggggtccctgctagctctggagagaatgtggtagcagggctgaggcccttgtcttcagctgaatgagtctgcctggcgtgcgctcagtgctctcccgctctcctgcttctcttctgaggtcagtcacagacctggacatccggcttgtggggagtattgagttgcagtggctgtgtgtgcttttgtatgtgaacacatgtgctcatgtgttgcatgtgtgtggtgtgcactgtgtctggatgtgatcataggcagcattttggggtatttttgggtgtcagggtactcactgggggcattgaagatgcagtggcaaagcaggtgtccaggagtctgagctcagacttgactttctgcctgggtcagcctagattttctacatggaagtgaggtgaaagggagaggaatatttgggagcccttctctgtcccttaggtccctaggagcccaaggatggtgagagggcccagcccttggtttttgatctatttgagaggaaccgagtaatcttctggggtctgctcttggcttcttcagtacagtgaaattagctgagcagttcctctgggcagagcctctgctaacattcctttgaagcctccctccatgctgggaatccagcaatgtccagtgataagcttgggaggaggacatacttgcagtggaagagacaccatgcctgtcccaccagccccttcacttttggggtcaagcattattagagccctgccaatggattgtgtgtgtcgtgacagatgtcagctgggaggaaaagacactgggcccctcctgcacaggggccttatttctagagaaagggaagactgaggtgcaacgtgggcctgtggttagggagactgcattctgaacaccgtgggaagaatgctagaagctctcagcctctgccttcctctgccatgctcgagctggtcagtcatggtccccgaggccctacagcagcctgcagggatcagggcagcaaaggtgctgcaaaaccagcaagaccaacaggactgtacaagaccggtgttccacggcgacaccttgtggttgcaatggcagcagcactgcctgtggaaggacaaggctctcctgcagctcctccctaccaggctttggactaagcctccagcatttttggacagttggcatgcatgttggaggagagtacttgagaaggaaataatgggctgggtgctaatagaggatttggaggctcacacactaaatggggaaggactcattcatacccattccttcttccgaaatgtctccttccatgtcctgccctcgtacccattccttcttccgaaatgtctccctccatgtcctgcccaggcctgctctttgggtctcctggctggtgggggaacagatgtggcgtaatcacgtcgagatgcagcaggtgcaccaagcactgtgcgcaccgctgttagccccaggacccccagtgtcagcactggtggggctggtgtttgtggagtgtgtcagtggactggcaggcccgtggattccacgtgtgtaagagagactgacagcccttcctgtctcagagcagcccctcctgggtcccatcctgggtcccatcttggggttggacatgcccttgtttgagcttggccccttcttgctgggccaccagccctgaccctaaatctgagagggggcttggctgggcctggggtcaggggacaaacagccaccctggctgaggccctgggcagctgaggaacttcagccagctttgggcagctcttgggttgggagatgggctgctgttttctcggacaacgccctccccagcccctcaagactctgttttcagtcagttcaattagtacaactttaaagcaattagggagaattagtggccaggctgctgcaggcagatgctgaatacactcatgccccctcccccaacctccctcaccgaacctgacagctgctgcggggagtgcctttctctgctggctctgtcctttctcccagagatccagcccccatctctccttctctcaagggtctgaggaggggagggtgggcagtctaggggacagacccagagacaggggccctgggactgggagggtggggcaggcccggggaaatgggccaacttcccctcaagaccccaggcctgggcctgctctaaggagagaagggatgggtgctggttggaggctcagcccctgagtgagggtgagggtactcagcgcggattgggaggactgaccaggattgtggcccagcctctggccctgtggcctccaggagcccccagctctggtgagggcaccctttggtggggctgggggctgttcttcagtgggaggcctctgagaggctgggcctctcccactaggtgtggggtggcagcgaggccctgcttctgagccagtgctggagccacaccaccttctctgcctggtagtgaaggaggtggccccgtgggtgctgcagaccctgggccctccctggtgccccttgggctgctctgtggggagagctccaggtgcttgcttgcgtggatggggcaccagggcaggtgcagggctgacttcgcagatggagccctttgtgcggggaccctgtcttccggccttgcccctccctactcccccagcttctcaaagaaggtctgttttctgagcctcctctgtgatgcccccaccagccgcagcctccctcagatgtgtggggggtgtccgcggtcctaaccaatgtcttttctgcatgtgtccacgtgtatctggcactttctctgagcaggctctgggctcagcaccgggtaaggcagatccatgcagcccctcaccttggccgaacactgaacagatgatgacatgtacttgtgcaattccagcttcaacaagggtcaccagaacagctctgagcaattccagcttcaacaagggtcaccagaattgctctgtgcaatcccagcttcaacaagggtcaccagaacagctcggagaagggctgtgacccggtctgaaagcttcccagagactggcttagcgggatgaccctggggaaggagatagtgggtggagcagagaggctgattagaggctgagtctttatacggaagtgatggtgccctagaggcacaggagggagtgagtgctgccagtggggcaaggaggggcggctccacctgtgaccctaaccctaaccgcgtagggaaccttcagtgggcccatgatggtggcccaagcacacgaaggtgtctgtgctctgtgccttcgctgagcagtgcaagtctgggcccaggggcttcccctgaggaggggaagccaagggtgtccatgaaaagagtcaaactctgtaaagtatttgaagagatttatcctgaaccaaatacgagtgaccatggcccatgactcggcctcaggaggtcctggtgacatgtgcccgaggtggtcgggacacagcctggttttatacatttgaagggtgacatgagacatcaatcaatatgtacaagatgtacattggtttggtctggaaaggcaggacaactcaaagtgtgggcttccaggccataggtagataagacacaaacagctgcattcttttgggtctttgatcagtgtttcactgaacacacaatttacatgtgagagggggtagagaaatagtcacttatgccttaggctgactcagtgaatctgcatttttacataagcagtagggcagaggaagccatcagatgtgcatttgtctcaggtgggcagtgggatgactttgatgagttctgcctgtccattgtcccgcacctgtgaagggaagctatccatttacgttgccagggtgaaattcagcagaacagttttagggcaaagatcttgaagcccaagaagagtttctctgtggggaaattgtgagggaggatgtagacttccacacaatccttgtcactatcttattcgggaataaaatgggaggcaggttggcctgacgtgctttggcttagtgattttggggtccctagatttattttcctttcccaagtacttattacaaagtagcaggcttcaaacttggagatctcacaaccccaagtaacattctgttagaaaccatgggaccacccacaccgttgctgtggactacaagctcgtgtcactggcagctcaaagtagaaagtatcagacaccccccacctcgggggacctctgtttcagatctcaggtgactcttcaccttgaagacattcagcttaatcaaaacctcttttctgaccctttgtgccagccttcctggagggggctccccaaagaagggtctacttcttgtcccctacctccccacatccgctaagggcttctacacaaacacaggatgaaatgagaggaaggtggccaccggaacggtgcttaatggccaggatgttctctccctgatgtgtgctgttcccattacaggtattcacttcttgatgaagcaatttcctatataatggccccacatggcaggctaaatgtggaaaaccaccaaatagaggcagaaatataaagacactttggatcatcatttgcagaaggcaaaatagctgcaggcagcttgtggttgagacactcagtaatggtactggccaggcacggaaagcatccacagacacagctcacaggtgcagcgtggagaattccaaccagccaaggggcccaggcaggcctccgaggaaggacgcttgacctgagacttcccccttatcatggtcaaagtgagggtgtccctgctggagcccctgcaaaggcccgagggagccgggaccttagagtctggggactgcatacagcccactttgaggaagccttcttggtttgaggagggggttgaagggcagcatcatggaccctgggttgagaaggaggtggagaccagcggggtgaggggctccaccttgactcaactccctagatggcaactgatgggggctggtctagagggctctctcctaggtgaggggctagacctgaagctcttgtgcttcctcagccctagtccccttcatggggacaggaatggtgtgtgatggtgcattcatagatgtgcatgcacacatacaggcatgtacatttgtacacagacatgcacacagaaatgtgcatgcataggcccacacagcagacaggcacatgcacacaggtgtgtacacagagatgcacacacacgtacacacagatgtgtacgcagagaggcacgcacattcacacacagatgtgtacacagagaggcacacgcacatacacacacagatgtgtacacagagaggcacgcgcacatgcacacacgtgtacacagagaggcacgcgcacatgcacacagatgtgtacacagagaggcacgcgcacacgtacacacagatgtgtacacagatgcacgcacacacgtacacacagatgtgtacacagaggcacgcacacgcacacacagatgtgtacacagagaggtacgcacacgtacacacagatgtgtacacagagaggcacgcacacatgcacacacagatgtgtacacagagaggcacgcacacacacacacagatgtgtacacagaggcacgcacacacgcacacagatgtgtacacagaggcacgtgcacatgcacacacatgtacacagagaggcacgcgcacatgcacacagatgtgtacacagagatgcacacatgcacacagaaatgggcatgcacatgcacacagatgtacacacatggatgttcacacacacacacatgcacgcaaacacagcccctctgcagctctgctgtctgcctcaggtgggggccatgctgggtgaaactgtcatttctccctgtctataagctcctgccttgaggctatgaagacaagaggatgtgaactgctctctggaggcagaagacgtgggttcaaatcttggctcttctctgggcctcaggtttctggtctgtagactaggatattggagttttactcacgttactggagggatgagggccctaaatcaggagctgggaactggtgcatggtaagttgtgggagtggaggactgtggagaaggacaggccttccctaggtgaggtgctactactgtggaaagtggtctagtttcccctctgcccctatgggcacccagtggaagaagctggtggtcagtgatgggcggactagtcctgaggtcctaagactggagtgtctggatgatcagtgtgacctctcagagaagaggtgcacacctaggggtctggctaagggaaggggagggtgtcagtacaggaactgcagggactaggtcaggctgggtacacagaggcaaggacagggtcgtgaggctggtgcttgatgagaaaagctcagtctagacatctgggcctaggccccaagaagagtggggatcaggccttcatgggtggtgttggagagccctgaacaggatgtgacttggtcttccctgtggagaactcaggagactagctggaccattcaggtatttaaggagcaatgtcagtgtgccaggaactctcggggagcttatatcccagtggaagagacggctcacctctttgagctttctggcaaagtcaagggtgctgagtgctgtgtcagggccatccaaaggtcctgagatgagtgggacttggaggaggtcagtcaggaccagcctcgttgtgggtgttgaaacacaggagtatctgtgtggaggaggcctggggggctcctggcagggagcggggcgcagaggagcacgaggtcctcaaggttctcagtggtggcatcaggagtgcccaggtcaacttgtcctgggcagaggatgggttcagaagagaacatcggctgtgtatcctttgtatcttccagaggtacacagccctccccagccgccctccaacctcaggacaaagtgtgggtgtgcgtttggctcctgcgttcccctgtctcctttgtccacaggatgctcttggctgccaggaggttcccactcctcatctttccaggcccgggtcagaggcactgaagtcagaaacagaggtggcaattccaacctaaaagcacaaattacagacaagtctccctcctgcaggtttccatttgcatctggcttttgtgtggcactagaagagatcagctttttgcaagcatggggctgatgaacgcatttgcacaaagggagacggcggagtagcaggagtttgcaagctgcttcattaacttggagccagtggaatgtctgggatcgtctgtgatttggaaaccggtggcagaatgttcccgcgtttctggtcctcatcagtcaggtaggttgaggggagcccaagacgagcttgtggctgcagcgagggtgcaggatgggtacacatctcggtggtccagctgggtctcagctaccttgaatctgacccacgggctttgtgtggtctcagggcttgtgtgtgtgtgtttggtccgctgtgtacctggtgtgcacacattgcctgtcacgtgggtctctgttggaagctcttgcccgtcggttcttcatgtggtgctgtcggacatctactggtctttgagcctccaagtctgtgttggctgctgcaggtcggggcctgggactttgtgtaccagtgacgtggccccactgaggccccgttcctgactcagccatgctgtcatggccctcagaaaagatctatcatttctttgatcctgtaaaacaagtaaattcagtcttcctgtgaggcacggtgatgattcactggaatcatcccagtgtgtaagggtacttcctcctgccgggactgccaggcgggacggcttcctgcagactcagagggtccaaggcagggtttccaagcagactttgcagctggatgagaggaggggtcagcgcacctgcttcatacagagactgatgtgcctgggcccaggcaggcccgtgctccaagcaccctgttcctcaggtgggacagcctcatcttctttttcctttttttttttttgagatcgaatttcactctgttgcccaggcttgaatgcagtggtgtgatctcggctcactgcagcctctgcctcccgggttcaagcaattctcctgcctcagcctcccgagtagctgggactacagatgcacaatgccatgtcctagtttttatattattagtagatacagggtttcaccatgtttgccaggatggtcttgaactcctgaccttgtgatccgcccgccttggcctcccaaagtgctgcgattacaggcgtgagccaccatacccagcctgacagccccttctttagagccggtgcctcgggctcccaggctcggggtggggctcacacccctcctctcatgatcttgcttatcccttggggtgggggggggacctgtgtcctcccaaccccaagcacacagctgtcaccccaggtcacctcctctgcctttctcccagcaccctgcatgctctggcctgggcagccccctccccctgtgcccttggtggcatttgcatacaggtgcccttgcagctgaagtgttggggcagggccagcaaacccacgcccgagagggccagtggctcttggcacaggtggtgggacaatggccactcagaacacggctgcgctcccctgccgcctccttggggctcacaccttgctcggtttagtcgctgtctgagccttagttcctggtcataactgggctgtgcggggcttggggcctcatatgaggaggaactgatggcctgtgtgtgctggcagaggaggcggtgtcatcccggcgggtctctgcagatccactgcacaaacactgcatgtgtgtatgtgcagtgtgtgtgtttatgtagtgtgtttgtgtgtctgtatatatgcgtgtgatgtgtatatggtgtgtatgtgtgtttgtgttgtgtgtatgtgtgtggtgtgtttgaggtgtgcgtgtatttgtgtgtctgtgtgtgtgtggtatgtatatggtgtgtatgtctgtgtgtggtgtgtgtgtgtgtctgtgggtctgtggggtctgtttgatgtatgtggtgtgtgtatgtgtgtgtctgtgtgtgtgtgtggtgtgtatattgtgtgtatgtctgtgtgtggtgtgtgtgtctgtgggtctgtggggtctgaggtatgtggtgtgtgtgtgtttgtgtgtgtctgtgtgtgtgtgtggtgtctatatggtgtgtatgtctgtgtgtgtgcctgcatgtgtggggtgtgtgtgtggggtctgttgtgtgtatgtggtatgtgtgtatgtgtgtgtggtgtgtatatggtgtgtatgtctgtatgtctgtgtgtctgtgcatttgtggggtgtgtgtagggtctgttgtgtgtggtggatggaagggcctcccggggctcttggatttggagggcccacgctgctctggcctgggaaggtggggttatctggagggtatattaggctggggtcctggggaaggttctggggctctaggcagagctcctggtcgggtgcaggcacatgggcttgttgggcagtcccaggccttccaggctccatggcccgtgttccctgttgttctggtgggtgtgccctttaggcacctgcccagggtcccctgtgccatcccagctgccccaacactgtgtgccccggctctgctcctggaccccacgccgcgtgccccggctctgctcctggaccccacgccgtgtgccctggctctgctcctggaccccacgccgcgtgccccggctctgctcctggacctccgcatgcctcctgctcactccagggcagaaacctcctgtcctggctctgcctccctttgaagcctagcaggggacccctctggccctgggtctgtccctcctgagctctcatttgaggaaggcaccagtgaggcccttctttggctcagatccagcctttggtgccagacggtccagggcgtcagtcccagctttgtctgggagctgcgggccctcgacccttctgagcccacctacaagttgggaacaacattgtggaccctcaggggactaaaggatgaagctgccctgtgcccggcaccaataggagcatcctcgttcctcctcctcaggggctggacccatagcttgagtggcagtggggacatccaacctggcttcctcagtggggtttggccatggaggtgctcagggtgtgcttgttggaatgatgggggatctcgctctgggatctgtctcctagaccctgtccagggctccagctgccccttccctctctgggctcccagctgggatgggagggccttgggcacaggctgtagagcccctgtggtcggctcccacccctccccagagtgctgcatgtgaggatggggactgcctcactcaggaagccatcctgtcatcccagagtgtggtgttggcctcgaactggctcttgatctcccatgtggggcatggctggaaccatcccagggtcagtgtgtctcaggctccagcttgggcatcttgggacagagactggaggggtgtttctcccaacatggccaggccagcgtggctgtcatccttggacatcagtcagcagctggccagtgcctaccggttccaccaagctccattcttgggaatgcagggcccggacattcagtccagagactttccctcccggggctctgctgggggtgcccctccccatgagcccatcttgacatttgtgagccctgctctgtctgctaatgagcgatcttcaccagtccagcctgccatggcaaccgcccgcagcctcgctctctgtccaggcacccggtagctttatctccgaggccatctgttctgggagcacaattccaaagccatttaaacagagcctggagcagggcaaggcgctgggccctctgtcctcacacgtgtctgtgcacacactcaggcacacacacgcacatgcacatgctgatgtggtgtgacccctgcagggtggaaggtgatgacagggacagtcagggtgccccaccggctgctcccttttcctgctgtcaccgagccggttcctgggcaccctggtggtcggccagtctgtgtcctcctctctttctctgtgttcctcacctctctgtccatctgtgtgtctgagccggcctggtttctgcctcacctctctgcctgtgggccacctctccctctccatcctttgtctcctttcctgcccctgtctgtgtccgtctctgtgtttaatcgccttgaccctggtccctggaccccctccctggccattgcctctgtttctttggcctttgtctccagctcgtatctctcctactggttcagctgctttttgcctttggctatcgttctgtgctggtaggaccaggacatcagggggtttccacccctgcctcaccctcttggatgctcctagaacagtcaggcaggggcctgtccctcactgttctcctggtccactctgggcgcacctgtctctcctccccactttcctctgcctcagggtggccaggtcatgaggcgggtgggggggcgggggtactttctcgtactgctcttagcttcctgggcccagtgcccagggtagtgccttcagcctgagcttcttactctccaagcccttcactctgagctcctccctctgagcccagtcccgctgttcattgaatgtgcttccgtttcccgccctgcggccttcactcatgctgtgccctcaccctttcctggtcaggcctccctgtcaggagcttctgtctctctctccacagggctggacagatgcagcatcctgggctcagcatggagcctcctggcttccccaaaccacgcatggctgagcttgcagccttgttcagctgaccctgccctgcaggcccctctgagctccacagagcgttgacaccagtctgacttccagggggatgggaaggaagcccctctgcagctgcttccagttcttcctgaggcctggcctaggctgcccctgctgcagggagctgtctcctctggtgccacagcagtcacggtgactttgccttctcctgccggtgcccccagccctcagctgtctctcctctgtctttcctctgtccccacatcctttgtctcctgggctgggctgttgctgaggctgctgtgagatgcacagatccccaggacccttgggctggccccctcagaggcttgagggcctggtgacctgggtcctctgagcagcttctgtcctccaggtcactctgctgtttcagcatccccacagcccagccaaccccctaggatgccgccttccaaggtcatggccctgggtcagggcagagcaggcagaggagccgtatgggcagaccagaggggcttcataggtgcccctgtattgggtgccctactaaagcagaaaccagtgccagcctagacagcgatgaccagcagcctgtgacctctggagcccgggatgtgtccggacatatcacgtcagcccaggtggcgctgagtgctgggaacccagctatggtgggtgatgtccagacggcttcccttgggtcagctgcagcccggcttcctgttgagggcagggaggtacagtggctacacgcagccctgagggaggctgaggtattgccaccttcaatagccagagctgcatcccacacacggggctggactctcccggctgtggggtgaggctgggccgcatggcctatggcaaatgcccctcaaaccctaatgcatccacggtcaacctggtgagttctgactcagcctggccaggttcccctggagctggccccctgagcacgtgttgagttggggtgggggagctggagggcctttctcgagcagaacttcagagaggagcgctggccctgtctttcctgattctgaacgtgtccaagtcgtttcatcacgtgatggattaccaggctggttggttctaccgaaaggcagcagcacaagcttttcctggatttctcaccattgttcctttaaataatcagtcttaattaactccatccgaagaacatattttccccaagggtagggagtcccagtcaggtggagcaagttggaactgcaaactgcatttgatagctgtggtgttgggaggagccccctggctactgcgaggggtgtctccgtgatgggcgggcagatggatcagcaccaacccctgctggcactttctgacatttctgttgccctcatttgatagatcgggaaactgagtcacagaaaggtttggcaatctgccccaggtcacttcccctaagcacagacgtccttgtggacgaggagaagaggcagaactcacaggggaaaacccttcttccacacagcatctgctgtggccagctgcccccacctgcccctgtccccacctgtccctgtccccaacctgccccacctgtccccgtccccacctgctcctgtccccacctttcccatctgcccctgtccccatcctgtccccacctgccccacctgccccacccatccctgtgcccaacctgccccacctgcccctgtccccacctgttcctgtccctacctgccccacttgtccctgtcctcacctgccccacctacccctgcccccacctgcccctgtccctgcctatccttgtcctgcccacctgttcatgtcctcacctgttcctgtcccccacctgcccctgtcctcacctgccccacctgctccatcccacctgtccctgtccccacctgtctttgtctccacctgccccatccccacctgccccacctgcccctgtcctcacctgtcccacctgcccctgtccccacctgcccaacctgtctgtgtcccccacctgcccctctggtccctgccaccacctgccccacctacccctttcccctacctgccccacatgccccacctgtgtcccccacctgctccacctgccccacttgtctgtgtcccccacctgccccacttgtctgtgtcccccacctgctccactggcccctgccaccacctgccccacctacccctttccccgacctgccccacctgtccctgtccccacctgccccacctgcccctgtcctcacctgcccaacctgtctgtgtcccccacctgccccactggtccctgccaccacctgccccacctgaccccgcccctcttctaccttcctgaccccatcccctcccctccccctacttgctccacctgtctcaccactgccatatgcccctcctggccccacctgtcctacctgtctcccctgcctccaacctgcccctcttttgccccccacatgtcccccctcccccctcctacctccacctgccccacctgtctccccacccctacctgcccctcttggcctcccacttgtcccccctgcacccacctgcttcctcctgcttctcctgcacgctcaccagcctctgagcaccttcacccctcgatgttctctcctctaaacaagatgactcaccatttatttccagcctaatctctgcccccagcctcagcctccatactgtcacccttgttgacggtgtcacctggtgactaacaggcgctcagacatcccagcagagccagcaactcccacaaatctgccctccttcagcgtctccctctcagggggtgctgccgcccacctcatggctctggccagccctggagtctcctgtggcctctctgtccctaccacatccagaccctcagcaacccgattcattcctgagggggtgtcccaactcgaatgcaattcgtcacttctcttgggacaccctttaccgtctattgccgcccagtagcactcaccatagacctcactgaagatgtaaatgttaaacattttgctcttggtcacccagctgggaggggccggtcaggggtcagtccagatctgcctcctccaaaggtttgaaccctccatactccgggcctccccctcagtgctgccctggatgggagagactagcctggacttggccacgtgttggtagaggtaagccagcatcacctgggcctccacctgtcccctgcagggacagacacctgcagaacctgaggaccaggaggtgaccctgagctgcctggggtgatgggagcttccctcggcatcaggggaagctggcccagaggacagccgggctccatggtgaggccaagttcatcgtttcaaagggcccctgtgggcagtgaaaggtcgtgggcccagttcgagggactaggaatcattctggaagaggcctctgcagtgcccaccttcactcccatccacacaccctgcccctccctggccctggcgcggctgtagctgctggaaggtccaggtccttctgggcagccctctctccctgccctttccttcctgcacaccccaccctctgcctgcagggcctgaggttgtcgagggattcttgacttctacagtttgcctccccctggcacctcccaccataccttgtgcctgggatctggtggtggggagtcaaccacaccagctgagggccctcaggggccttgtctcaacaggcagtgattgggttgtagggagcgagacctgaccccactcatgcatcctggctggttccccaccaggtttcaggctggacctagtgtggcagttccgagagaggaagcgggggaagggatgcatcttcaggaagggccccctcccctcactcactgtgagtccattactgtgtgggaagggctgtgtctctgcctcccctcactccccttccctggccctgcggggtgggggagagattgtctggggcctgagcccattgtgtggagaagagagcctcattggcaggcagccggggcatcaatttgtgattatctgctccctggtcttgattggctggatgcagtggggtctccccagggccctgggacacaagtttgtgcagcaactttttccagcatgaagtgacgtgtgttcccagagagaaggtgcaccccctggccaggatgacgctctgcgggaccttcctgggtgcgtaccacccccagcccctcgcgtccctccctggtctgttcacaagtttctgcgaagatgccaaagggactaattagctgtgtgtgtccccccctcagagctcagtgctcttttctgggcagccaaggaggtgacagacatgctccctcctgaacaatggccagggcccctggggaaacagccacctccccttctagcggatcccgtggcttgcagaagtgctgacggcacagagccctgtgaacgctgccctgcagaaggttggaggtgggagggcggtgggcagggtgtgtgcagaggccagctgggccttctttctgttgatttacctgcctggatctgcctggcaggccatatagctggtgggtgtcaggagcccttggcctggagcaaggctctgtgagactctgtgagaaggtggcagagagaatgtgtgtgcgcgcgcgcgtgcgcgcgacagatgtcccctgggacttaactgtagctaaggggctttggccagggccgctgctgcttgcgtcctcatcacactcaaagttgctgtgtgtgtgagtgcacgtgtgtgagtgtgcatatgtatgtgagggtctcacaaactggatgccaaatgtttgtgagcgtctgcgtgagtgtgagacagaaacacaaagtcagccccgagtgtggcggagagtggatcccggttttgtttgctccatctgccagggccggcctggggcagcacccccgccctcagctgttctatacaatattaatgctcaccatctcggcctcacacaacggccctaattgtcgtctgcagcattaaggcaggcgcccatctgcggggaagctttcagaaggaaacaagaaaaccctcacccccagctggtcaccggagaaggtggtgccaattacagatgcagaaagtttagaccaaaattacttgaaagagtttttatgaagcaaatgaactgacacttggaatgtctgtgtgcagatttgcacaagtaattacactttatttgaaatgatcttaccagctaagcgatcattaagcctgctcccccactcacacaaagcgctttctcagcgagtgcggctgcggcgtaagtttggttttgcaaatctcccgtttccctccccgtgtggagtctgaggacccgccagtcagacaggagttatttcctggtggatctttccaaacatattattaaaaagtcacatgtgactttcccacagacttttatgaaataaaacccaaaggaacagcgtgcaacatgctcagttatggaagagaaaatattttatgatttcaaaaagtcctgacaaattttcaccctctctaagaaaggaagcttaagactataccttgctgttgtcacttacaagcagggatctgttggggtttggaattctctgtctcagcccggagcccagagttcagcgatagctgaatactggtgcgagctcagaagcttccgtgtgcggagaacaaagactgaggcgctctggggggagagcgctgtccgaagtgctgatcagacttcggatccacccaccgctcaggccgcctcccaggggctgaagggcggcagccgaaccggagagacgtgccggcggccgctcttctgtcctgctcttttccctggactcctttgtcttgacggggtcagctaaagacttcgaacctttactcatcaaagctcatcttcggaaactgctcatagcactttaacctcccggtgggagctcccagggcgccctaggtcctgccagcaggcaccgatttcaagtttccaggcacattctgaatgctcctcctggcagcgccacagagggtctgggggcccattcccgacccccggagcgccacacctcaggaggcctgtgattgttcaaaaggggaagtgagaaatgccgaaagacttacgttttcacaaatacaatttctattacctgaaaaaactgttgtgccccacgaagcccgtgttgcgcaggttcatctctcctgctgccacctccgcttcgctgtggtttcttaggtgtgactgttgcatatctgaattaagtcgctttcatgaaaccttgggtgtcgttgggaaataaggctgattcagcaacggccctccctttgattctgtattcatcatggaacaatggcccgcaagcctgcccggagcctgcagcctgccgataagagtttaatagaatttctgaatgccgaaggtttggggtgtaagacatcctagcactcacagcatgtccagaggagacagaaacggcttttcaggagtgctctcagctgaatgtgtccttttatactaatggatataagtttatgacagaaattaaaaatggtaggcagtcattgtggaaacctcgaactgttctcatttgactaattaatatttcatcctcagtttgaccagtgcaggcttgcatttatgtccttgtgctcaatctgaacaattgctctgtgtgcattttgtgttttatttgttgaggataatgtgtgcgtataagaatctaagatacttgcctttggggtgaagcttttggtttgtatgtaacgtgtaaagcacaaactgtatgttaaaaataagccactaagattttcaaaacatgctctcttagagaaagctgtgttcagttctgcctcagtcacacttttggtggcccgagccctttagcgctaattaagttggggtattgtgctcttgcataatttaccaagaaatgatgtttactgtctgttgaaatctctgcactgaacttctgagatgtgagttttctgcttctccagctgcccttggacggcggcatctttgcaggcgtctcacattgagttttcacccttgtgtttcacagtttcatttctaacatcctgattatgataatggacaatcgtttgcctgatttatcagtacaagaaggagatttgggccgcaaacaagaatactctggctcttgagttctcttactgaagaaattcccactttatccctgaatgtgggggaaaatatcacaaactggcagatgagaaggcagacagtcaggctgcatagagagtgggtgagcacttctattgtgtgtgttatggatttttctcttcttgattttcactggatagctcctttcaggccgtttataaaagaatcaggaaaagagcagaaaacttgggcagtgtgcttcgctctggttgcaataaacttagtctttttgtgggggggttcccatgcccaggaatccctgagttctctttgggaaggtttttattattgtaaaaattaaagtgaaaagggaaagtgtgagaacagaaaaatgtcttttcctgatctattctttgtgtgcatgactctattttttggtctgtggctatagttaccttttatgccgttaaaaaatacatatccatttaagtcaggggtacttgaatatgcagatgagccgatatgtaatattcctggttcatttgagtaataaattctgcagcccgctctttatgatggtagatcatattcctcaccaccaataaatattgtaaagtactttcgctgtagccatgctaacccggggcatctgtcattccggttgctgctattaggaattattggactgaaccactggcagagaaagcagaggggggtgaatgtggtggttgtgatgctctctgcccttttgtgtgttttgctttttaaaaaaactcaatcatgctgcacattgagtatgaatcagtgtggacaaacataggcaccttctgttggccgaggctcagagcaggacacaggactccaccggactgggacacctctcacccccaattcagcagatccatctttctgatgctatactgtaaatttatttcacctcagagagtaaacagatatattggagccccaagggttcatgggtagcgtatttacaaaggagcctcctccgccagcccgtgccaccgctgctaatgagagcagtcattaagtaaatgagacgtcgcctttagctggcttaggagttcgcacactaaggggagaagatatttaattgaaacccgcacgcaggcttccccacatgtgaccgctgtacgggaggcagctgccttccctctcctcccccagtccaccctgcaccccccatgtaaatttcatgattgctttccgtgatgtcattttgaaagaggacagacaatagctgtggggaaaggtaagtcaacgttacgttctttctgacaaaggcagatacccaacgcttggcttttcctcttggacagagacagggagagggcgcgcgggcagagttaatttctaagatgaaggctctgtttgcaggaaaagcaggtctgaggatggctttttgaaactgctctggaggacgggggctttcttctcctccctggcctgccgtgtgctgtttttctcctgtctctctgttgttcatgctcctctgagattccaggggacatgttgtgcgtctgacagaggagacattaggggaaggggagcgcatatcaaaaccagaaactttatgcgcatttctggaagaggaacaacggatatgtctgtggccgtgggacccagcagccccgtacctggggagagcactggccgcttaagcagaagacctctctgaagcagggtctcagagtctggggtgtgtcatgtgtgacccccacccaaggtactgaggagaggtgctcacgtgaacgttttgtctgcatgtcatgcatttctcaacttaaggatcaatatctagggtgcatgcgtctgtgggatagatgtgcagaagtaaatatcggccgctcctctcagccccttttttcgctacgtgtccgtgcagctgtggagtgtggttgtttatggtggtagtgtaactggatttttgtatttaaaactaaaaatcagggttagctaagaagttgaacaccctaatgccattgtctgtagttctggggccgtggactttggttctgtctattgaattcactttcttctctataaaccaggaaaataaacaagtgctggtggctttgtgttggagtggtgggttctcactgctcctcctgagtcaccaagggctttgcttgtctcagcatcacctttgaatcagtggacaccattggctggtaaagttgggtgtttaattttggaaaccaaacatttgcggtggtgcggggggttccgtggctgcaggtgggtttggtcctgggcatggactctgtcacgatgatgataatggcagcgatgattataattatccttttgggagaggtcggtggagaattttgcccttgcagtttttttttttcttttaaatcacagaaaactgaggacacctctaacgccagtggctgagtgcacaaaaggtgggagggatgtggggcagacctgggggggcccactcggtgctgaggggtatgctctgcctctgtctcctctgaggtgccagcagagcctgtcctggcctcactctggcctggggagtgggggtgctgtatcctctacagggctgactgagggaggctcccctcggcccccagcctccctgccaccccgggctcccctcccattggtccttggctgtgattatcgcctccttccatatggccctgttaattaacggtaaacaaaagagtaagagagcagggattggagtcctgtggtaccagccagggtgctgctatcagtagaggcaggaccctgccctgtctccctcggtagctgttccttgtgcagaggaggctgggtcagggcttagagggcagtttgttttcaaagagaaggaggcagtcttatggattcttctgtcccgtagagactgagactcctacagggtccccccgaccccctgggcacctggacgtttgccgaacttcccaggggtacttgctgatccaggagcttgagcaggagccacagagagttggacaaagaggcctttctgctctggaacagcctcggctctgacctccttgggccatgaatccctgaagagggcctggtagccctcttcagagacccgaggcaggggggctgcttctgtccaaagtgccactcgagggtttttgtgaccctcagccattgcccacagatctggaggtagcctcagttgttcagagctaatgctctggcccctcttggaagattctggcaaaggcagtggtcacctactcccttgaatgcccctggtgcatgagtggggaaacactctctgagatgaccccttctagccatgtgggatgcaaagttgctctggtctgggggttgcagcagcctctacttggaagctctgttagtgccggagatgtcagggagaggctggcagagggtatgcggccacgggggtgcatgctgggcagctctggcagctgaccaacggcagcctggatggtggctggagcttggcctgtccctgctgtggatgtggtgggcgctctccctggtgctgctcagagactcactcccttcctctctggcctggggtcactgaatgtgcagacaatgacatttgtggtggtgtggtgggtagaggagacccacaccactctgcactggggagacaggggtcagagcctgactaactgtcttcctggtgctgctcagtctggtgatgtctgggccgcttggaatgccagtttgcacaacccagtactgtgcagagagagcaggagaggttcctgaagactgacaaagtgccagagagaaacccggggcctccagccgctgctcggtggcagtgggcgggctggtgggggctgagctcttcctggacggactcagtgcaaaaggtgcgtctactttggaaaagactgagcaaggcttgtgtccacccagtccctctgtcggggctcagggtggggatgagaccgggaacaaccagaacactttggtcagcaccgggcctggagtagatgaggaggtagagaactgacccagctggtggaacaggggtcaggaggttagctgtggggtgggtgggggctgctggcggtcacctgatctgcgagcaggcagggtactggacggtcagccagactttcatgttactcaggcatcttgaagagtggatgctctgcctgtcccaatgctggaagacacatctcagagcccctcttttgttgcctgttctcttgtaggaacctgggcgggagagtggagcagggtgcccgcaggggctgggggggctcttctctttcttcctctctcccatcttcctcatcttagatcctccccctctgcattttccgtgtgaactccctcatgaataaaccagaagttagttgtctacagatgtaattttaacaggaatgttgtggtgtgagtttacaggaaaatggtctttgggaaccagcatcattagattagtcagaccgagaaacgccgtgtttcccagaagggaagagagcagtggctgccgtgctgctcccccgtgggcttcctgctctttggggactgcgggacccatccccgctccaggacagccccactggggagcccactgcccagcccggagtgtctgctggaggcctggggggtggaatgtgctttcacggcctcttgaggttcccggcatttttctgtctttcagaccaaatttccccaaacatcactttaaaaaactcaaaacaaaaatgagcaagaggaatttcaccggaattaaaatgtttttgatctcaggcttccacggagccagcttcagagagaagagattaatggatacttgcaagtggaaagtgtagtttgaaaatgtcttcctgtttctcttcagtgttactggaactaaccagatacaagtgtggagtcttttctccccagggttaatgccattaggagcgttccttgtgggaagattggtttcacccatcacttcatccttttttttattttacaatttgcacttaaaaatgcaatgttattttaatcgggaacgaaagtaactcagcgtgctttaatctgccctggctgagtacatctgccttggccaggattggagtccaggccttgcagaggagagaggatgtcgacacagctgtgggtgtctgtggtcctcctgccaccccttgtcctgcagcaccggaagcctccactcagcagccccaaccttcaagagagtgactttgtgctctggcaactgagtgtgtggtttgccctggggttgcttggagttgattggatatgttccctgtgccttggggtttatttgggactgtggcctgggagcacggcctgtgccaggagggtgcaggttggatggtcctcaggaagtaggctgcagcgctctgcaggagtcagggtggccaggcaaggtgggggtgagcactggggatctggatgctcgggaggaaaggtggaggcaccatatggcctgagctgctgacagatgagcctgctggccccacctctctctcacgcctggcttcacacctccatcgtgttcaacactggtctgagggctggggcagaagccatctgggtcctcttctttttttccattttgctgcctgcaatccacacatcagaggaggagcgtgagaagagggggccctgggtcaaggcggttggagcctctcacctggtcctgggggaccctccatgtctccctcagggacccacagagctgccagtggctgacctgtcctgcctgagtgggaggagagtgggagtttggatgctccatggtgcaccaaggcctgctttagaaggccctagaaggtccctgagactctcggaccgcaaactgacagcagcaggtgcctggggtggcctcccagtgagccagagccacagacccgaggcgcgtccccaatcccggtgtgcgcctcgctgagctagcttgtcaaagcgcttgggtctttacacctacagggtttttgggttctgaaaatcaaatggctttagcagtcctgctctgtgggcagccaaagtggctcctaactgaaggtgctgcccattctttacaagacttagagctgggggacaagttccctcttggctctgagtttcccaggataactgccgtcccagggagcccggggatggttcagagcagcctcccagttactgctgactgaatacttggttgtcagtcgctcgtcagcatgtgggattgtgctcaccctgcccttaccaaagttttgtttagggaaaaacagagatttgaaattgggacgacttactatggttaacattattttcattgagactgggccttaatcttcgaatggaacaaaaaatctgacttaggtcgtaaggggcagagaaacacgtttgacgctgttattttaatcgttgagaccgtgctaacttgttcagttctcatgaacgtgttctgtactggacactgaggctgggaggcaaattagcttcccaggtgagtggtgtagctcgaatctaagatctttccagcacagcctccctcacagtcccacccagccccacccagccttcctgccgagtgccccaggctgccatggaggctgcccgcaggccacagtatgaccctcactgccctcgtgtctcttcctcacagcctgggacatatctagagcctgtccccagcataccctccaaccttattctccgtcccaaactgggttgttacccacgattcccaaacatgcctccctatctcccttcatctcctgcagctgaatttttgcttctctttcaaggcttcttacagatgccaccccgggccctcctttacttacctttactctcacgtgtctcacatttgaaatcccgctctcgggatgcaatgtctctgctgtgacattgcatcagactgatgggtatccctgcttgctttccgggagagcctgcaggcaaccagctctgggggctgctgggcctgaggaaagcatcccaagtcaaggggctgctggacccaatggggcactgcaagtctggaccagggaaggatccacattttagctttgaggttggaaggacacttgtgttgggaagaaaagctacttaaatgctcagttgagcagttctgaattattcctccactctgttccttcttgaggttgagccctgccttctggttatttgagatcaagtccgcctagataaaatgttagactattactgcacattaaagaggtacctcttacagtcatttttttttaagtggtctgattttgttttggctggcttatttagagttttgtgcttcctcattttatttccacgaaggctgtgcccaaccttagcctcggtgagccgtgacccagccatgtcaccgatgcgtcaaagtgggttggctgtgaggcattcattctctccccatgacacagatagacaaattggtcatatatatatatatatatatatatatatatatatatagagagagagagagagagagagagagagagagagagagagagagagagagacggagtcttgctctgttggcctggctggagtgcagtggcgccttcttggctgcaacctccgcctccgggttcaagcaattccgtctgcctcagtctcccaagtagctgggactgcagatgcgtgccaccaagtctggctaatttttgtattttttttttttttaacagagatggggttttgccatgttggcgaggctggtcttgaactcctgacctcaggtgatctgcctgcctccgcctcccaaagtgctggtattacaggtgtgagccactgtgcccggccaaatttacccaatttttaagagttatgacgtgctgcaagcttgctgccttccctcatccagcggtaagtcctgtaaggagtctgcttcctaggtgcatcagccagatagggaaaacaaagggatttgttactgaatggcattcagggaagcaatccctagaaggctgcctggagcctgtctcggggaatccgttccaggactctgggccctgcacctcttccctgtggagtgtcacccacaccggtggcctgggctttgtctggctgcaaatcgcacatgcggcttctaagtcagaacctgctgctggatgtggagctcccttcatccccagggtctgagcctttgtccttggctgacccctatcctctggcatctggaggaacccaaaccctaacccctaacctctggcatctggaggaacccaaaccctaactccctacacctctggcatctggaggaacccaaaccctaacccctaacctctggcatctggaggaacccaaaccctaactccctacacctctggcatctggaggaacccaaaccctaacccctaacctctggcatctggaggaagccaaaccctaacccctaacctctggcatctggaggaacccaaaccctaaccccctacacctctggcatctggaggaacccaaaccctaaccccctacacctctggcatctggaggaacccaaacccacttcaatataagagttagagtccaattcctcttcctggagagccctctgatggccttgggaccctggacctggtgagctctccccctgccagcccctcctactggccacccacttcctgcccagtcacccagaggccaggccacctctggtgtgggtaaagcgtttgtgttttccccaaatgtgttctgtgttggctctcgtgtactgaccactgtccatccaggctgggaaattaccatacacatccccccgccccccacaatttttctaagcctgtagagcagcagagggggctgctctgagccctggagctagggctgcagttggacccatcagagagcagctgcctgggcttaccctacccaagcagggatttgggcaggggtcctgcagttggagagcctgggattggagaaggaaaacagaactgttgtgaaagccaaaatccccaagggctttgaggcctggggatcttccctcgagctctctcccttctgaactggggatgagccagcgtgtgggctcatcctgaccctaaagggaatgtgagatgcccctcctagtggaattttgtcttcaaggcctcagtaaaatgtggttttaaggcagaaggagatggccatttcctttctttttgggctggaaagctgaacggttctaagaaaaatttctgggaccaaggaacgaaaatgctggagcagaattccagagcaggacctcttgatcccgcgaagccgacgtgtcttctggggagttcccaaagatccatggggaagacgcccccaaacccagtgctgctggctctggccataccctctttttttttttttttttttttttgaagatggagtctcactctgttgcccaggctggagtgcagtggcgtgatcttggctcactgcaacctccgcctactgggttcagcaattctcctgcctcggcctcctgcatgtgccaccacacctggctaatttttgtatctttagtagagacagggtttcaccatgttggtcaggctggtctttaactcctgccctcaagtgatccacccacctcggcctcccaaagtgttaggattacaggcttgagccaccattcctggcctcataccctcttaattcttatcttgcatctggaatacctgttggaccaggcctgtttccatcacagccccttcttattgcctttgtgttctctgtgttctaccccttcccataccccaggattcaggcaggcgagtccagttgtgcctgattggaaaaagtgtctctgatggtggcccagtgaggcaaggcccatgggtcagcctggccaatttccctcccctcctgagcaccgtgggagggtcaggcctcaagcagccctcggaggcagcagtcacagacagaggtgggctgttggacaggtgcggctgatagagtgggtgtcttttgtgggcttctccccagcctgtggcctggcctagtcagtagagatggtcaggggagcaggagggagcccataccccagtgcctgtagttgtgtccatttcccctccctgacttctcctcctgcagcatccttccctttagttgtgtccatttcccctccctgacttctcctcctgcagcatccttccctttagttgtgtccatttcccctccctgacttctcctcctgcagcatctttcctagttgtgtccatttcccctccctgacttctcctcctgcagcatctttccttgtagttgtgtccatttcccctccctggcttctcctcctgcagcatctttccttgtagttgtgtccatttcccctccctgacttctcctcctgcagcatccttccctgtagttgtgtccatttcccctccctggcttctcctgcagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccattccccctccctggcttctcctgtagcatctttcctagttgtgtccatttcccctccctggcttctcctgcagcatctttccctgtagttgtgtccatttcccctccctggcttctcctgtagcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccattccccctccctgacttctcctcctgcagcatctttccctgtagttgtgtccatttcccctccctggcgtctcctcctgcagcatctttccctgtagttgtgtccatttcccctccctggcttctcctgtagcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccatttcccctccctggcttctcctgcagcatctttccctgtagttgtgtccatttcccctccctggcttctcctgtagcatctttccctgtagttgtgtccattccccctccctggcgtctcctcctgcagcatctttccctgtagttgtgtccattccccctccctggcttctcctgcagcatctttccctgtagttgtgtccatttcccctccctggcttctcctgcagcatctttccctgtagttgtgtccatttcccctccctggcttctcctgtagcatctttcctagttgtgtccatttcccctccctggcttctcctgcagcatctttccctgtagttgtgtccatttcccctccctggcttctcctgtagcatctttccctgtagttgtgtccattccccctccctgacttctcctcctgcagcatctttccctgtagttgtgtccatttcccctccctggcgtctcctcctgcagcatctttccctgtagttgtgtccatttcccctccctggcttctcctgtagcatctttcctagttgtgtccatttcccctccctggcttctcctcctgcagcatctttccctgtagttgtgtccattccccctccctggcttctcctgtagcatctttcctagttgtgtccatttcccctccctggcttctcctgtagcatctttcctagttgtgtccatttcccctccctggcttctcctgcagcatctttccctgtagttgtgtccatttcccctccctggcttctcctgcagcatctttccctgtagttgtgtccatttcccctccctggcttctcctgtagcatctttccctgtagttgtgtccatttcccctccctggcttctcctgcagcatctttcctagttgtgtccatttcccctccctggcttctcctgcagcatctttccctgtagttgtgtccatttcccctccctggcttctcctgtagcatctttccctgtagttgtgtccattccccctccctggcgtctcctcctgcagcatctttccctgtagttgtgtccatttcccctccctggcttctcctgcagcatctttccctgtagttgtgtccatttcccctccctggcttctcctgtagcatctttccctgtagttgtgtccattccccctccctggcgtctcctcctgcagcatctttccctgtagttgtgtccatttcccctccctggcttctcctcctgcagcatctttccctgtagttgtgtccattccccctccctggcttctcctcctgcagcatctttccctgtagttgtgtccatttcccctccctggcttctcctgcagcatctttccctgtagttgtgtccatttcccctccctggcttctcctgcagcatctttccctgtagttgtgtccatttcccctccctggcttctcctcttctagcatctttcctgctccctggtagcctcttgggagccacctatttctggaggtccccactctgggttccttgtcctgggtgtggggcgaatgtgctggactggggtcacagcattgaaccccacttggagctgaggatgttctcgccccagaaggaaaagctgtgtgtgtctgcgtggagcagtgtggagtggtttccttggtgccgcctgggttccgggcacccggcctgggtgtgaggcctggtcacatggctgaactgctctcccaggcaccccgggagggatgaatgtgacactattggtgtccctcccagcacactgcctgccctgggctgggcacactcctcccctgttggcagccggggatgacaggccgcctggagagcccgtcctgtgatttggtttggaaagtcattattactgcagagcagtttagctgttgtttttacagcgttggtaaggttaaaagaaataatgataataatataagaaagactcagccacagtaactgcctgcaacatgctatttgcatttttaaggaaacacttctttgagacagcctgggtgaaaggtcactatttgcatataaatggaaaagaaagtgtatgatgctggaagttacatctgtattattttctcagcagtgagctgctgttggagagattagaggacatggcttgcatttggcttttattgaatagagaaagtaccagcgaggctgatttagaagcaaaataatgagagaaatgtgcaaagctatagaattgccaactccctgcccccacctctcccttctctcattttcacctaaactcagcaaaagctggtctgcctttgcgccactcagcaagtcttcattttacttctctctggattccagagaggaaaaaaaaaaaggaaagaaaaagagcaaaacttgccctcattttcccctcggtcccatttgtgtttcctgccagtgtttcctccagatgccccaaaccccggagcagaagcccctgtgactgtggccccccagggtgtggagaggaagaggccctcggggcggggacaagagggcacccctctccagggtggggacaagagggcacccctctccaggggtggggacatgagggcacccctctccgggggcggggacaagagggcacccctctccagggcagggacaagagggtacccctctccggagctagtgggcctgttttggacccgctgctgggaaaggctgggggcaggggcaaatgtggggggtcctgtgtgggctgagggagtcctgttccaccttcccctcagccccatgggacccgcagtttctagggcatgggttccaccttcttcatggaaatttccaagcttgtcagactttctcaggtgcctggtcccctgggctttccaggatgcccccaggaacaaagccagccatccctgagagaaaccctgggtggggctggggccggcacctgcccagccagctttggaagcagacttggctgagcacatcatggacttcagggtcttccaggagcagtcctgggacagagggaggtggagcgtcctgcccggaggaggcacctcaggatcctccttggtcccagcttctctcttcacagaggcctccactgaccactggttacttaaatcacagtcccccatcctcattattttcaaaaatacattttgaaacaatctcaaagccacagaaacgtttcaagtaaagggccaagctgtttctcctgagcgtttgagagcgtgttgctgatgcgatgccatcaccaaggacacttgcatgggtgtttccagcagagaggccgctctcccactgctccaccctcaccttctcggccatctggtcctcagacccattcaggggtgggttcagaaccacgtgctgtgcgtggtcctggtgtctcgttcgtctgaagtcgtttttagcactcctcgcctttcgtgaccttgtgcttttggaagagcgctgagccgttattcagtgggatacccttcaacgtgggagcactgagccgttattcggtgggatacccttcaacgtgggagcactgagccgttattcggtgggatacccttcaacgtggcagcactgagccgttattcggtgagatacccttcaacgtgggagcactgagccgttattcggtgggatgcccttcaacgtgggagcactgagccgttattcggtgggatacccttcaacgtgggagcactgagccgttattcggtgagatacccttcaacgtgggagcactgagccgttattcggtgggatgcccttcaacgtgggagcactgagccgttatttggtgggatgcccttcaacgtgggagcactgagccgttattcggtgggatacccttcaacgtgggagcactaagccgttattcagtgggatgcccttcaacgtgggagcactgagccgttattcagtgggatacccttcaacgtgggagcactgagccgttattcggtgagatacccttcaacgtgggagcactgagccgttattcggtgagatacccttcaaggtgggagcactgagccgttattcagtgggatacccttcaacgtgggagcactgagccgttatttggtgagatacccttcaaggtgggagcactgagctgttattcagtgggatacccttcaacgtgggagcactgagccgttattcggtgagatacccttcaacgtgggagcactgagccattattcggtgggatgcccttcaacgtgggagcactgagccgttattcggtgggatgcccttcaacgtgggtttgtccagtgttgcccgtgatgcaggaacacctgagtgggaggttctcccttcacctgatgctgatttgtcccttaactcataatgttgacttggtcactggattagatggggcatcccagcacctctatgccagagggaaatgccagtcattttccctttgcaattaataaatatttggggggaaggtactttgaaactatggaaatatctccatcctcaacaaaccatcacttaactttgatggatatctctatagactcgttgtttcctgttttaccccatgggctgaaagccttctttggatgctcagattgtccctgattgaccagtggaagcccagtacagaggctcctgcagcctcggtccagctcccctgtcctttcttgttcttgcctttcctgcttggggcctggaactctggttccttttattagaaaatggtgttagcctgagacctgggtgttgggcctctagtggacatggctgggaagacgtatgtgtgtacacacacatactcacatgctacacacagttacacaatgctacacacacacagttacacacacatactacacacaggctacacacagttacacacacgctacacagttacatgcatgctctatacagttatacacacatgctacacacacagttacacatttgcacacagttacacactcacatgctacacacagttacacacatacgccacacacgctacacacatgctacatgcagttacatgccacacagtcacacacagttacacaccacacgcagttacacacacatgctacacacaggtacatgctacacacacgctacacacagttatacatgctacacacacgctacacacagttacatgctacacagttacatgcatgctctatacagttatacacacatgctacacacacacagttacagacacacgccacacacacaccctttttcacctaggtctgtatttacttctccatctatcgatgtttattgaaaaacacaagttcatattgataacctctgattccaattcccacacagggttcattctaaggttctgcctttccgtaggcataacgtcctcttccaacagtgagaaagctggtttccattatctttaatgtgtttacttctttgatccacctctttccccataccagcaccctccttactccacacaagtgctgaccccttgctgagcccctctctgcaggccaacctctgggtcgccacaggacagccccaccctctgttctaggccttggtggggacaccttctcccctgcaagggctctggtgctggggagcctcactggccagttgcccaggactttggggttcacagggtgtgggccaggacaatccaagtataatgggctgattggcctccctgtggctccagaactggaccttttcggacacttgtgctcacagtgaccagctagcttcctttgtagcgttgagcgttatctttctttatcttcagtgtttcgctggtggaccaaacagtttaccagtgttatgtctcatacaagattttgtggtttgtttttcttgtagacagtgatcaccacccctgccacatgcacctccctgccctcgcttcccttactcgcggttcaatgctcagtttttgaggctgtgcatatctggatttttttattcttctacttcctgtgatcagtgttttgcctgggcatagaggacatgccctgaagttgaatgtcaactcccttgaaattgggaagaggctttctctactgtctgtgaatgctgctctggagcaatgtgatcctattctagttatcggttttgtttgtgactttttcccacttcaaaagcttttagggtcttttttctattcctggtgttttaaaattttatagtgccgggcttggttggatgtgggtctctttttattcacgattatgggcacttaatgggctttttaatctaaaaatataatttcctttagttctcggaaaattttttttattatttaacttacacttttccttcccattttcttaattctctctttctggaactcccaaatcgggtgtcagtcctcactcagcgtttcctccgtctctgctatctcttcgtccttttgttcactttcctagtatatttctttgactctatctcccaagtcttctgttgaatttttcattttggttttacaatttatttccaagttggggaggatggacacaatggtattaagccttcccaaacaagtcctcctgtcactgtctgggctgggccatatctgccctgtccacatgcgtctggagagtctgtgtcctgcctcctggtttgtccttgttcctgctctaaccgctgcccacactgttagtcgagggagcctgaaggagcctcctgaaacactcatttgctcatccagtgcaggttcctcccacaggccaggaaaggtcccaggaacagccattattgagcaccctggcagttctcagactgcggtggggacctcgctttgaactttgagaggcagatgctggacctagtatttctgctgcctcctccaggagccatgtgacatggatgtgagtctgtttgcctcctagggccttaccttcctatgtctgggggtgtagcctggacctcaggggtgtccccttgggtgtcagaggctctttgggactagagggaggaatcctgggctgtggtcccccaggagtctactgtgacctgtgactggtttcgtgtgggccttaaattgtttctaaatttttattctaaccgttttcttgctgccttgccaggctctgatttaaacccaagtagcagcaagaaggggataaatgagggattgagaggagaagcaggaaaaaagttttttgttttttgttttttttcctttcgaatggcaagatgtaagtttatactcaaccctgggcccagcttttcagtttcactctgcatgaggtatgatgaaagctaagaaggcctgccctctccagggaagtggcggctggagcagccacggtgtcccagggcgtggcaggcccagccaatacgcacgcacaggcagaatggggggctgttgctgctgggttagctaccaggtgggattggccctggccatcggctcagctgcatggatagctgtggacacatcctgacatagcactggccgaggtgggaggtgagcttgggccgttctgggtcccgatgcctcctggctgtgcagaggcaggtcgccttcctttggccctgttgaatgagtacagctctaactgctctggggagtgggagggtgaagtggacccaagagctctcactctgacctccgtggcctgtctcgtgtcactcgcatgacccatcctcctgttgtatccctggacccagccctccctggcctccaggagcagggagtgataggcatcaaggtggtccagtttggggttgaggcgcagcggtccagaggctggcccaggacacaggctcacagaacccagtctggagaaccaaaggggacttgctgggacctcctgccctaggcaagagtccccagagtgtctcactgaccatccacatgccactgtttaaaaacagcgttattggaatgtaatgtgcacatcacagaattcacctattaaaaatatacaattcagtggttttagcgtacgtgtagggttgtacatctatcaccacagcccaagtttagaccgttttgatcaccccagaaagaaaccccatgcccgttcacagtcgttctccattttctcctccaccagtcctaggcaaccacgaatctactttctatctctacgaatttgcctgttctggccatttcacaaatatggaattgttcaatatgtggtcttttgtccctggcctctttcactgaacacgaagtttttgagattcacccacattgttgcatgtataagcaacttcattcctttttattgccaaagactgtgccactgtatttcgtatcacccattcagcagttgatggacatttgggtttttccactttttggctagtatgaataaagctgctatgaatagttgtgtacaagcctttatgtgacatatgtttttatttctcttgggcaaatatctagagtggaattcctgagtcatgtaactctatgttgaacattttgagtaactgccatgccattttccaagtgattgtgctattttacattcgcatcagcattctatgagggttcttgccaacacttgttactatctgtttatctttaacattacagccattttagtgcaatggtatctgagtgtggttttgatttgcatttcctggattactagctgttgggcatctcttcatgtgcttattggccattcccgtgttatctttggagaaatgtctgttcaagtcctctgctcattctaaaattgggttatttgtcttattatgagttatgagagttcttttttccaaatacaagctctttatcagatttacgatttgcaaatattttctcccagtctttgggttgtcttttcaccatattgatagtgttattcatttatttatttttgagacagagtcttgctctgtcacgcaggctagagtgcagtcgcatgatcttggctcactgcaacctccacctcccaggttcaagtgattctcctgcctcagcctcctaagtagctgggattacagacacgcaccgccatacccagctaattttgtattttcagtagagacggggcttcaccatgctggccaggctggtctcgaacccctgacctcaagtgatctgcttgcctcagtctcccaaagtgttgggattacagccgtgagccactgctcccggccgacagtgttattttaactccgaaagttttaaaccttgttgaagtccaatatattactttttttctttaatggcttgtagtgttgttgtcatagctaagaaaccattgctgaacccagagtcggaaagatttaccgcggtgttttctaggagttttggttcttacatttacatatgtgatccagtgcgagctaatttttgagagaggtccaacttcatttttttttttgatatctagttgtcctggcacgtttgttgaaaagacagtttttttcccattaaattgtttttgtgccattgtcaaaaatcaattgatcattaatagagggggttacttctggactctcaattatgtcccacttatccatatgcccgtcctgatgctagtaacacattgccttgattactgcagctttgtagtaagtttggaaactgagaagtgtgtcgtccaactttgctctttttcagaattgttttgactagtctatattccttgaattgccatacaaatttttagaatgagtttgtcagtttttgcaaacagaacaaaacaacacagccagagaggtcagaaatggtcagattctggtgagatttagaaaataacattggcaggatttggggccaaggatgaccctcagggttctggcttgaggagctgatgactgaagaggggaagaggaaaaccccacgtcacgtaagaagcagatattgtgggcagcgaggaagcaaaaaggagaagccatctgacatggggtggccgggtggccaggaggagcctgtacaggtgaccgacaaggtcaggggcgagtgtttgccacagaagggggtgaacagacacgcaccgcagtgatgtctagtgggccctcacgtgccctgtgaacatgaagccgcctgttgttccagtagagggatgtgggtggaggccaactgtggtggggagtgaagcgtagttatgaagcaggaggagatggagagggggctgggcaggggcgtgaggtccaaagagactgtgtttttaaacatggatgcctcaagccagttgaagagttgggaagagtagttcaatattccagaagaatggagggaagagttgatattcctgggaactttcattgacagtgggaaggaggtgggtataaagtccagatggacaagctggctcagcagggaggcaagaccccatctcctgtgctggagacggaggagggctgagggggtgcatgggagaatggaggtgtgggctcctctcaagtgactacccttcccctctttgctgaggggcaggtggtaacagctcctggccccaaaggcagccctagttaccagagatgcaaaacctagtgaagactgaaaacatgtggctttccacacttaccacctggcctctcactcagtcttcctgttattttgttcttgttttcagagtggggaggttttacacagtggaagggggtcaggttgccagggctggagtggatcagagctaactgccacagggactcccatccggaggcccaggggatgcaccatgggggcaggtgggctcaggccagattccaggctaccgagccagcatgaaaacagccacggtcgcccgcagggggtcccccatggggttgtgcgtggagtggccacagtgccagtgcaaggaggaagtgtgtgctggcagtgggtcagccggcagctggggtgttagctctgggacaagggggctctccttgccatgacgacagaaggaaaccttggggtaggccagcagcacttcctgggaagagcccagcagagcactggctctcagtggaagcgtcctgtctggggcctgggtcaggctggtctccagtttgcagtgctgctgagttggaaaaagagggcttcattaggagaagacagacggggggctacagctcagcactgcacatctccctggcctgtgttggagtctctggccagtgaggggtggttccctctcctctggacctttgtgcatcaatctcagctgaggaggccctgtttgtttcctgagtttttctgcccacaagagccccataaaagtgagtgtggggccaccatggggacagatgtgggggttaccttgagcaggcaggactccaggtgcaaagatgccgggtccctagagaggggtcccagccagcgccgccctctgggtgccgggagctgatcccgagaggcttgttttccaggagacgtgctcaggatggagcggtctctgatgttccgtttcccattcgcatccacgagcagggattcagattaactcactagaaactcaataacccaagagaacaggctcgtctggatgaaaacctccacttcacttcagattcctgacaagaaaggccatggtgatgacaacagcactgacgtcctcatgggttcacttccaggctccgtccacacatgtctctccatctccaaataattcttcccctcccactttgtgggtgaaggacttaagtctcagagagggtagtgacctgctgctcaggtctgagttggtggcagtgccctgtgtgagctttggggacccttgttcccaccacagagtgtccatggagcagcatgacttctggaagggcgtctttatggaacacctccacgtttccgtggagagatttcctgtagcccgtggccccggcatccacgtttccgtggagacttttcctgtagcctgtggccccggcatccacgtttccgtggagagtttcctgtagcacgtggctccggcatccacgtttccgtggagacttttcctgtagcccgtggccccggcatccatgtttccgtggagagttttcctgtagcacgtggctccggcatccacgtttccgtggagagttttcctgtagcctgtggccccggcatccacgtttccgtggagagatttcctgtagcccgtggccccggcatccacgtttccgtggagacttttcctgtagcccgtggccccggcatccatgtttccgtggagagttttcctgtggcacgtggccccggcatccacgtttccgtggagagttttcctgtagcccatggccccggcatccacgtttccgtggagacttttcctgtagcccgtggccccggcatccacgtttccatggagacttttcctgtagcctgtggccccggcatccatgtttccgtggagagttttcctgtagcacgtggctccggcatccacgtttccgtggagagttttcctgtagcctgtggccccggcatccacgtttccgtggagagttttcctgtggcacgtggccccggcatccacgtttctgtggagagttttcctgtggcacgtggccccggcatccacgtttccgtggagacttttcctgtagcctgtggccccggcatccacgtttccgtggagagttttcctgtggcacgtggccccggcatgttgtttgggtgcatggggacttaatgtgctgctagagatgctgattgagcagagcctacagacaggagagctttgtctggggtggagcctactgagcccatggggcagggtttggccatacacaggccccagtaggggaccaagagggccacaggagaagaactggcataccttactgggcttctagtagtgatagccgtttgctgccaagacatttcctaggagagggaggctatcatgtcaaggttgagccgggtcctcaggcccttgtaaaggagggtctacgcttgggggtttgtggttacttgtgtgctctgtacccaggggtatggtgcacaggtttcaccgggtgccattctgctcttttgcccagagaagctcagcggctttgctgcctcagggaggcaggagtggctctttggaggagcagttgatccccgggatgctagtgctctgcctgagcagatgtggggcctcagggcctcaggacttcagagcccagggctgactgacctagggacaggagtgtaagggatgtgggcaacgaagaattccacagggctgtatttccagactcccatgggtgggtgtgggtggagaagccccagtgagctggttatctcccaccaaacaaaactggaggtccctttgcagagactcttgcagttcatgtccacatgacttctctgagaagcaggagagactcagcgcagaactcaggggagtcgcactcgggagaggcagcgtctcctctggagcacacagaccttatgtccttccctccagctgtcagccagacatgccccagttgtcttgcatatatacatatgtaatggtaacaaggaattctgcttgagccttgccaatcagcccagtgagcaggtttctgcagcatcttgtctcctgggatagatactcagaaagtgaaccctgtgcactttggggccttgtctctcagcttctgttgacacataagaaaagagacacacagaggaccccacgccccatcttcaaagtgtgaagcacactccccggctgatacgattcttgtcgattcacttacggaatcttccaatatgcttttcctccctataccccacatccctgtcacagagttgagaattggattacctggtgggcaggtgggccccagttagaggccgctcacaccggctcagtgcagatgaccagtggcagatgggaacccaggaggcctagagatcttgggtgatagggaagctcccgcagctccctcctcactagtccaggcaccggagcctgcggtgggagccctgtcatctcagcgacggcctgcgggtgacttacagctcaatgaggggaggcacagagtaggtgcacacagtaggtgccgaatctgagtggttttattcgttcctctgtagacctcgtattaggctgtctccttgactaccaaatctgctttcctctgtgtttatgctctggaaggtaatccgaagccctttaatgggatggaagcatttccagataagaagagggtgctgtggccagaggcacagggctgcctggggccaggagtggccagaaccctagagaagaattgcatttggggatgcacatcaaaaacacgaggaaaagaaagaaagtgggtgggaatagcgtgccttcggcagaatccaaactcacttccaaggcaaagccagggcccaacacgagaatattcatttcctgtttcattgttggttacttaatgaccttcctttgaaatgctgcagttatgtagaaagcaggttgtcatggaaacggggagtgacgtgcagggaataggtacacaatgcgtttctttgtcatgtccagctgatgcgttcagcctctgctcagacatgggaatttatgtgaggaattaaatattaactggaggcattgccctggagagaggcagaaacacagggtgacaaaagatgctggaaaccagggcaaagagcatgctggggcccccgggatcctgcgggaggcaaagctgatttgagaccatgggtggatctcactttcttcaatcaatgggctccagagaagtcgtgcaaaacaatcttctttttcaaatgcatatgtactgtgcattcttttgaggggcagaaggatctggttgtaatgcgaataattactcattagtcagctcattttcaaagttggaggggtgacatgccaagttttctcaaggtggctctcagctgccttgtcccagcactctgctggccgtggttgtcagtgggaaccaacacctagagctgggacaacagtgcaggggactgcaggaagactccagggaggccccaagtcagagagaaattgtctcttgttcctgaagcagccatggagccatgaccttgtctgtttctccggtggattccaggaaataggcattgaatatatgatgttaaaaaagtgcctcaagtttctcactttctccccttgagccagcacggctggcacccaccaagctttccttttctgaccttgaacctttttaaaccctcagaaaatgagttccgaggtgagctgttaaatcagaggtggacacacggaggcaaggccagcagctgcaggacctcaagacacctgggcagacactgcaaggtgagacgtgagagggcagcccctgtcgtagggccccaccccatggctgcctgcacaaagcctctcttcagctgcaggcatgaagcatggaggcgacttttggtctgatcctcaccagagtccgggttaggtgaagggtaaatggggactaggatcagcaatgatccggtcactttaaaattaagggaagaaaaatgactctgagtagatcaaaactaaaatgtgaccccaggctgggcccggtggctcacacctgtaatcccagcactttgggaggctgaggcaggtggatcacttgaggtcaagagttcaagaccagcctggccaacatggtgaaaccccgtctttactaaaaacacaaaaattagccgggcatggtggcatgcgcctgtaatcccagctatttgggggaggatcccagctaaggtgggaggatcacttgagcctgggaagtcaaggctgcagtgagctgagattgtgccactgcactccagcctgggtgcagatcttatctcagaagtaaagggactaggaatggtggcttttatctctaatcccagcactttgggaggctgaggcaggtggatcacttgaggtcaagagttcaagaccagcctggccaacatggtgaaaccccgtctttactaaaaacacaaaaattagccgggcatggtggcatgcgcctgtaatcccagctactggggaggctgaggcaggagaatcacttgaacctgggaggcagaggttgcagtgacccaagattgtgccactgcactccagcctgggtgacagagcaagactccatctcagaaaacaagcaagcaagcaaacaaaaaaaacccaccaaaatgaaaatgtgaccccagagtctcacttccttgctttgaggtgtgaccacgtctgggctctgtgataggcctgagcaactgttctctattcaccctgcttttacctggccaggctgagaatccctacaggatctgacagcagagattgctggcaggagcttatgaagtctgttggccttgttttatttcgatcttcctaaggggaggcagatggtgcaagcccttcttataccttcccagggtataagatctcccttcggggacactcccgaactgtgacatcacatgtgcttacagccactgttctccaccaccaaccctctaattctagaacttcccaccaatactctctggatgaggccaggtccccagggtcaggtgaccctcacagctggaagtagaggctgacaataggcttaggctgaagcccttcccagagatccgattctgacctctcttttttcttttttgcatgtagatgctctccagcaaggatccagctgtgactcagggcatggctcaaggacagtgatggcgtagggtgtaggcaaggagggctatgcagttgtagtgggaacttcatttgggggtgcttgtgttttactctcaaaacccaacctttttcttttgaatctggtggcgagaatgtacattttaatgggtctgttatagacaacttgctgagcacctccgctcatattttggctcccgcaggattatcagtgctctgctgatccatgttggagcctggggcacaaggaagagtcagtaatatggatcctgtctttatttaaggttttggtatcttgtttattaggggttttttgcatcatgttgatgtttctaaatattgaattaaaatattatttatcttgatcattgagtttttggcctcattcccctcaccctaccccagatcctgaggattcacatagcgctgtactggcatgagatcatgtgagcatgaacgttacttgacttgaggccaggggctctgcatgcagcgttatctacaaatgtctggtgccatgtcaggggtgggtcggaagacttttgtctccccctggcccagacatgacaaactcagagagtttgggacctaccatgacaacccatggctgttcaaagtgctgcttctgtgaacaaagccagggacccgtgcccaggttctcgtggcatcaccagctctttcatcactgctctgtttgagggtcatttcccttcttttcttgcagatagggccgagtgactgctctgaatagagaagctaagatgaaaagtgtgccagagaaggcgagaggatgagaaagggtcgactgcctagaggacagtggggcagcaggtgcaagtagaatctcctgactaagaggctgaggagggtggcagcagagggcataagccgtggtcacagtgtgagaatgtcacacagccacagcagcatcggggtcagccttccagaggctggcttcggacaggagatgggtggtgaggagccagcatgggagggcagtgaacacacaaaccctgtgcatgggaccgtcacagcctgcggcgtgcctctgagttcagcaccaggcatgtggacagctcaggaccggttggaaggggctgccagaagtcaggtggtcgtgtgtcggggtatgcaggagctgatggtagctcctcaacccccttcttgccaaatattcagagatatggaatcaaggaaaagatcagttgcatggccattcagccaacccttcttcctgccacccagggcaggaggtgcctctggcaaggactactggacagaggctcctgcaagggaaggagctgccactgggtatggcccttctggcctctctttatgttgttggattctaccctgggtgggtataaattccatttatgctggagtttttaacagacggttgcagatatggctgcttcatcagggtatccattatgtagctctaatttttgatttgggaatgaagtgagccagtatcccatgcttagagctgtcaagagaaccccttctcagacatgtgttaaataatgccccatggaggtgtcctttctataccccaaggaggaggctggtctattctgctgaatttgttgggagaatttcagaatttcagacatgcaacaggacatcacccaatgtgaggacagaactatctctgcaaggaaccaagggtactgtgatggctgccagtggggatcaggggtgagggcatatggtttagcctcagagatcaagagagtggaaagcaggatgtgtgctgaggtcaccgactttctatatctgttctgtgggctgagctggcaggcaggtccatgcaccaaagaaagggaaggggagggctgtggatgcagcagaagatcctcctgggatactcgggaggggagcaacacaaatgcttgaatgctgctcttagatcgttgagtgggagcttggatcttccacaatactgtctgctgtaatggcttcacagcagtgacagggaagttgatgctgccctcagtacataaatgagagaagaaaacaggccagaccatggctctgtctttctcccctcccctcactgcagagaagtgagactgaatgtggtgtgaggtactgctggagccaggcagggtaggggacagccagtttctggccacctcctcaccccccactcttcactggccccttccttctgggaagtggctgcctatggtccgctgggactcagcaggtgctcttcctcttcttctaggtctctgggaggaaaaccattatgcaagaggctcaaccgtcccaccgagacactataacctatgtaattttatggatttttaaagaatagttgtaagtccattctaattctccagatttgctggctgtcagaacacattttaaataaaataaaacactaccgtgtctccttctctggcccagcgctggggtgaatggcccccgtggtgtcagaatgcccggaaccccccagctcagcgttcccacatatggcctctctgcagcccctctgaccacggctctccacacaccccagccccagggtttcagagatgtttctgactgtccccatttattcattcatccacctgtccatccacccatccttaaatgacatgcactaagcagctgtctggaggagagacaatgaccttacaaccatgaatgaatgagctcatttcagattgagatgaggactgtgagggaaacaaacaggcacaaggtggagactgagaggagctgggaagaggcagggtgctggccacctaagaatgctcccagctctacctctggagtgcctcccaccccagatgtcctcaggtcactgatccattcaccctccccatccctacctggctctcaacccttagcagagctctctgtttcttgaactctcccctgagcactccctgcctccctggggtgatgtacaaatcttggaatgccaggctggtgcccctcagggccagaacagctcctgctggggccaggacaccctcctgctggggccaggcttcagccaggattctgtcctttgactggccctgggccattggtgcagaagggatgtgatgggggttgagggaggaagctgttcagctctgagggccctgtcctgggaggaagcatgaaaaaggaatgaaagaggcagagagagacagagagggagtccgtgagtgagtgaggagaaatgggtaaccctgagctggggcccgggaaggagtggggagacgcagcctctgggggcaaaggtggaagttggcacaaagcccgttgggcttcatggaaaatctccaaccctgatatctttggaagctgagtctaccatttccccttagaggttagacacgagtggtttgttactggctatgtgtctgggttcttttcattttttattttttttgagacggagtcttgctctgtcacccaggctggagtgcagtggcgtgttctcagctcacctcaacctttgcctcgggggttcaggtgattctcctgcctcagcctcccaggtagctgggactacaggcggccgccaccacacccggctaatttttgtatttttagtagagtcaggtttcaccatgcctgcctcggcctcccaaagtgctgggattacaggcgtgagccaccatgcccggccctgtttctgggttctgagtggatttgttacagctgcagcctcagcgcagatccctctaggtttcaagattgcttactgcattggcttgttttggttcctgagtttgtaaacacccaactcagggcactctgttttggccaggccagcatgcagatgagtctggaaaaggggctggtcttcgtaccatgtcatggtgagaactgtgtgtgtgtgtgtgtgtgtgtgtgtgtgtgtgtgtgtgtgtatacttttttttttttgagacggagtctcactctgtcgcctaggctggagtgcagtggtgcaatctcagctcactgcaacctccacctcctgggttcaagtgatcctcctgcctcagcctcccaagtagctgagactacaggcgtgcaccaccacacccaactaatttttgtattttcagtagagatggggtttcaccctgttggccaggcttgtcatgaactcctgacctcaagtgatccacccgcctcagcctcttaaagtgctgggattacagacgtgagccaccgtgcccagccagaaccatgtatattttcaaaagagcttacatgattaatcctgactttactaaacagaaatataaaacagaacaaagcaaaaacacacttttgaggagactgcttttatatggcactaagaaagcaagttaaatggatggacaaagagacagttctcttgggttaatttggcaatatacaatgtatttgcatttatgaattattctcctccccacagttttcatggttttcctatcgaaggcagaactattgaaatattaattagagcctcaagacatgctcgcagtggcagaatgaagctggcatttggagaaacagagcagacgttcttgagaaaggttgccggcccagcagtaagagtgggtgatggggtcgttctgccttttcactctcaaggggagaggtcaccgggctatctgtgggttgcgcaaaaaagggacctggttggcttgtgtttggaacaagtaaagtgtgttttaaaaatcaatgaaaaattgagaagtgtttaattttctttgcatcattgagctgccctttagggcccagctgtcattgtgtggtgggggcagaaggtctggggggctgccgtccagggatcaccaaggtgagcctgggtggtgctgggcacagggccgcccccagcacccgctctccatctaccacatcgtggtgccgatcttgcggcaggaggagagcagagaactcacctctgaagtgctttgacttctttcgaaaagaaaagtgatgtaaatcaagcagtgctggttttgtccagatgctttcgcgtcagccggcactgctgatttcaaatagctcagaaaccagtgtcccaagtcacccagctcttacgggttcattctcgtattaaagagcctggtttattttttcttcggtagttcagtttttttccctttaaaaatcaaagctacacgctcctaagagaacttctcgcttattgaccagtcaatgcagataaattgcaaatggtaaaaaggtgctcagcagaaggagcggcagagctgtcagcttcatcaacgggagctcacagttttcaagcagtgcccattacacatccctgcaaccctctctattctctgctctttgaataatttatctgcaggaaatccaaattgccaaggcacgctttaacctagcagaatgcttgccaatatccttgggaaaactggcaataaataaataaataaataaagccgtagattgcatttcagctgagtgcaggcaccgcacaagtcccattgtacgtcctgcatcggaaggcattgcacacgggctcagagcagacgacatttgaaggctcataaatgtaatgaagtccctgtgacacctgctcctctattcactttaaatgtgagccatttgtccatggggaacctccgctttaaaaatagaaattgtagtaattgtcttccgttctattggaaggctgtaataaacgcacggctcacagcactgtgctccacagcctggagtcggcaggttgcataaattacccaggttttgatttttcttccttaacaaatcacatacatcattgtatgttagtgctgctgcatgggggaggttcaatttgcaaatttcatcttactaattgggggaattcctttttctttcttcccaggtggttctgtagacatttgtctctttttctggctttcaggagcaaaagccccatttaagacgtgggggcttctgagccccctcctgctgcctctcttcctttcttctgctacttctttccactcccctgctttccctttgactacctcacgcatagagccctggcagctctggtgtctgtggcctgggacaggtgtggatttgctgcctccccttcctgaccacaggtgatggtggtggagtccagtgctctcctcttgggcctcccctgtccggctagaggtgccctcccccgcctggtgtggctccccgggaaggatgttttgcatagcatggagtgtgtaggatttacttgcctgcccagatttgtcatgagtgacacaggacaaggatgctgtgtgtgaccctcaccactgccccacatgtcctttctgtgattgtcaccctcctgggggctcccccatgactccctcgccggacaatgctgtgggcagtgtccccacagagggtggtcagattcaaggatcacaggtggggagggacaccgataggctcaggcaaggcagccaggccctcgaggcctggagaacatatgggctggggccgctccaggttgcctgtttctcacgggatgaccctggtgcgtgaggggcattaaagccttctgctgggccgggcgcggtggctcacgcctgtaatcccagcactttgggaggccgagacgggcggatcacgaggtcaggagatcgagaccgtcctggctaacacggtgaaaccccgtctctactaaaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaagccttctgctgtagtgggaagaaagggcccatgggaagctgtgctctggggacacgttggggtcagaagccactggacgacccagcactgccgctggtggctgagtctgtggtgagcgacctgccctgatgcctcagcacctgcctgaccaggtgagcagtgggtgctgctctgtgtcgggccaggagaccctcttggataacatacggacattcatcaggcttcagtggcgcagggcccatgcctcagcacttgttggcaggtgcaaacctgggggcacggtgcactgtaccctccttgccaaggccggggacatgctgatgggacacttccaagccttgtagaaggtcctttctctacaccctcccacctgctgctcctggccccaggcctttcttgtcctgtgagcccatccttgtcattctgtgcccaaaatcacctttgctgtcaaagcttgagccagaaaatggccagacattcctgatggctctgtactccagaggcactggctgggttttcttgttaacgtcgtggttttttgcttgcagatgagcttagaaaatgaagacaagcgagctcgcacccgatccaaggccctgcgaggtgagtgccgccctcccctcctccagggctgtaaatgccactttcctccgcggtcttcctcaggagcacaaacccctaaccacacatgtgcagagatgccctggggacctcaggcctcttcagcctcattcatcctcagggctgctgagctttgaagctggcatctaagagggctgctgaggggcctttggcccagatgaacctgccttgagggcagaaatgttgaggtagacccagctccatggagtgggagtagcaaggctcagttacgagaccattctgtttggaaatgagaggccgccagccttccaccgccagcccccttccttcccaggcgatcagtcttggtgctaatggggcataggaggttgttgggttgagctggaagtgcagtgggaggagaggaggctgactctgttaggatctgagccccaacccctggccagacttacctccctgatacgggcgggggcttcctcttgtgcccaagcatctcaggtgtgcctgccccggtcagagccccgtgcatcttggcagccatcactgaaggaccagtaactcggtccagttgttctcttctctgtccagcttgatctggtggtttgtgtttcctgccaaaagctgacttctatctgcaattagagaaagagataccatccctggccctgaggtcccagagatcctgtctgaggtggagcatctgtcccactttgtaaaactgccaggctgctcaggggagcttctgcggcgagcaccaggcttgggggagcagctcactctgttgaccttggaggactctctgggaggtcaggaaagggtgagcgccctggggaaacggctcaggtctcactgagatttgcctccactcgtccttggcaaacctctcggctgtttaacttagtttatgctgttagggcaatgagcctttaaaatcacaattcccacatgttttccctgtttctgtctttttcccaggacccccagagaccacagctgcagacctcaggtaaggaagtcttcctgttagcaccaagcatcgtctatgtgcctgtgaccctggagatatcctaaatgtcccaaacggggtcttcttggattgaccaaacacccctggtgagcccctgctttccctaaggagactgcctttctcctggccacgtgtccagctatcttggccccatctctatctgttctcacctctgtcctggccccatcatgtggcgcaccagcatcatggcaaggacacggatgtgcctacacctggtcaccacgaggacctggactgtcactgcggtcccccaaaccgaaaacaagccgctctcttaccggaccctcacaagtgcttctgtgtcagatggttggaggcccagttcggggatgagatgagagaaggggtcttctacatcctgagtcttccattggctcgggatgcaaacagcagttctgtgtgctgatgacccggctggctgagctctgtgaccgtttccttcctgcttctcagggatacagattctcagggcagggaccatcttactgttcagcatacaattgaagagtggatggcttctgccaatcaggaaaatgagaggactgcaaagttcactttgtaaaccttttgcagaggtgggacaggaagacagtgtccctctgacacttgaggccccgtaacttggagatgaagggggaggactacgggagggagttggggtgctgcaagccccaggctctgcgtcagtcacacatcacagtcttgatctctgggaaggtcatggaagcactgcctggtgatgttattatcctgtttgtgaagtggggaaacggactcaggggttaaccttcatctaaccagaagagctgaatcgcatgtgctacttgctggaagccccaccctgggtaacaggtgggaggggtggggtggaagctcagccaaacaggtcgtgtgccagcacttccggtctggggtcctcagcatcacaccgggtgctccccagaacacagtccccggaagcacaggggtcggctccctggaagggagacattgcctgcttggccagcctgctgaagaagcggtgattgcgacggcgagagatgctcagaaggaccccgagtaaagggaagaggaggtgccacgtggagtcgcccagggacacggtggagacaaagacggaggagaatcccaggcgagggtgcagtgagtgaggcacaggagttgaggaaactccaggcttttttggtaacagatggagtgtggaggaagtcgaaaaggcaaatacaaatggcagggtgctctcttgtagctttgaaacagcagaaggaaaagtgactctcaaatagatttgttcgtttttaaacattctgagaggacctgtccagtctaagtgaggggttctgtgagcatttggattttgacgccctcatcatgagccttgtggtctcaactgacatatttggtaatagtgagacccttaaactttttaatggagaaactaggggaaatgtgttgacatctagtgttccaacaataatttcttcagcaattcttcattgctaacatgcaatgtgatgcttagagtaaaataggacaaagattatgttccaaggaatcaaatacattctgcacggaaggtaccattcattcctgtattctcaaacatctgttggccacacgcttcacgtgggcatgcctgtggctcgtgctggctgactgcgtgccccagccatcgtgggagcatttacaccacagaaatggactgatgatgttccccctcccagagacctgtttaccagcacacgctgggctctgaccggacaagcagacgagacctctgtcctggtgggggccacaccgtgggtaccagaacaggaagcatgacccacgcagaaaacgcaccgttgtggtctgtgagaggagcatcgcgtcctgtgtgcagaccatggcactggatgagctcacagacacagagtcacctgtcgggaacccccgtgtgtcgggaacccccgcgtgtcgggaacccccgcgtgtcgggaacctctgcgtgtcgggaacccccgcgtgtcgggaacccccgcgtgtcgggaacccccgcgtgtcgggaacccctcgcgtgtcgggaacccccgcgtgtcgggaacctctgcgtgtcgggaacccctgtgtgcaggactttctctgtggatgacttaacactgcattggctcagaacttcacagcctgcagtgcccctaaccccagctcgcctccccaccagctcaggcagagctcccaggaagacagtccattggttgtttaccaggtgagctgaggagaggttggacttggatcgagcaggaccctgagctgctatttccgacctcggagcccactgggagtgcctgagcgaagaagcagtttgatggtttttcctttcaccccatcgggagaactgatgacgtttcagcttgtatttttgcctgggtccatctgttgtcacatggcctcagactggctctgccagaggcgaagactagggaaggttagggttggggttagcatctttgagacagcgaggcgctgacaacaccgagttcaggaccatctccaagttcagagagagaacacgtctgtagctcacccttcttcttctggcgccttcctccttgagccactggccaactcccacccagatgactgccccaggagagggagggaaggcagggaaggcagtgtcttcaaaggctagtagctgaagcatggggctccaggctgggattcagttcctctcctgacttgtctcctttgacgcctacttttcaagtttgggtccctcagagctgtcatgcaggatgccagctgaggggtgactgtgggccacaccctcttcccagcctcacgtgcatcctttcctcacatctctgacaccagccctagtcagagctggggagtcaaggctggggaattccctcctcccggagaaaagaggctcgggagtcctggagccctggccgtcttcctctccctacaactctggccctgagcacccagaggacatcaggaaataagagctgagtgtgcttgcaggtgaactgcagggctggcatctgctggcacgacacccttggaggccctggctgggtctcttgtccactcggctgtggggtggggagcaggcatctaaggggtttccagcttcctgtccccgagcggccttgtccgctccacgcacttgggctcacagccgtgtctcacaccctctgaggctggggccggaaggtgcaggcccaccttcctggggaccaggactcttctgagctgagggtgacgtgttcagggcagtccggtccccacaggcctccacagcagctgtcacctaattgcctgattcactcagtgatgtcatcggctaattgggaccttagcttcaaatccccattaacaaggagcttttttgtgaaaagtcccaaagctagttctccaaagagtgaaagcaagtgtgggcctggattttagaagagactagaggcagggagaggtgggtggcagcggcggcaactccctcagtttggaaagggagcccccagtcgagtgtggtgtgccctccctctctcgctctctccctcttcctccctcttcccctcccttcccgtctgggttccctcttccctcctccctccctccttccctccctctctgtcttcttgttaacacactgaaaaccccaccctggaaggctgcagagaacatccccctcccccaccccatggctgctgttgagccaggggatagggtaaggcctggattctgctgacggttctcccagaggtagtcggggagggtggcctgcaagcccactgggccccacagttgtctgcagtcaggcctgtgatcagtcgaattagaaacgatcagaggtgtctggatagagactggggatggcgttcttttccccgggtcccaggtatgggggcaccagcccttaccttcctcccttcacaggctccggaagatgtgcttgggttttggaaagagctcagactcacaatgccagtcctgttaaaagcaaggtcttcccatcttggccaggaaagcctctctcttcccacaaggagcgcaggcctgcccctcccacctgccttaggtgacctggcacaggcgtctgggtcttacaatggcagctccttgtagtccttgagccgtggatgcatccgacagcccacaggagcctgatacatggtgaactctggccttacactccacactggcccctttgtgcctgaggctgctgtgggagctgtggtcctgccgccacgttggttggcatagtcagtactcatgctcagaagtttccagagcttcctgctggtttggttatatagggagacagatgatggttaaggaagaggaactcctgggtgtcctgccttgtgcttctagggtgagagatgcaggagggtcagtgtcaccccctccccaaactgcccttcttagcacagcccaaaagtcttccacgaggcagatgctgttggttcctggttcacgggccctcccggcttcttttccctgcgtggaagctgggacccacaccagctacaggcactggtgggatcttcaccactgtctgtggcttgggccacagattcctttctgcctgtcagtcctggctccgtttgctggggcacgaaggtcacagctggcagggaatgcagagactgttaccctcgagggccataggccttatggcattagtgatggccacagagaatgccaacttctgtgctttggacttgggacctctttagagaggggtgccgtgttcagggcacctcagagcgtctcgtgtccaagctcctggaaacctggtggcagctagtggaatgcctgccgtggggagcggtctgggagactctggcgctagaagtcttgctcttatgtatacacagtctttaattgaacactcgtaaaactgtaatgagccatttatttatttgaatggggcgagttattaattttcagcaaactgcaggcagccattctgaggtgaatcgtctggagacattctgctccccagggtgaaggtctgcgacaggctctgagatctgagcccatcgcctgatgtggccttgcctttttatttcccctcagctgccccaccccaggatgcacaggctcagggcacgtccggggcaagtactccaggcaccgaaggtaagaggacccttggatctcacggagattcctgggcggtagatttggagcccctgcccactctgcagatggagaactttccatctttttccatggctcccaaggccaggctgctgacccttctgcgaggcagcgacctcccactctagcgtggagatctgtgtggccatgggcgtgccatgtgggggaagacagaccatctgacctcccgcgaggcagcgacttcccactctagcatggaggtccgtgtggccatgggcgtgccatgtgggcgaagacagaccatctgaccccctagtgctgcactttgctttttttgtccgggttccctgcaaggactggatgagtctgtggggaagggagggagggaggaccctcgggaggggctcatggggtgtctgaggcctctcgtggccctagcctggtcctctccactgcctactcctccctcccagtttacagagctgccccctggccaagaagaggaagctggagggcgctgaggctgagcacctggtgtccaagaggaagtcacaccccctgaagctggctctggacgagggctatggtgtggacagcgacggcagtgaggacactgaggtgaaggacgcctctgtttcggatgaatcggaaggaactctggagggggccgaggctgagacgtcaggacaggacgagattcatcgccccgagacagctgaaggtgctttgtcgctctttcttccccgaataaagggcgcttagtgtggccctggagaattgcagcctgtgagcggggaggggctcactccgggcaagagaaagcccttcctgagaacaaggcatgtcttgtcccaacatgtgctgggcttcctgggagagaggtctgcccatggtgtttatggggcctgtggtgtgtttgtgtgtgaacactgtgtgcgtaggagagaggcaggacagacagagacacggggctggtgtgtgtgtgtgcagttgtagtgtgttttggcaggtgtgtctgcatgtatatgagagagacagacaaggctgtgtctctgtgtgtctgtaagtggggaagggaggatcttagactggccctctgttctgcctggccctctgggagacctgcctgggggcatgggtgagaggtctgcgttcccctgaggtactcacaggcagatgctgaggaaacacctcaggttgagcttcaggtgattgaggaccagatggagcctctgaagacggggtgcccggggaggccaagaggggaaggaggaaagcagacgagtcccccacttccttgtggggtctaccaggactgccatgttggagctcctagcccttggcaaaagtgcatgaagcaggtgctttggcccctgggtcccggagggaggggtctgtgcccctgagagccctggcagatctgtagagacctggggtcagatgaggcccaaggtccactccccccaccatccccaccactcacccagcactccccaagcttctgcagtggggaagggtctgagatggatttcagaagcaaagccagagagggtcctcaaccccagctcccttggggggctctggagtgagtgcgctgtcccgtggaatcaacatagtcctagatcccaggtagaaaagacacacattttcctgctttcttatcaagaagggcgtctggggttcagctgtcaacctgggcttggactttcccctccgaagtaggtggatggcagggcccattcctaccactgtgggacgtgctggcccaggtgtccttgctgacaaccctacggggcctgcatgtggtgagcacctaccatatcttagtttcgttttgtttttgttttgagagagtctcactctgttgcccaggctggagtgcaggggcacgatcttgatttactgcaatctcctcctccttggttcaaggaatagctgggactacaggtgtgcaccaccacgcccagctcatttttgtatttttagtagagacagggtttcgccatgttgaccaggctggtcttgaactcgtgacctcaggtgatccgcccgcctcggcctcccaaagtcctgggattacaggcatgagccaccgagcccattcttatttactgattttcaattatgaaacaattattattatttttttaaaatctgacttgctgcttaagctccattgtatacaatgcaggtttatctgatttgggaaagtaaacgtgatgggagaggaacattaagaaaaagtatcaaagtaattcttagtttaaaaaatacatcagtggcccatgacctgcctcctaaaatatattcaccgtgatttctggattcaggcagaagggttgacagaaaggtccataccaaatccccacttctggagtttcatgtttccccttggctcccgtataaagagtgagtggtaggtcaggtggaggggtggtgggtgtgttggggactggagacctggagtcttcccacgtgctctctggcccccacgttgattttgattttgtgcaggaaggagccccgtcaagtcccattttggatccaaccccatcggcagcgccactgcctcctccaagggcagctacagcagctaccagggaatcatcgcaacttctctcctgaacttgggtcaaattgctgaagagaccctggtggaagaggacttgggccaggcggccaagccaggtcctggcattgtgcacctgcttcaggaggctgcagagggagctgccagcgaggagggtgaaaagggcctcttcatccagccagaggatgccgaggaggtcgtcgaagtcaccaccgagcgctcccaggacctgtgtccccagtccctggaggatgcagccagtgaggagtccagcaagcagaaaggcatcctgagtcacgaagaggaggacgaggaggaggaggaggaggaagaggaggaggaggaggatgaagaagaggaagaggaagaggaggaggaagaggaagaggaggaggaggaagaggaagaggaggaggaagaggaagaggaagaggaggaggaggaggcagctcctgatgtgatctttcaggaagacacctctcacacctctgcccagaaggcccctgagctccggggcccagaatcacccagtcccaagcctgagtactctgttattgtggaggtccgctcggatgatgacaaggacgaggacacccactcccggaagtcaacagtcactgacgagtcggagatgcaggacatgatgacccggggaaacctgggcctcctggagcaggccatcgccctgaaggctgaacaggtgcgcacagtctgcgagccgggctgcccgcctgccgagcagagccagctgggcctgggagagccagggaaggcagcaaagcccctggacactgtgcggaagagttactacagtaaaggtagggctcaggggtggcctggccctgcagactcatcctttcacccctgccccaggtgtgcagatgcaggctgagagcccttctaggacagggggctgggggatggcagaaaagcagacaaaaggacaaatacatgacacagactgtggtcagatactgagcaaatgggttcccacactgctttacatagagcgatctggagcgagacacagcggagacgtgtgagaaagaaccaggtgggagagaggaggtgggagggacagtgacccacccacagtgactggtcacagcagcatctggggtctggagagggtggggaccgtcctgtcccttccaccccaactcacactcgtggcagggattgtgctatgacagaacccgctgtttcctacagccatgctgggtcatcctgatcctctcgtggggtggagaccagcaggcagatgtgaggggtgcccttgctcctcagagggagcagcctgccgctggctctgcatctgtctctggatttggctctaaagtgtgcagggtacaggggagccatcccctgatcgcacggagtggctgatgttgaggtgaggatagacaaggagggctgcttggaggggcctggggctgggctgacgtggttggggagcagctgggaagcagctgatgtggttggggagcagctgggagcctggagtgctgaggtctgaggacgaatcctgagtaaacggttacggccttcattgttactggggtgtcagggtctggacaacaggctggctctgctctgctgactgcccatctcagattcctcctgggacaggggtctggggagcagggctggccaggggctgctccctcagtgagccatgccagggaggccaggccttggacaggtcagctttgacccagccggcctggtgcggagggcctcctgcacctgggcacttggcctctattctcctaagactagggacctgccctgatctcggcctcttttttccccatgtctagtcctgcatctcttctccaggtggacgggggcagtgggagttcttggtgctcttccaatgagtgcccccaggaagagttagctgagaccagggagggagcagataaggagagagaactgggatgggagatgactcaggtgctggagccacgaaccaaaaatgcaggagacacggaattgccaaccctgggaagatgcacttgggtcatgggagagacagacctgagtgagacataattcaaggggcatgataggcaggtcagtggagacacgagggacatgttttccgggaacaccaggcatatgagacaagctcaggggaaagatgctaaggggacacaggtggggacatggtttcagggtgagatggacccaaagaatggctttgcggggacaccctttagggcaacccagatggcgggacagctctttggggacccagatttaggtcggcagtgtcatgctccggccttgtggggccatgggcacaaagagacacaggctgaaggtgagacttagggacaggtgtcaagggcccggggtggttactagcctggctgtggtgtgcttgggccgcacagatcagcgcagaatttggtgggacacatatgaggaacacagacaccaagtgacagccctaggcccaggtttttgagggtctcagacctgtgggacagacataggaggacccagatgcaaggcatcctgccttcagggatagattttcagtgcatggacccaaagggacacggccccgggtgacacaggtggccaagctgagaacaccaggcagtgcccagctgggctgtgagtgtctgtgcaacgtgaacgtgcggttctggttctgagggactgatgttggggcacagatgctgcgagaattctggacagaggccgtgggacaggggtggcaagcccaggaggccggtgttgggcacgggtttggaagcccctcaggacacccctgcctgtccacatgggtggaagtctgactcctttgaacttggggcagcagagcaagagctccttccctttggagccccctcctgggaccctcctgctctgaggtgggagttctgagtttggctctgtgacctctgcaccctcccaaaggggacagctctcgtccaaaggtgtttcactgagatgtcagctctgctctgagggtcctccgtgttcctgctggtccctatactctatagtgaccggcctggacctgcagaggctagaagaggtcgataactgagatttgggtttacatttctgcccaggcatagattagtcatgcagccttggataagttactcaactcctttgtcttcctcgttttgtcaaatcccaaggatatctcctggcaggaatattgccaaacgccttgacctctctaggcagaaggctgacccatgaggcctccacactgtcagaggagagaggaaagaggactccagcggccgtctgggttgttctccttaaaacgctgcacaaactgctatttgggattgtcagggcagcctcagggcttccgcacaggcagccagtgtgggctggtttcttcagggtctcctgactgtccagccccagtccctgttcaagctcatgggcagtctcgcctcccttctctctggacagccagagagagggttcctgagctacccctgccccctctctgctcaccacccagcttcctggctctaactgatgtgacttgtgtgttttagatccttcaagagctgagaagcgtgagatcaagtgtccaacaccaggctgtgatggcactggccacgttaccgggttgtaccctcaccaccgcagcctttctggctgtccccacaaggataggatccccccagagagtgagtagctctgtgcagcgttagccctaactgtgaagctcacgctgcctctgtggtgtttgggtggtgtctatggggaggcgtggcctgcccagggccataaccttcccctttggtttgtccagatgctcatccttacatctccccgctttcccccacaaactccctcagcccaaacttgagccctttgaggctggggccctgcaaccagcccatttgtctacctagagacgccagtccgggtcagagcccacagtaacagatcgatgggagggggacaggctagtgccatccaagctgggaagggagaggtcttcttgcagcaacctctgtgccctgaaagcttaggaagcaaatacttgttcttatgtttaggctagaagcagtaattgtgaaaattaaatttaaaggagcaaaccacagaatgagaggttttaaagctgagtctggtttctgccgcaggagggagggaccacagtggtggtggcggtggggggcatgccctgaccaggctgagggtggggagttgtgtctgcaggctcttgggggctggagctgccctgcgttgctgtgtcccccacctgcctaccaagcagcagcctttggacaaggctcctgcaccctcctcagcctgtgctccccacacagctggcgctccccagattctctgacagcctcggctccctccaccccctgttctcttacagtcttagccatgcatgagaacgtgctgaagtgccccactcctggctgcacaggccagggtcacgtgaacagcaaccgcaacacgcacagaaggtacttggactgagctgggccgtagtgggggccagggtgggggccgtggtgggggccagggtgggggccgtggtgggggccagggtgggggccgtggtgggggccagggtgggggccgtggtggggggctccacgtggggtagggcacctgggttgggcctgtgtgtccctgcctgggccgtgagcccgtgacctgggacggggctctggcctgcctggggctccctgtgtgctacccttctcccagcctgccgccctgaggagtgggtacaaggtcagggcacacctgggcggtgaggggcctttgtgagggcagagtggcaactggaggtgcagtcacccagtggtgttgctgccttaaccctacgagctcccgagagagcagggggcggcctgcagaggagggagcaatgcaccctctgtgaagagaggtacaacaaccatgtgagagccaggtgaatactttgtgtcctacccacattcagaaaacctctgcacactggctcttgctcctgagtgggaagggcagacatgaacagtaacctcggcaggccaggactgtgctctgggctgctttgtgggagttctgaggcccaggtggaagtgaagcttcccgaccaccctcgaggtgtagttgttgactggtcttctatggtgaggggggactactcctccagccttaccctaagtgccatgggtggccgtggcctcggtgggatatgctttcccccagcaggcttatgctcagctgaaaggactgccagagcttttgaggtcacttcatttgaaaagaggccagttccccattacgtcacctccctgggctggctgagggactggcgctggagctcacagttaactttattctgacagatgaagctgctgcctccgtgtcttagactgagtactttcctgggcctgtgtcatccagggtcagtgcccaggctgtggtccaagtggggccctgggctgccccagagcagctaacagaacaagcgccagagagggctgcagaatccagccctgcaagctgggaagggagaggaagggggtgagggcaagcctgtctcccagacccatgcagaggaggcatctttgcccagagctttcaaggcctttaggatatatttcatctttgtgtgtccttggcatagaatgttccaaaacagaaactgactgggcagcttgtactgtgagggctcaagaacagagccagagagaaaacccctgtcctgcagaatgacagggttattcccggctctgggcttctctggagttcacctggagttctcacatctgaatgaccttgccgtgagacacccacacacacagacacccaggacaggacaggcatggaggggaaggctcagaaacccctcctcttccttcctctagtttgtctgggtgtcccattgctgccgccgaaaaattagccaaatcccatgagaagcagcagccgcagacaggagatccttccaagagtagctccaattccgatcggatcctcaggtgagtgagatgagccacagaactgaagaggctgcctcccaaatgcctgcagagggcttctcagtctcccgcaggctgtatgtgcatgtgtgtgagtgcatgtgtgtgagtgtacgtgcatgtgagtgtacgtgcatgtgagtgtgcacatgccccgggccccccaggagcagaactgcggggcagttttggagccacacaggacagagtctcatgtctaccacattcgccagtgcctcagccaaagcgcaaactcctgcacagttgcctctgcctccgacatggggctctgcctccttggagtcgtctgatgtgaccacttgaggccccttggggattcatttgtggagatgctggtcctgtctggaaagagcagactgcaccagccaaggaccacggacgtccaggaagcaccatgagccactaatccttggccgtcctgcctgtccctccccgaccccagggatagaccccaagtcaaggaagagggtgggtgcaggctttgctccccagagtgctttgtggcccctgaggttctgagatcacagtaggtgtgtgtgaacatgtgggagcgtgtgtgtgcatgttcacacgcctgtttgtgtttgcatatgtgcgggtatgtttacatgtgcgtgcaagtccatgtgtatgtgaacacgtgggagcgtgtgtgtgcatgttcacacgcctgtttgtgttcgcatatgtgcgagtatgtttacatgtgcgtgcaagtccatgtgtgtgtgcatgtgtaaatttggctctaatcaataaggatctttcagaatgtgtcccattagtgtcccctccttccatgtggctctaagaagtaagtgccacaaataaggccagaggctcagagagttgcccaaggccaccctgcccatcctgcctggcttcaaagtctctcctctatggagctgagtccttggaccacggtacccactgtcgaagaggacacttccactgctcctgtcttcacctgcagacaccctgctccccactcccgtgaggaactagaactcacacacagctcctcctccccagctctcagacccctgttccatatctgtctcaccagacaagagtgtaggagaccccggctggggtgagcgtgaatgactgcatagccccttccactgtccgcctcctttcggggcccacctgaccccggcccttcctggcacataattggcaaagttccagccagatgatcttcgctgctcaccttggctgtgtcatgcccaggcccttccctggtctgctccagagtgttcctctgaaggtgcaattcccacacgtgggatctctgggcagagcacagagacttgccttcctgctctgtgggcatgcttgccatcccacacacaggcaccttcagccctgcaggtcccagcaggctgctttccaccagctggctctcacaatggtttgaagctgcttttttcctctatcttatttgctgttccctccagcttcctgtcagttgctaattcaatcctttccctctttgatctaaatcaccgataaaatgtcaaaccgcagatttggcccccgtgtgaggccaggcaggggtgtcaaacaggctccaactttggagactgcactccctgggactatgacctcagtttgttcacttataaaagtaggacaacaaactaagtcgctcatgaggctcaagtgacactctgccgccctcagcccatggtgaatactcactgaacgctagagagattgtggctagggtggaggaggcctcccgttaggcccttttgattctatccagcccacatttctggctatcgaactttggggtgtgaggacgggctttgcaaagcttcgttggcattgtggacaataagtgtacagattctgactgaagccttggtcaaggaagccatcaacggtggtaccaatgttaagcttattattattattattatttttagtgacagagtgtcactctgttgctcaggctggagtgcagtggtttcaatcataactcactataacctcaaactcctggtctcaagtgatcctcccacctcagcctcccgagtacctaggaatacagatgtgccatcatacctgcctattttttttgcgtttttttttttttcttttttttgtagagagggtctcactaggttgcccaagccggtttcttactcctggcttcaacagacctgccttggcctccaaaagtgcttggattatagacataagccaccatacctgacccaatgttaagtttaaagttagttttttccctcctggcctcactcttgcaacttttctatctgccactggggtcaggatccatcctggggctcccacccttcctggagaaggagaaaacacccacgtcctggtagtgttcagttcttccaggcccatcagagctggccgtggttgcagggctggcctggtggtcctctgtgctgggctctgttcttagtccacacttaagttctcgtagcacccagcaccttggaggctgtcattgtcagctccttcttaattccactgattgtacactttccagactgaagtcattgcttggtccagacaggaacaaagaaagccatggctgcttgccaggatctcctcttctctgagctgccaggttcagaagctcctctgtgcctgtgtggtcaccagcatctaccaccagtcttcctgcccctgtgccttctatgccagtttcttcgtgccatcttttgtgcatgtaaaatcctgaagtattccaagagcattagtggcagtgaactgaatgcttgcagtagctttttcgtggctgttgctgacccttccaacagttccttgagggtccacctcaacacagctttaagaagagggcagctgagggctgagtccctggctgaatgaagaagggtcaggcctggccctgaggccactcctcagaaatgcacctgatacaactagcgtctcctgtagattcctcagcttcctccttgctggggagttctaggttatgctgccttggagtgtcttgctattgtcctgggctatgctactctttggccctgcctgatactcactccagttgcagctgagctgtttgaaacctgctctcctaagttctggggaaaatcttaggccctcctctatctgatgctgtcagcaggacaggccattgattatttgagggtcctattgcttcctccctgcaggccattcttcaccggcctgctctgggagcccttgaccctgggaggtggaactctgcccagctttagtggtggaatatgcaggggtagtgtcttcctgagtctccttcctcaccagacgctgtgaggcccctgcctgggctgcagattggggttggggagggtggcacgggatccccaggtcccatctcactggctgtgcatccctgtactgcaccccaggcccatgtgcttcgtgaagcagctcgaggtccctccatatgggagctaccggcccaacgtggcccccgccacacccagggccaacttggccaaggagctggagaagttctccaaggtcacctttgactacgcaagtttcgatgctcaggtttttggcaaacgcatgcttgccccaaagattcagaccagcgaaacctcacctaaagcctttcaatgtaagttggggagaattgttcttgtttctcttctgtgttgctcctgggaggggcaggattcaaggggcagtggaggagggaccctctcgaggagctactagggagggaaactctaccctcatgggaggaccacgatgcaggctggaggtctcagctgtcccagtgggcactgtggtggctttcttggggcctgcatctcactcctgctgccaccttcatgttcaccattaacatttatgtgtctcctagttatttgtgaaacaaaacccagatccgttacgggcgtgtgtgtccaaagacttcagagcaaccccaccagcatggttcacactgggagacgccactctccccactgtcctcctgctacctgtttaatcccagtgcagccggctgtccatttcccagccctgcctctggggagggtcagactgtgggctgggtggggccagatgactgcggggctgggcccagtgccctggcaggaagccattgctctcctggtggggaccatcttactggatacaatgtgttatctgtgacattagtaacaaattttctgggtaattgtactgacaaaaatcattcctacaaatctttaagaacaatcctttctgtcttgtcttgtcacttactgccctaatttgtggaataagcccattagccctggaagtgcatgcgaaatggaaaagcattcagtgtacacatgagattgggagtggcatcgcggggcagatgttgtcagccccaaacatgacgtgacgagtttcctacatgagaataataaaagtactgattgatgcggctgccagtggggtgtgagcctctcttcctaactttgacagaacctgctctttaggatggaggacttcctgcctccaggcacacatgcctacttggatgagggaatgcaatggtgccagtggagagggggacctcacgataagctttccaatatatctagacctttctggatatactggtgacatcgtgattgctgagaacatcgtgcatgagagtgattttgcagctacagtacaattgctagaaaagataacattctgtgccttcatttgtcatgttcatttgagcaataatgttacttttttaaggcagtgatggttaccggggacaccaagtcagcctaaatatgggtacacccttttgagatcatgggacaaaattttcctatttgggcgatatggcaaacactcatcctattcacagaatgcttcagtttctgatagacaagttatttttgtttgaaatatcagggctgctggaatgtcttggaggcttttactccttttgcccaaattttcactgagccagaaacaagattgtctcctcagtcccctagaggagggtgggtgggagtgaggtgtgtgaggacttgggactgggacgggtggccaagcccctggcccacttcgatatagctgtgccctgggccctcccatccctcccaaagtgccccctccccactgacttgtctgcattgctgcctcttttcaagttgtatatcagcctggtgttgttccctttttgcagccaaacctttcccaaaggcctcttcccccaggcacagcccctccagtagttatgtgaggagcacttcatcctcttctgcaggctttgactactcgcaggacgccgaggctgcacacatggctgccactgccatcctgaacctctccacgcgctgctgggagatgcctgagaacctcagcacgaagccacaggacctccccagcaaggttagtacatctgccacagagcctttcttgggagaggtgagttggtggaatttgcagtcaggcccacctgctctctgcacaaaatgtccctaggaatggcttgtgcctagctggcaattctcattcttaactttttctccctcctggccatggccccaaggaccgcagagcttggatgggtccaccaggagaacctggtgtgctgagtgaagggggaccaagggctgcgaacacaagttcccacgtgttaggttgtgtgcacaccatgcgcccgcgtgtctccctctgagcctgagggtggtgcacacacatgcccatgtgtttccttctgactccagggcggtgcacgtgccctgttcacacgtgtttcccgcagtcttgtggttgctgacacactctccttgctcagaggacctagtcttacccgtgtttatgacatgtcctgagggactggtttttgtgctgttgggaggcaagaggaattgtagggcccccttcatgggaaatcaggaaatggcagctggattttttccctctcgctgcctgtctgtccccgttgtcctgcttccttctatgggaaccagtgttctggactctgtacgtttgattcaaatggaccagaaggcacacatgggaagggatggaatcgctaacagatctcacctttgccattgcagtctgtggatatcgaggtagacgaaaatggaaccctggacttgagcatgcacaaacaccgcaaacgagaaaatgctttccccagcagcagcagctgcagcagcagccccggtgtgaagtctcccgacgcctcccagcgccacagcagcaccagcgcccccagcagctccatgacctctccccagtccagccaggcctcccgccaggacgagtgggaccggcccctggactacaccaagcctagccgcctgagagaggaggaacctgaggaggtgggtgcaggcgcctgggcaagcagtcaggcggctgcagccagcttgccctgcctgaggctgttgtgatattggcttttcaaggaagcttctcctcacaggcttctggaagagcctcggggagccatcccttttcgtgaagggtccttcatcttctgagcagctgggactcaggggctcaccctctgggtgggattttcagcagcagggtcatgctgtgcccttgtctgtcaagaaggaggtggtcttctcacccctgtggagcatggtggccagcaccaacgtgggcactgtggaggcatggggaggagaaaggcatcgttcagatcccaggagttgattggggaaaagctcaggtttcttgggttttgagcctcccaccaccctgcagagctaacctgctgtccgggtaggggcagagccagtgagagagcttaggacctgggcttaggatcgcccatggtgggcagttctacgtccccgagaccaggaccaacctggcatgggtgctggaactgtggtctgggaagcaggggatccttccctttttagttccttaaaacatgtgaaagaagaatcctccgaggccacagccggttctgggctttttcccaaggaggtgtgtgtcctgaagagcaaagtccagctgtgagggcagcccagggtccaggcggcagcagccgcgtgtgtgagactagcaggcccctctccctctccttcccctcccccaaagcccctcaggaggtggaaggggtccctgtggaaggagcagggccagaccctcaaggaggaatgaggggggtggggctaggcccctatgaagggtgggggctggatcaggcccctatgaagggtaggggctggatcaggcccctatgaagggtgggggctggatcaggcccctatgaagggtgggggctggatcaggcccctatgaagggtgggggctggatcaggccccctccacaatccggcctcagtgggaggcagacttccttaccggccctcacaccaccctcaggtcaccccatttcatagacgagcagcctgggaacccacaacgaggtccaattatccgaagactgttattatgctgggctgtgggcttcacgggcatttcctcatttgacccccaaaaacctttgaggggctgctgttatctcaagttggacagagtggcacctgggccccaagagcctgagccacttgcctgggacacatgcgagtgcctgtcaggacaggattttgagctctggttacagcatcctgcagaatgttggccttctgacccttcctggacccctggcccctccgtgggagggactacgccctgcttatctgtgtccacagctctgagcctccatacccagcattcagttcgaagcctttatcaagcacctgctgtggtcaaggcatcgcactggtgggcgtgtcgggccaggtggtttcgaggttactgcgattgttgtaatttgtatgttattaccctcgttgtgccatctcatcttcatggcatttcggtaacacttatttagtgcctactgtctattgagtgccatccctggctctgaagggaactgtatcctgatgtttacgctgcggagtgatgtggcggagggaggccagggagggtgtcaggagcctgccacactgggcagcaccaggcctcatttctagggcaacgcaggacctctggctgaagcaggggagggatccagcccctcaggggtgttgtcttctgtgttttgctggggggagttaagtcttcctcccttatccagaagataggagactccgggagatgcttctgtggacactgtcctgaagggtccctctccctcgcccactgggttgggcgcccaggcctccccgccagccggttaaaacatcttcctgctggttttttgcagtcagagccagcagcccattcttttgcttcttctgaagcagatgaccaggaagtgtcggaagagaattttgaggagcggaagtatccgggggaagtcaccctgaccaactttaagctgaagtttctctccaaggacataaagaaggagctgctcacgtaagtccctgtttggctggcacagctcctaggggaccctctgtggcctggggaggaacaggccctggtcccaacccatgacgaccgggtctgctcaggctttccccgacctgtcctgaccacctcgagccaggcagcctgtgacaggagccagggtattcagaggtttcccaacacctttgtgttgtgctgggctttactgcaatcttctaaaagtgattaagaacaaagaaatcccctggccaagctcaccaagcaggacagagcagggcaggggcagagtggaggagagctcctcagagagctctgcaggaagccctcggggcacccagaggcctggccctctccctgaggccgcagctgggcacgttctgccctgggctccatggccaaggcctggaatgtactgccttagggctcaccaccctcaactctgtcagcctggctggcccagaggctgcgtgtctgagctggtccgcatggggttggaacagacagagttgctgatggatatgaatcagatgtcaatgaccttctggtcagccttcattgccagccacctgtcctaggggactgtgagaggctgtgcctggcacctgctccacaggtgatccagctctcacatgtgctcagagtacatttctggggtccctcttctccccaacctgaacccctcttgtaccctcacacttgtagcttgccctcctgggagtggctggatccagggaaggccttgcttcagggcctggagaagggaaggagctcctctgcctaaatattcgtgggcacatacacgtgcacacacagcacatgtgcgtcagaggcatcctaactttaagctcaactttaatttggttactttttcttcttgagttaagttgtgtgggagaaacttccagcctgagaggcaccggctgtcctccaaggactgagtggaggaggggccaccgcttggctcgcgggtgagccaggagtgggcaccagtctccctcgcagagcaggctcagcctggggggcaggtacacaccactctccggtctgacactctttttcctttgtccagctgtcccacccctggctgtgacggcagcggccacatcaccgggaactacgcctcccaccgcaggtttgtctcctgctcgggtccgtctggcctgggtgcttcgtggtgggtcttcctcctctcctcctcctctgctctccctctttggcttaccccaatatcccatctcttctctttcagcctctctggttgccctcttgctgacaagagcctcagaaacctcatggctgcccactctgctgacctcaagtatgtttgcgctccctgacctcctgtctcttgggcggcaccctcgctttgctctccttccatgaggctcctgccaaaatcagccttctccaaggtgccaagcctcagctggccccagctctcctgagatgggcagaggggcagggccgtggaggggccgattctgcttggctggggctgctctgcctgtgtgcacctgctctgagctctgctgtttgcctctccgctgggggctaggggtcgctgcaggctcctgcgctgctcttgacccatcccccaccctccagcctctcctgaagatccccgacagggctgtctgggcctgctttcttactgccctagagatttgggaaaagcccagaaccgaccagggaacgtaagccctgccgtggctcggcaggccacaggctgtgcggctcttgctaaatgaactgaacgctgataatgaagagaaagctccttcccctcccctctcctgtcacgctccagctgcttctgccttggccctgatgccctccccccatgctcatgccttctctttgctgggctcacccgtttctgcttctgtacctccctgcccctacctaacacatgggcagggcaggccctgcaggcaccagctatagcttgctggacagtcctgcacaaccaggcgcaagcacccagaggtttccaggggtcagtgtcctcctggggctggagtcagggactgttactgcctttggttttcatgcctccagttgtgctgtgactcctcagcctgtgtgaccctgagccatggggagctcctcctgggcaccggggccgagctgaggccttggaggaagggggtcccattcttgtctcctcaggtcacctctctccaggggtgtccctccctcccataggcctctgtgttgggggccctgaatccaggtcaacacaccctggcttattccattctggggccagacaggatcctgggcactggtgcctctaagatgaggaaatgaacttgctgaaggcttctagggaccttggctggctcagacctggacagaaagctctaggtctcccagagcccccaccagcagccttgtctctgttcccctctggaggctggtctggccccagcagccaggaggagtgtgtcatgaggcccttcagttcccacagagtggggtgcagcatctaagtttccttcctggaagttaatagcttcaacataagcattttctgaggctgagatcaccacagcagctgcacacattgacttattcattcattctgccgcccactttgtctagtcctagaaacccaggaaacactcagtcctgcagcttctgggactgtcctctctccctctttccttcttctcttgccatctttcttgcattcctttttccttttccaattctgctttcttttccgtgattagtctccatggtttttcccatttgggcctgaataatttaagaggagaaatgtggctgcaggcactcagtggccccaaatgtcaccatgtcctttctgtcctgtgaagtggatgcttgggcggatgaaaggagcttggcacagttcgggcctggagacatggccgtctgggagagttagtgcttttttaagactaagagcctgtgaagaaccttaacgccaaacttctttagaaataacgaccaaaagcctcccctgtgtgaaagtgaaccgctcatcagcatcagcagggtttgggcaggcagccacggcctccaggctccttcagaaactccactctcccccaggggcctttccatgggaggccacttcctttcctccctccgaccactgcatgagcttgggacgatggtggtctccccccgccacgtgtcctggtgtaccaacctccttgctctctgccacctcctgtgtgaggcggcatcgggcactggcccctcctgatcagcctcgtggcagccatgggtgacggtggccttgggacaaacgaggttcctttcatgacttccctgtccgcacctggctgcagcgacagtcagatgatgtgtgttctgtgttttaagtgaatcccaagggcgttcactcttccctcccatgtgtctgatgtggtcaagggctgtgaggacatggccgcctcgggccactcagctcatcttgtgttgggagttgagctgcaaccacacacacctgccagggcatgacaggctttgtgcagggtgaagaatgcctgtccacagcacggggatggggcttagagaggtgagacctggtgtgtattgccaaggtagagggtgcccctcagacacggtgttcccttctgcccagatggggcactcagaagcaggtggtgggaggggtggatgtggctccagattcctgcagctgaccctgggggtccacagagccatgaggggcatgcagaggggacacctgctcctctgactatgtgagtactttcctctctgggacacaactcttgagaaaagccattgaatcgggccttagtgaggactgcaggatggccccccctgtgtgttaggtactgccggccccttgggagttatacccccacctgagactcactcacagatgccatcgggaagtatctcctctgctgttgatgccactcacagtccaatgctgtgcttatccccgttgaggcctagagctgctgtgggtctgtcactctggccacctgagtggccacttgcccaccgcactgaacctgagctctacctgatgctttgctgccactgagacaaggagctggagccccaagtggccacttgaacagctgccaacccaggaaggagaggcaggccatcttcagttctcttggctggccagcaaggtatccaatgtgtggcccacagggcaaggatgaaggaatgtgaggctccccaggagggcaccccaaaaaaactcctaggggccgaagagaaggttgcaagaggtggggccagccctgctgtgccgccacagccctttgggtgccaggctgtgcccggcttcatcttcctccaagcgaggagatgtcctgtcccagtggccggatgtcacatgtgctggtggaagactccggtgaggaagggccagcagcatggaaagtgagacgtcctccctggggtctgagcaccactgcaaagtgcctttgagcagcaggtgatctggacacaagcactgaactcttgcctggctcctgcagggtcaggggtcaggaggggtgaggcacagagagcaggcctgacgggggatggatctacccgcagaatcaggtcacctcctcccactctctaacatcagcaggaactcacatattttttcctcagtggacattcggaagaaaataacatccgtgcttgtaatattaaagtggaattttgtaccaccttatgtgatacattcgtcaaatagttttgggtgtgtaaagttggacttttgtgtttctcctccttactctctgctgtaagccactggctgtgtgaactctgcagtcatgctatacaacagccaggcctggcatggccagcgccatctgctctgcagcaggtgtgcaaaaaggcctctgttcatttaccagcccatggtggccacgctttgtgagggcaagctcccagcccatccaagaagatgaactggtcttaggctgtgcttcaagttatggctcagatatgctctgaatgcctttagtccagaccggaccctacagaagtccaagctgggagcccttcgtgtccttggctgcagtggaccctgtaggcctgtcccagtgcccaggtttggtgtctgggtgtaaaccgatgctggagcagcagttggctgctctcctctcagacttcctggtctccctcggggagacgggggagcaaagcactgaacccctgagatgatcgcatcagacccctgttgctggcagtcggcagccggggtgaacatcggcgatgctcctctgcggacaagggaatgtgggtgggcgcactcaagggctgagcccagaaggctttcctctgggggtcccagggctctgggccggggctaaacgccttcacgggctcccgttccagttctgcttccctctgcaggtgccccacgcccggctgtgacggctctggccacatcacagggaactacgcttcacaccggaggtgagcctgccacaccctcaggtcctgggccccaggggtgggcagggagtctcttccttatatgaagattagaagacactaatgttgctgacagctagagtccattcccatctctttaatctgaattgttgccatttccagaacctgattaagttgtcctctgcagtaagataaaaagacaaggggtcagggctaggggctcgtggtaatgcttctccttcccgaccctgctgcctcgtgtgaaggctgtgtctgtggattctgcttcttacaactgacccatcggttgccctcactccctcccaccccaccctggggtcacagagcttgaggggagagggtgagatgaacgggtgtgagaagctgcggttccagcactaaggtggccttttttcctctttcgaaatcagcttgtccggctgccctcgtgcaaagaaaagtggagtcaaggtggcacccaccaaggacgacaaggaggaccccgagctgatgaagtacgttgggccatgctggctctttcattgcattgcggaattgagattttcgtgtgttttataatgtaaaaaaactcctactagattcccttttcattaatacaacgggtcacctaactgaccaacgccaactttcgtttctttcatttttatggaagctctcatacgctacacgttgatacctgtgaagataggagccctggatgtcgcgtggagggcatgggtgccagattttctgggcttttcaggtctggagtatttgacggggctgggagaggcagagcacccttctacctatgtcttagggccacctgggagtgggccccagggccttgcaacctgcagaatttgtctggcaggaaaggtgagatgcaggagtcaaggaggagaaggtggttagaacaatgttgaagctccaaatcccatgtgtccatccacccacacacctgtgcagagagctggtagattgagagagccaggaggatctaaactgggagccagacactgttgggtgaaggaaagaggacatcttgggccttaagtgacccaagtccttgaggagaaaagattctcctctattgctcttctcactggggcagggtgggggctcgtgtgtctttgtggggcttataggtgaaccctgactctgtgtgttatcctacttggtgggggtttgtgtccttacaagcttattctcccaatagggaacgggtcccctgcactgcccacttttaggtggggggaatgctttgctacagactcagaccaggtgacccactggccattttgcccaggaccgaggtactttcagagctgacatctggcaaaatgggcagtgggttccccagcaggtgagcagagtggaaatgatggctctggacaccttgttgcccagggttaggggccggctcggtcgggacggggccctactatgcccgcaggaagcaggttgccctcgttgtgttacctgctgggccaagagcagccagacctcacgcccggggaggggcaacttggcctgagattgggttgctcctcctggtagtttgctccagctgtgcccaaacacccggccacactggaggagcctaattgaccaacatcacatccttcagacggggatgggcccaccagctgtttggtgtaataggctgtggcttgtttatttatttaatttttacaataaaactgtaatgaatgctaaattaacaatgcaaaattttggttgttagtactatgaaggtcgcacactaaatgctgaggtggataaaaagcattttgcccctgagaatccaggaatttgcctatgatcatataagtgcaacacctttatggatttggcaaggatcctgctggcagggatattataagtgaatcgtgctgcatttgcaaatgattaaaatcaagatcagcatttttcaaattaaccaggaaaaatggttttcctttctaatgtgctgtcaactgagctttaaaaaaaaacaagagttctgcagccgagtggagactgtgactttcagaaacacttcagcatttgcaggatagaggaaggtcctagaggctccatggcagagggaacctgactactgaaccctccgttttacagggttccttcccagccataaactttaactgcacttgtaattgcctagcatatttaaacagatgcatatcaaagcagaaactggaatggatgtgtcaggtcatgctgagggatgggatttcgtcagcatgcatgagctgtgatttggggagcctggtggaacaggagtcctttttatgatatctcctgcctgcgctatttaaaattaagtcacatcaggcgcttggtggtaaatccctttgccacagctttataactggtcataaaagtcttgcggaggttccagcatgggagtcaagaggtgaatgctccccttgccctgcccactgtccctggaggggacttctggtcctggccatgtttctcatgtcactggcacacacggcttctgccccccaacacgtgataggaaacactagctcacccaagaagcacagaggcctcaccagctcagtgcctgcccccaccgccccagcacctctcaacatgatgtccctgacagcttgaaagtctccacaccaggttttgtgagaaagagaacatacctgaaatctgaaatcctctccatgtatgcgattcaagggaacaaaaacagtttcccttgatgaaggggagtagtgttttgcaagaaagggagtgaaaataactcagatttgggccgggcactgtggctcatgcctgtaatcccagcactttaggaggctgaggcgggtggatcacctgaggtcaggagttcgagaccagcccggccaacatggtgaaacctcatctctactaaaaatacaaaaatcagccgggcgtggtggcgggcgcctgtaatcccagctactcgggaggctgaggcaggagaatcgcttgaagccgggaggcggaggttgcagtgagccaagattgtgccactgcactccggcctgggcaacaagagcgagactccatctcaaaaatactactactactactaataataattcagattcgactgtgtagagtagctgaagagccagccaccccccatttggccacagagcctcttcccagccagtctgtgcctggtgcaggtgtcccccagggtcccatggctgggccatccccatcagaggggggctggacattgaatgtgaacttcccaaagctcccataggggcccctggcagtgtctctgctctggacggggatgaggtgacctcggactggctcagggaatgtcctaaaagtttctgagggccaggtgggtgggatgagtaacaaagggaaaagaaccaagagaggggcctgtggagagagagaaagcagggtcctggccgagttggctgggaagggtctgaaacggcagcttcagagacgaggccagagtgtgggggcaaggagccggacgctgccctccctgtccaggccttgttgaccttccactgggcagcgcagccctgagccgcctctcacccctacggcgggagcctctgcccccgcccccgccccctgctaccgtcctcccgagcgcttcctgcgctgacagtgacttccctgtatgcccatgaatctcctcgtaaatggagccatggtgacctctcggggtcttgtgttgccaggtaatcagcacacagggagtgtgtgacaaacggtaatttggatgagtttcatttatgaagagataagaatgagccttgcagattgaagatcttgtcctgggtttggcgtgggttcctggatgacgtggtccctcagctccccaagtcctggtccaggtccttccctgaggcagtggggacagacactcagagaggtcatgggcctgggccctctgcgctgtcctgtttgtctctgacccacactgagcccaaggcatttgccaatctgaatttatgttattttcataagggcctctatccctctcctggaacacccagaacgaaggaaaggaaaacaccatttaaggccagcctcaggcacgagtgattatgggtagcgagtctcccccacatgaggtctgcgttcttccttctagaacatagatctcagtggtggcaaagctgcaacatctatgggcattgccccctgattgcactggcctcagtctgggaggctgtggggtgacaggcctctgctgtccctgagctcccctgcttaggggaccttgtcattcttttgtgatccataggcccccaggcctatgcttgatgcaagctcccagggagtggcctctaggtggtctcagctgacaacatggctccacattgctgagtgacacacaagtgactccagcagcaaggcttggagggaacctgagagcagcccccaggcccagggtcacggctgctggagggcacggaaagaaggtggctgtggagaccccagtcatgcaggggctgtgaggccaaagcggaagagggagcgtggcccgggtcttcacactcagcccggaagggccagttcttccctgaggctccaggacctcagcggccctccctgcctcactcagaagccctttaacggctctgagttgggctccccttgtgtctggcttgagagagtctccaggcttctcctcccaacccttcgcccctgtactcaccccggcctctctgtacccaggtgcccagttccaggctgtgtggggctcggtcacatcagcgggaaatacgcctctcacaggagcgcatccggctgcccactggccgcccgcaggcagaaggaagggtccctcaatggctcgtcattctcctggaagtccctgaagaatgaaggaccgacctgccccaccccgggctgtgacggctctggccacgccaatgggagtttcctcacccaccggaggtaactgtgcctgcaggtcctgcccctctgtgcagtcagtagggaccctcgcctggggcctggggctgaagctcctgagggagggccagaccagggctccgtgtgaccagagttgctcaagggaaaggccaggccacatgggtagcggatgggggaggctagcgggtctgttggtgccaggtgatgctgtgggttatgtcttcgccatgcgtctcccctcatacgccacccttccacatcctgatggagtccttcctggctgggtgttatgctggacacagaggccacacatgagcagagccctgggtctgacacttacgttctcttaacaggctgacaacttctcaggaaaagtttgtctcctacaccttatgccctgtccctcccattcataccttctcaggaaaagtttgtctcctacaccttatgccctgtccgtcccattcatgcctcttctttgaactctgggcagagacccctgcctgccttgcaagggagctggtaacccctctctgtcaggcagtgggcctgggcagcattcaccaactctcgcctgccctccaacacctgctccagagccgaaggaccttgcttcaccagccccacttcctgtctgtgtcctatggtgacaatgagtgcctggtcccatcagaaaccctgtgtctgggcctagggccaatgctgactcttcattccctcccctgtccctcccctccccttcttccctcctccttcccctcccttctccctcctttcctcttctccctcccttcctccttccctttccctcccctctcccctttcctcccctctcccttcccctatccctccccctttccttctttcccctcccttccccttcccctcccctctccttccttcctctcccctctcccttcccttttgcctcctctcccctccccttcccctcccctccccttcccctcccctctcctacccctcccctcccttccctctgcccaccccccacctcccccactccctccccaccccctctcctccccttcttcctctcccctcccctcccccctcaccttccccttcccttcccccaccttcctccccttctcttctttttcttcccctcccctcccttttcccttccttcctccatctacaagattaattaactcactcattcaacaaaagcatttgcaccatgtaccaagccttggagagagagcagagaaaaaaaggacaactaccccttatccttgtagagtgcattttgggcagagtaggtgggacagcctgtaaacaaataaatacgtaaattacttagtatggtgaatggtggtgcgtgtgctgggcaaaaaagaagcagggaagaggacaaggaagtcctctttgagaaggaagtagcagcttggcctgaggtgtctggggcacaagccctcagcgaagtggctggagctgggaacagcctggcccgctggacaaggttggaggtgctgagggcctggagccagggagagggagcaaaagagatgaggtagaaagttctaagccagggcttatctggctgcccgctggcaaggactcagctttcactgtgagtgagggccctggcagaaggcagaggagagactagatctggcatgggcagctggcatggacacagctgcagaagccgggaaggccactaaaggagactactgcagccggggtcagttgggcagagacttatgctgggcttcctaaggacatcttaccttgcctcaatcaacctttacttatggtgtggatacaatcacttcataaatgaaatcatgcttgagaatgcacaattgtaatgcatttttctgcttgagtgtctatatccgaggagtgatctgtgactgtcattatcaccacagcctagagggtatctcagaggcagacgcagctaggatgggctcctctgggaggtcagggctgcaaagtaccggcaagtgggtcatgtggacctcagaccccagagggagccctgctgagagcaacggtgccctggccccccgagtatcaggcagggtcagctatggctgtgccagatgaggtgagctctggagtgtccccttcccagcctctgccctgcctagatgtagcttctttttccccatagaacacagtttggccatagggaggccctccaggtcatctaggtgaggtggaacatgccttctgttaacccgtaatgtgtgaccctgggctggccgtggtgggtgaccctgggctggccgtggtgggtgaccctgggctggccgtggtgggtgaccctgggctggctgtggtatgtgaccctgggctggccgtggtgggtgaccctgagctggctgagtgaccctgggctggccgtggtatgtgacccggggctggccgtggtatgtgaccctgggatggtcatggtgtgtgacccggggctggccatggtgggtgaccccgagctggctgtggtgggtgaccctgggctggccgtggtgggtgaccctgggatggccgtggtgggtgacactgggctggtggtggtgggtgacccttggctggccatggtgggtgaccctgggatggctgtggtgggtgaccctgggatggctgtggtgggtgacactgggctggctgtggtgggtgaccctgggatggtcatggtgggtgaccctgggctggccatggtggttgatgctgggatggtcatggtgggtgaccctgggatggccgtggtgggtgaccctgggatggtcatgatgggtgaccctgggctggctgagtgaccctgggctggccgtggtatgtgacccggggctggccgtggtatgtgaccccgggatggtcatggtgtgtgacccggggctggccgtggtatgtgaccccgggatggtcatggtgtgtgacccggggctggccatggtgggtgaccccgagctggctgtggtgggtgaccctgggctggccgtggtgggtgaccctgggatggccgttgtgggtgacactgggctggtggtggtgggtgacccttggctggccatggtgggtgatgctgggatggtcatggtgggtgaccctgggatggccgcggtgggtgaccctggaatggtcatgatgggtgaccctgggctggctgagtgaccctgggctggccatggtatgtgacccggggctggccgtggtatgtgaccccgggatggtcatggtgtgtgacccggggctggccatggtgggtgaccccgagctggctgtggtgggtgaccctgggctggccgtggtgggtgaccctgggatggccgtggtgggtgacactgggctggtggtggtgggtgacccttggctggccgtggtgggtgacccttggctggctgtggtgggtgacccttggatggctgtggtgggtgaccctgggatggctgtggtgggtgacactgggctggctgtggtgggtgacactgggctggctgtggtgggtgaccctgggctggccgtggtgggtgacgctgggatggtcatggtgggtgaccctgggatggccgcggtgggtgaccctgggctggccgcggtgggtgaccctgggctggacgtggtgggtgaccctgggatggccgcggtgggtgaccctgggctggccgcggtgggtgaccctgggctggccgcggtgggtgaccctgggatggtcgcggtgggtgaccctgggctggccgtggtgggtgaccctgggatggccgtggtgggtgaccctgggctggctgtggtgggtgaccctgggatggtcgcggtgggtgaccctgggctggccgtggtgggtgaccctgggatggccgtggtgggtgaccctgggctggctgtggtgggtgaccctgggatggctgtggtgggtgaccctgggatggcggtggtgggtgacccggggctggccgcggtgggtgaccctgggatggccgcggtgggtgaccctgggctggccgcggtgggtgaccctgggatggccgcggtgggtgaccctgggatggccgtggtgggtgaccctgggctggccgtggtgggtgaccctgggatggtcgtggtgggtgacccggggctggccgtggtatgtgaccctgggctggccgtggtatgtgaccctgggatggtcgtggtgggtgaccctgggctggtgaatgatatgtggcctctgcttccagtttgtcaggctgtcccagagcaacctttgctggaaagaagggaaaactgtcaggggatgaggtcctcagtccaaagttcaagactagcgacggtaaggatggcttcctggatttccctgctcatggctgggtgccagggtaagtgagagctgtgcaccttttgtgctggtgggaagaaggttagggagatgaagcccctcctggaatgagtcacggcagaggcagatcccttcacctaagctgacagcctttcggaccttggctctgaagctcttgacacctgtgtctggggtccctggccctgaggaggtcatgcctgctgtaacctgcggctttggtgaccactgggatcagagtccagtggagcccatgtgctgtgagtttgtggagaggtgtggctcattcccccttaggtgaggaaattcagcattgcctgaacaaacttccatctttaatgtagcatttaatacctcccaaagagatttaagcctttccacctgccagccagctcggaaggcaaactataaacactcatctcacaattttcaagacagatttctccagcgcataatgtggggtatgagccccagagagagatgagctcggaaaaccaggaggggagacctctgctgcacagggggtttcagttctagaaagcaggcttccccacagcactttggcccaggcctgcctgaggcccaaagccacaactgaggtttctctctgggtcagtgttggagaatgatgaggagatcaagcagctgaaccaggagatccgagacctgaacgagtccaactcggagatggaggctgccatggtgcagctgcagtcccaggtaggtggtgccgccccccgctcctgggctctttgcccacccaacccaaacattcgtcttggggacagtgaggcatccgtcggcactcatcaaggttgctgtcagggctgagctgacggacagcgcagtggctggcacacaggcacacttaggacgtgctggccgctcacaatgcggagtccgtgaagtcacactgtgagtgccagtgggccgccggagctggttgtcccgccagggctgtggtctcattagtgttaataacactattaataatactagtcccattaagattagcagcactgtttctcttactctcattagaatgagtagtcctgtcaagaccagcggtcccattaggattaccagtcttgtgagtaccagtggtccatgagcgtggtgcggtagagccaggtctctggagccgggtttccttcccagcacccagcacagccacatgtttgtcacagctgagggacctgacaaacctttcagcctcttcctcagtcaattcctccataaaatggaggtaagaataggattctactccagccagttattgtacaatgaacgcatttctatgaggaaaacattcagcataagcacctgatccagagtaagtgccgtcgatgagagctgctgttgctgagggttaggattacaaattattttaaatgtttgtgtcatatttcctgatttccctaaaatgagcatttgtaatcagaaaaaaaaaagcagtaaagatcttattttgaaaataagagcatgccccacctgtggctgctgagtggagtctgcagccgtgctgggggagacataactgtgcccctaacagctagagggacaaagggacaaggaagtgaccaggtcccacagagaatttgggcagagcccctctgggcagggacagatggggagatggtggcctccaccaaggcagcaaaaaatgagtaacatcctccagccccacgtgtctcattactctgctcttgtctctactggcaaacaggctcatgttgactctgctctggtctctactggcaaacaggctcatgttgactctgctctggtctctactggcaaacaggctcacgttgaccgcttgttactcaagagcctgtataaaaatagcatcaccccacagggatcaggaaggattttcgctgtcatgcacatgtcgatgttgcatccccccaggttcataggcagtgacgacagagaaggagtgatggccctcccggcggagccatccccgtcccctcctggtgtctctgagtgtggagatgcactgttgtgtgggtgtccattttgtgctccctgctcctccccttctcagagtccccagggccttcatcagtgtcagtgtcgttggggtagcacctctgatttctttttatttgccaaaaccaatctttttaaagacagattattaccttttactagcatccctttggaaggactcagaaacccctgtccatctgagggagtttggtgactggtgccctctgcggaagggcaaaggcaaagggaaggcaggtccctatcccccatgcaaccctttcaaagccacatgcttgtcaccaggtggcagaagaagcgtgcttgaccccatccacagcctcccaggaatgagctccccactcctgcctcgtgtgtcacccacactgtctttctgtgagtttagcctctgcccccgtggctccctgcagatgtgcagtcaggctgggggctattcctggacaccaaaggcctcagggccaacacaaccctgggcaggttcaccgccatggtggggaagtgagaagacttgcctgtagttggcctggggaagtcgtgcttgggaggccctgaggaggctctttgtggggatttctggtgaggggaagacccaaaggcagtctgacactccacgggggggtgcagtgatttccatcttacagatagaagcaggaaacatggtgaagctaagaccacagcaggtggagtctgagattgagacagggcgctgtgaagtctgtgctcccaccccatcccctcaggacagaggggctcagaaaaccaggagtggggacttctcctgcacggcgggtttcagttccatctagaaagcatggcacagagggacgtgccacacgagcccccttcctggcttccctggagtcagcccatgtctccagagggcccttgcctttctctcctctgccagcccctcacctgtggcagaaccccctacaggaaggcagggtccctgcctcttcccccaccccagggttctgcattctcccagagggttgtgagaggcagcccagagaggacccccaggaggatgggggccaagggcaggcggcacttcgaatctctctctggcacagatctcctccatggagaagaacctgaagaacatcgaggaggagaacaagctcattgaggagcagaatgaagccctgtttctggagctgtccggcctgagccaggccctcatccaaagtctcgccaatatccgccttccgcacatggtaggcagcacgcgggcctgccggcaccacagctaccccccagggtctcttcggaaagcaggagggcagggcatctcccaccccctctgcctctgggtcctgccctaggggccctgtgcccttgtggagattctctccaccccgaatggcccgggctgttggctgtggtgggtttagccaccataatgagtagctgccataaagagtagctaatgaatccaaagcaaaatggtgattccatgagcagagaggctactgctgggatggctgcagagaggaacgcccagtgctgcctctggttggtgtgggcttgtctcaggtcacgtggggacataggtttgatgctcccacatcaggctctgcggtgtggggcccactgcatggacggagcttgctaacctggttctgttctctaggagccaatatgcgaacagaatttcgatgcctatgtgagcaccctcaccgacatgtactccaaccaggacccggagaacaaggacctcctggagagcatcaagcaggctgtgaggggcatccaggtctaggccgtgtggtacccagaagtgtcccagcccaccacaccgtttacctccctcgccctgccccgcaccgtggggatgcccaactcacagtgacttcccgtttggggcccggtgtggccgcgggcgggtttatccaaagggatggctggaaattggccgctcccacgaggctccctccaggcttggggccgtggtggccctatctgtgtgcataggggcactgaagaattacaaagtgatttatttttgttttctgaaagaaatctgaagagcagctcaaagtctccagtggaagctcatggacaaggttctcagggaagttttggagtttgcaaccacagtattcctttgtctgtcgaggctgggagggtagccgtgagcgtggtgggtgggtggtgtgagtggcatcttggcctggaggacacgcctggggcagcgtgtctgtgctcagtgagggccgatgaagaaagtgcgttttctgttttcatttaattcagttttgtgttaagggtggaacaaagctctgttctagagggaaagttaggaataggcctcccagaggatactccagacagttgacaagcatcgcagcccctgtcaggtcaaggaattttaacctgggagactcctgaaaatcagcctaatgtctgggggcagctggcgctgaggctgtgcagatgtgtatggccttgggtcacagctccctactggggctgcagcctttagaccctgggtctgggatccacgtctagggaccactctggcttctgtgcatccacccaggcccccgacccatcactgccacattctccgggtcatggccgagcttgacctctgcatccatggtgacggaggtggcaatgacatcatcaaggtcagagggtaaattcctaacaggagaccacaaaggtttcacttcttttagatccatccaatatgcgaaaaaagggtacattttaatttaatgtgttaaaaacacaatgtccctaccgtgtaaatagaatccaagtcaattgtgactgcaattccaagttagtatttaaaaatagagaaattgcacttcctggaaaaaattaaaaagtagttagtttaattattctgtaaattatttaattttgtcaagatgtaagtatttatattcacagcctcttatgttaacgtttgctatttatttaacatttttatttattaattttatactatttcaactagaccccacaccagggcaccctaagaggggaaaaaagtgaattcaaagcaaaaataactatttgactataatataggccacaaaaaatcttgatataactcctagttataattttgatgcaaccaagttattttttatatattttgttatttattcttttaataatggaatttttttaaaaagtattttgtaactgaggaattttgataatttggggattttgttttcccttggtctaatggagagaaagacattttggttttctttttccattttgggttccttttgtttcaggcacggataacagcaaatggaattctgtatttattattatttaagtgtagcgcagatgtgtgtgcttgggcgtgtttctcgtgtcgcgtttgcgtgtcggctcttgcggtggagtcctgttgctgtgagggagtgctggccgcaggcagcctcgagtcaccgccaggctcacaggctgtgccacccgtccctccgacagctccaatactgtgaccctccttcctcaggaagcgcgttgaacccacagcactccgtggtgtgtttgcagggtgatttcctaataaaagtccactctgactgtgaatcggtgctgtggtctgtggggaggacattgtctccattcttggtgagctctatcatgcaccctcctgggagcacatgcccaggaggggaatcttccatctctggtctccccttgataccacacgtgggtcccctctggtgtcagcttagccagtatctccttttgaaactaccctacctcaccgcctccacgtgtgtttctagaaggtgtaaatcattgtatcttgccccttcccacatgaccagtcatatgcaaattgaagtttttcccaggagtcttctcttagggtcagggagaataacttttcctgctgaggttgttagacttgggggtgtggaactggggttgccctgggctatctctcctggccacaggatgaagccatcagtagtaggagagagttcagacattctggaggggggcaaagctgacaatggaggtagatgtgaaggaaaagggagctctctgatgatctttttagagctcatggacccagccatgtctgaaggcactccacccttgaactgcccagttatataaggcaatggtttatttttttttttaagctggtatacaaggccaaaaagccaatgcataccagctttaaaaaaaaaaagagacttctcccctttttcattttcgtacttttgtgtcaggtggagctctagtgctcctagagtaagacctggacttgggacttctagtcacattcagcctaaactgtcaacatgcttttgacctccctggaatctggccctggtggtagtcctggagcgtccatctgatatgcaaacaaaggatccatcttcactgacaaattcttagaaattctggactgagtttccaccctctgctgtagtcagacagggtccacaacacctgtggaggacatttgatctgccttcaaggctccaactgctggttgtgggggcccaagcaggtgccagtgcccactggtgggttatgcagaacatgttcaactgtgaggaagggttcctgggggtcccctttggtgaggccccatttgtgatggggagaccagtggcctggagttgtaccccttcacgtcagcacagcagatgctggggtgggtgtgagcaagaccgattctgaagtgtcccctcagcaagctgaggtaaagtcattctggggggtatgagagttggctggagaggtggggactatgatgttcctgctaggggacacaggctgttaccatgatgttagaaagctgcacaatcccatagtttgataatggcacgagctggtcacccccaagaagattctctcacttttcgcttagaggcactggctgggccaccagcctactgggagctgagagaaagagcgtctaaagtcacaggcatgtgctctcttaggatttatttttggtatgggaccccacagctaggccttctctaccagcctgcagaccctcctgtttactgtatccagaggataaagctcaaggtttcatccagagggaggggagtgtttgccaggctctcagagtcggggtggagttctggggaagggggctactggctcccgaaacactttctaccagttgtcttctcccatctccaacagaatctggtgctaccagttattgggggttctgaggtatggacggtgttggctctgaactttctacactctggctagaattcagtgttttgtgtctcctaggccatttattttgcatctgtgaattttctggcttctaaattgcattgttgtcccctctttcatctcctcactcctgccaatgtatgccttaaaatctgtcattttaggcaggtgtaagagagaacaaaggtaaatacacatgtgcacctgctttccttacctgaatgggtatgcttccagttgatgagcacacgactgtctccctgaacagacgggaagtcagcttagtgctgggtcgacatcaccccatgagtaagggaagcctcaagttcaggtgagatttttcctattaaccactctgtctccctgaagccagtagcctctcagaggctgctaaagacatggatgtggagggtttcctaactgtcagctgattgtgaatcctgcaacacaggccatccatgctcccaggggttatagcatctgtgccattccctctgtccttcttaaaatatggaggtggagtgtggacttctctaatggagtcttaagtcttcacaagggcacccttatccatgatcgtgggtggcctgggctggtgccaggcagctgacctttggcagagctatgctctgagccactctggccctcactgcaccccaaccctaccatccctcctggctgctcccattgtctctgcctctctttctttcctctcagtgtctgcagcatgcaggtctccgtgtgtgctgacttttctaaagcctggcctctcctcttccagcacctgctatggctgcctcctcctctccctctactgtatcttcctcccacctgcttatgtgctcctggcctctcctccttcctgatttccaccctaccctgcagctgcctcagggctgtcccagcctatgtcccagcccctttcttctcattcccaaggctgatgtctgctgtgtgcagagaactcccatactgtcccccaatcctttcttccctggctctagtaccttctgggtatgcacttggatgccccagaggcatcaggacacatgcctgggtgaccacaacagcctgctcgctacgcccacctggtcctctctgggcccagcaagataccaacccccatcagcccctggtcttcactcacccagctgaaggtcacatggccatacgggagttgccaacaggggccacaactgcctgatgtgccacatgaatgtgaatgcccctgtggagcacccagcttgtgctatgtgccaccccatggggccaaccatagagcagccctgactagggcaggtgtatgatgtgggggaagaatggatggttattttggatcctggggaaagccacgcagggatacgtgcacaacagcacagtctgtgccctgcccagcatgtggacacagtgactcccctgagctcctagagagcccctcccagtaactggcatcacagtttcctgagctgtctacttgggctgattgtagctcctgagaactggccacacccctggcagcctcgtgagccagtgtaggtcttgaggggcacattgggagccccacgaggttggaggaagtggtacagtctcagccctgcagagccatccctgagcacccaccactcccacggtgagaaaccttgctgggggggcagggggtgcctgtgaagccttgtcccctgacccacaggagcccaggggcaggagggtgagcagcaaactgcagccaccactccagcacccagcgaaccctcttcatgggacccattcatctctgctcatggggcaccttttgccaaattagacacacttttgcctatttatttcatacactgtcaaaagtgttttccttgtctttaattcggtcacagctctctctgtagaagttgtcaaaatagcagaagtcaaatctggtaatatttatgactaaagatggcgaggagccatgtgagaaccaacctgctgcctaggaaagaccaacgagaagtgctgcgggttccaccccatatcccctgggccactgcttgggacccctgatgggtggataatctcagaacccatcaggcaccaaatctagaagggttccattatggctgccctaactcccaccccacatagaagtcctacttggctcagctctgagcagataaggagaaataaagactgaccattattgaatcttatccctttctacacatttgggctccttccacctctcaaccacctgtgatacaagcaataggattgtccccatcatgcagatgaagaaaccaaggcccagggaggcccagaaggccactcagagtcacacagggcttggctgtgcagccggggtttgccgcaggcccctgactccagagctggcgccttcggaaccacatgatggtgtctgcagcatattcaggaggagaagagcggatctgcacagagcagtaggatccagtgggtatccaaggggccagaggagaaggggctgctgtggtccctagtccagtgggaagggcaggaggcaccaggaagaatctgcctggcagggcagggaaagatgggagctcattgctgggttgctccagcctcaggagagttgggaaccatctgggtccccagtcaggatgcctaaagaagaggccaggggaggccaggtagatgtcattgcctctggggacaatctgataattccccagagcaggtgggactggctggagaccacgaaggctcctcgaaatggaggcagattctccagcctcatctgcctccatatttggtgaagagagctacacagaaagcatggggagaaaatggggcacaatggtggtcacgggtgcccccctgagggagtttgcacttgacctgagggaggcgcgggccagccctgggggtgtctgaggcaggggcagggaccctggtgggagggaggaagggtgccagccagtgaggctggccaaggggcaggggcagcgggaggcatgagggataagggagttcagccacggccagactttgacgctgtgtgagatgcaaacactgcgggtctggggcagtggagtgatcttgctgatgtgttttctggtttatttgtctgcacaagatccctgagatgagggtcttgtcatactaaccctggatgcccagggtcaagagagcaatctgcccttgaggcaaacagtgctgagtggagggagggaggggaagtccagggccggcctcaagtcactggggacatctggatgagtgctgagacagggcagggggctccacattgcatttcctcacccagatcccaggactgggctgcccgggagaagctgacttggagctcgctctccagacagctggcaattgggtacctctccctgtgcctggcacccctgcctgccacataaagccatcctgcaaaggtgcactgtggtcccagctcacccacctatgacacttcagggacatccctgcatctcccatctataccagccgctcctcttggcttcgagatctgcccctggtgggttgctggctaccggatgtctgacaacagctgccagcctggttcggaagtgctacccaaggccctcctgtttgcacctccaggtccagctgccactcacctggtgcccagggagtggaaacatcctctgctaccacctcgtcctcacgactagtctggtccaccacctgttgcagtaagacgtttctggggcggcccctccttcttcaaggccgatacccactcacatgttcccctccgggttttcctttcacaattcacaagaggcagtgaggagtgaggagtggtggaagagctggcacaggggacaatgtcaccaggaaccctgggtcccacatcctaagaagtgtgggtgtcagctcaaggcactcccacctcaggtgtgctgtggacagggctctgggccctgggtctgacaccacttctttgtgaggaccctgtattagccagggtccccagagaaacagaaccaataggggatacatatgtatctcttacataggcccagcaaagttgatataaaattggctgctgcagacctcttccctatgcccacgtaaagtggtttgttttaagatgagaaataatttttaagacagttgggaatgcccaaccgttttatgtacgtgaatacattcgagttcaccggtattttcagatcagcatcaagctgctgtcacctgtgtggcatgaatagcacagaagctttgacggatgtcggaaaacagactggcttgttccactctggctacggggcttaagatgaggaagaaggacttccccttccagatgaccccgtttgtctcctcccaagacagcagctgttcagcggtgacaccttgcggtaaattcctcatatgagccccccccccgccccccgcccaccccagccacccagaggtgcgagagaccaggcgtaaaggtaaattcctcatgtgagcaccccccgcccacccggaggcgagagagaccaggcgtaaggccattccttagcagtgccggtcccctgcccctgaggccctgacagagccggcctgcatttcataagaccgagggcaagtatctcagaggcccaggacacctagagcgggcatgagaccttgccccttcactggactgcaaaaagcacccaggagacgttggaagagtggcagggaaggggctgaggacgtagggcggctgctgcaggggcctatccacacatccacccacttcccttgtgaaagctttctgctcagcatggggggagaacccctggcacagcgtccatccgagcgtcttgttctgattcgccttcatccagccactcctgtctcagccacccctgaccaccaccaagtactgagcagggaaatggcgaggcagccactgtctggtactcaggagcggagctcctcctcaggaacagggtgctgtccgggcacagtggctcacgcctgtaatcccagcactttgggaggccaaggccggtggatcacctgaggtcaggagtttgagaccagcctagtcaacatggtgaaaccctgtctctactgaaaatacaaaaaaaattagccaggcatggtggcgggcacctgtaatcccagctgctcgggaggctggggcaggagaatcgcttgaacccgggaggcagaggttgcagagatcgcactactgcactccagcctgggtcacagagtgagactccattaaaacaaacaaacaaacaaagaatggggcacttgttgtaaaacccttagaggataaaaaaaaaatttttaattgtcattgcaaaagcgacattgtccatcatacaaacaaacatcacagaagtaaattaaatgagaagttgtgtccttagccagagctgagacatgctaagaaattaaccttacatatttacccatggagtctcatttccagagtccctttttaaatgtagagctactcttccatctgcttcatttgctatctgcctgaaaaattccctttaacatttcacattgtgttggtctgctaatgaattcttttagctttgtatgtctgagaaaaatctttcattgtttaaaataaatgacaaagtttatttttgagagcagtttgggtttacacaaaatttgagcagatagtaccaagagttcccatagacccctctccttattattaacatctggaatcactgtggtatgttataacaactaatacaccaatattgatgcattactattaactaaagtctagtctacagttcacattagggttcactctttgtgttgcagttacatgttttgttgttgttttgtgggtttttttttgttttttttttggagacaggctcaggctctgttggagtgcagtggcacaatcactgctcactgcagatttcacctcccagcctcaagcgatccttcctacctcagcctccagagtagctgggattacaggcatgtgccactatgcccggctaatttttttttttttttgtagtgacgaggtctcgctatgttgccaaggctggtcttgaactcctcctgcctcagcctcccaaagtgctaggattacaggcatgagccacagcacctggctagttatatgggttttgactaaagcataataacatgtatccaccattacagtatcatacagaatagtttcagtgccctaaaaaccctctctgctctgccagttcatctctccctctccctccaaccccaatccctggcaaccattgatcttttcacagtttctacagttttcagttttcccgaatgtcatatcactggaatcatatagtgttaatatgtagcctttttatcctggtttctttcatttcgcaataagcatttaagtttcctccttgtcttttcatgtctcagagctcattcttgttatcattcattcatactccattgcttagcatgtatgagtttgtttattcattcacctgttgaaggacatcttggttgtttccaaattttggaaactgtgaatacagctgttataaaaatctatgtgcaactttttgcatggacatagtggttgagtaagcacctaggagtgcaaatgctggatcataaggtaagacttgtgtcttccacagagcagaagttttaattttaacaaaatctaccttaccaatttttactttcacggattgtgtgtttgacttgtcaaaagagtcatcactaaacccaagaccaccaggattttctcctatattattttgtagaacttttatgtaaaaagtttgagatctatgtgtagttttttggttttttgtttgcatatggatgttcagttgtcccagcatcatttgttgaaaagactattctttctccatttaattgcttttgctcctttgtcaaagaacagttgactgtatttgtgtaggtgtatttctgggtttactattctattccattgatctgtttgtctcttcttttgccaacaccacactgtcttgattactgtaacgttataggtcttgaaatctggttgtgtcagttctccaacttcgttcttcttcagtactgtgttggccattctgggcattttgcctttccatatgcactttagaatcagtttgttgatatccatgaaataacttgctgagattttgattggtgttgcattgaatctacagattaagttggaaataactgatagcactgctgagctttcctctccataaacatggaatatctgtctatgtaaatatttgatgtcttttatgagagtttggtagttttcctcatatagaccttgtacctattttgttaggtttatgcctaagcatcccattttttggtgctattgtaaacagtattgtatttttaatttcaaattccaattgttaattgctggtatataggaaagcaactggcttttgtttataaccttacatagtagtcccccatctgtggttttgctttccatggtttcagttacctgcagtcaaccacaattcaaaaacattaattggaaaattacagaaataattcataaattgtaaatcatgtgctattctgagtagtgtgatgaaatctcgtgccgtcctgctccatgctacccagtacgtgtgccacctttctgttcagcatatccatgccatatacactacctgcccattaatcacttagtagctaacagagagaccacactcatgtaacttttattacaatatattgttatagttgttcgattttattattagttattgttgttaatctcttgctatgcctaatttataaattaaactttatcatagatgatccatatgtaggaaaaaacatagtatatatagggtttgattccatccctggtttcaagcattcctatatgtactatagagtttggtacatatccccaacagtgtcttagaacatatcccctaaggataaggggggggactgctgtatccagcaaccttgctgtagtcagttattagtttctggagttttattggagattcttcagggtataatacacagttaatcttaccacctgtgcaaaaagacagttttatttcttccttctaaatctgtaacccttattttcaagtcttattgcatcagctaggacttctatatgatgttgaacagaagtagtgagaggggacattcctgccttgttcctgatcttaaggagaaagggtccactttctcaccattaagtatgatattagctgttggttttctgtagatgttctttatcaagttgaggaaatgcccctctctctattactagctgggtgagaatttttttttttttttttttgagatggagtctcactctgtcgcccaggctggagtgcagtggtgcgatctcggctcactgcaaccgccgactccctggtttaaactattctcctgcctcagcctcccaagtagctgggattacaggcatgtgccaccatgaccggctaatgtttgtatttttagtggagacggggtttcgccatgttggtcaggatggtctcaatctcctgacctcgtgatccgcccgcctcggcctcccaaagtgctgggatgacaggtgtgagccactgtgctcagccagctgggtgagaatttttaacacgaatgggtatggagttgcagttaggcatgatgaaaaaaatgtggagctggatagtagtgaggttgcacaatagtgtaaatgtacttcatgtacacttaaaaatggttcaaatgataaatgttttgtatactttaccatagtaagaatagtgtatttcgaagacaacaacacaacctcccacatgtggctctagctacttgctccccagatacccagccgcacccctgcctcaggcccttgcatgaccttccctccgtccgaggctcctcctgcagatacaacacagatgagtggagagatgcaaggggataggcgaggggacactgaagacatactcagaaagctccccgtggctgggtgtgggagaagcctggaggagggtgacagcagcagttggattcccatccaccttcctgtgcttactactagctggtaagtacaagaagccagcgaacctcttgcagtttcagttccctcatctgtaaaatggaggtatcagtgtcgtcaagccaaaggctgccaggaacctgcctgtaattgaatgagttgggattatcactcattgcagcgagagggatgcagatcatggagaactgcaaggcatctcagtaagaggtgtcgggaaaagttactaaaggttatgggcttgagttgggtgatttttttcatggattagatgctgtcaggaattgggggagtggatggggggaaagggtggttctctgggcatctcagtagatgttatctgtgaggaggccagggcagagggaggctcagctgtagctggtagaggagcgggggtcattgttactaacttggagatgatatgtcttagattttgtgggtggcacagttaccctgtttttgtttgtgcttagacaaaattatgacgtggccttggatcatgatggtgctcctctacaaaattatttatgtccaacaggagaccccatggcctcgatctgagtgccaggccagctcctgatgtcacggtccacttttcttcttggaggtcatactagtacctatttcatggaaataacccatgtagagtgctcagtatataccctgtgaagggttatgaatgctgatggtagtggaagctgatgtggaggggaatggtggagacaccttggaaaaccaagcaagagtctgaagttgtggcaggccgggtctcactaacgcaggcctccattacagctgtcccagcacggactgagtagccaggttaaacattaaaagctgattgagccaatgcccttatacaaaggttggaatgtaacaaagagcccaccaagagttttgcctaggctcttcctgggccttgaagcatgacaagataacgaaggaactcttaacaggaccctttttaggattaaacaagttgtattagggatctgaagaaactccccaggcctccacaaacaagtttatgggggtctaaaggaattccccatatcattatgatttagcaggagacaagataagggtaatcaccccagcacctagacccatttagattaagtaaacttactgaggctccagaagagggtcttcaggactcaaccttagtcatagattaaaagaagttaatcacttatgtctgtagatgaatgcacacttacatgtagacatacagcttagaaggtatacgagctttggaaaactttgtaattttgagttggtatggtgataatttccaggccttctccttgtaaccggttacagaaataaaacctctcttactctccagctcatttgcatcttgttattgggccaggagaagtagtagcccgaccctcagttgggtccaggaacaaagggagtgtctgaagacagcagtgatgtgatcacctgttttaggaggaccactcgccagagcccaggggaatggtgggaggggtggggagaggtgaggggagctgggacagggcaaggagggatgtatggaggacgtgtcccctggcagtaggaagagagtcaaggatgactccagggcttctgtaatttgaaacagtcacaaataaccacaagctctcaggtggaaggacactgagagccccatgaaggtcatgaggtggtgggccacctcaggtccgtggatccaggaccatggatcaacaagagaagtgaggtctccctgggaccacataacgtggtgaaggcaccggcctttggttttcaaactctgctcctaagtggagctccagggtctggggaggaatgccgagttaggagggaggcgggaaccggagacccaggcccactcgtccgccccagcgacgctggcacttgcacatatgaggcggcttgcatggctgtgcttgaagaaagggttctgcagctacagcctatctgcaaagccccacgcgaagtttgggcaatgggctgtgtgaacccagaaaatgggagacaggtctcagttaatttacaaagtttattttgccaagggtgaggacgcgcccgtgacacagcctcaggaagtcctgacatgtgcccaaggtggtcggggcacagcttggttttatacatttagggagacaggatacatccatcgatacatgtaagaagcacatcggttcggtctggaaagacgggacaacttgaagcaaaggcaggaagactccaagcggggagggagcgtccaggccacagataggtgagacaccaacggttaaattcttttgagtttctcatttgccttttcaaaggaggcaaatcagatatgtatctatctaagtgagcagaggagtgactttgaatggaatgggaagcaggcctgccctaagcagtttcctgctggagttttccttagtgatcttgggggcccaggatatcttcctttcacagctgatttcacaaagccggctgggtaggagggccccagggccgggtggccgtccgcgtggcagggcgggggtcccagggcggctgtgcttggtgctgggaggccgcccgagggcagcgccggccccgagtcagcagccgcagggcaccctggagatgcggaacgcccccagccgtgggtcagcaaaggcgtctcaggtgacccttagggagggcttctgaggcagcccgtgcggggtccgtcctggctgagcactgcgcggacggcgcgcccgcgagactcggacccggcctagggctcagcgagctctcagcggggcgggcggacgcaggcagcccaggggagtggggcccgccctgcgccgccatcacccctttaagtgccaggcccgcggcgcatgcgcagtcaggccgttgtgcgcaggcgcagaggcggcggcggcggcggcggcggcggatgtttacggcggccgaggttggagcggcgctgctcggccgcggacacacgagggacgcgcccgaggagctgcaggtggcagcccaggcggtccgaacccgtcggccggccgagcctggaggtagagccgccgccgccgccgccgcccctcggtccggcctgcggcgagcgggtggtgtgtcccctcggccccttccctcctccttccccacccccggcacccctgcgcccggagctctcctctgggggcgtcgctcctccccacctcgggcaccctcacctccccccagcggcctccagggcgtcccgcgtttctctctccgagcgctcgcggtttcccgtcggtctctcccggtgcccgttgctcactcacactcttgggtctggttagtccagacctgcagcttgtctttgacttcccaagtgggaaacgtttgcagttccaaggcaagccaagagctaaggtttagaacaaagtctgccttggaccctttcagaagatgacaggattttttaaaaaaataattgcgcccccccgccccgtgccttggagatagtaagaattggagcagagcactgggacttcaattcacgcatggaaagagatctttgttagttggaggaaggagaacttgcctgagcttcgggcctttgttttgtttttgtgagagggacgtgtctcctaaatgaatgtttgctccagcgttgcacctcaaataagtcacctaaatatccacgccctctttatccaccccctctttactcgtgtgactagaatagttttcatttttcttctcaagggaatggctaaacagctcctatctgggcgtttgatagactgtcattcaagaatgagtgaagttgaggtgcctataagcaactcagaaattgttgtggccacgcttgggggaaatagagccctacactcaggtgatgagaggagacctcagaggtgaccgatccagggccttgctccctgcgccaccccagctcgtacctccagtggaacttggctgggcttatcaagagctcctttcattcattgcaacttcatttgttagaaagcttctctgtgtatttagtaggcattgtctccaacatgtaccactggtctggcttttgttaggcccattaatagtgtacatgtgacagcctttcaagtataggtgctccccggcttacggtggggtcgcatcccagtaaacacatcgttaaacctgaagtcgaaccatccgaagtcggagaccatctgtatttgaaaaaagtccctttgcattgcttgtaagagttctggttttcaaggtgagaaatctgtttgtgtgtttgtttgatcattctgcccaaaggagatgtggctttgggtccttttccccactcatcttccacaatgaattactttgtccatattaccctaaagaagtgacatccaagttggaatgtgatcttccgtatgtcgcctcccaaaaccccactaccatagcttcatgcttgtgttgacacagccacaatcacaactcaggtgtcagttctgagaccttcccatgcctgtcgccactcagcaagtgttcttcatgtgccctggcagttcgcattgtaaggagcagccaggttgttatggactgttgctagttaccacagagtagtgaattatattaaggattaattacagcagacaatgtgcacagtatcatcgagtgcagcgttctaaaaatgattctacacttttactttgaaaaattggatttgaccagattgtagaatctgggtgaaaatgataggatttggtttggcgaagagctttgttgtcggtgtttttggtgacatcatgactgatcatatcgatggttttcagtgcgagggagtgttagattaccagacaaagatggtaataaatatcagaccccacagctattcacatggatcctaccagtggcaataggtatagatagggttaccccatcgtcaaaaggttaccggtgtgttgtgtggtaaagaacgttgctgtcttgagtatttttaaaagctgcactggtgtggtattaaaaacacaggccttttgccatacagtcctgggtttgaatgcagccccctcctcacaaactggctatgtgatcatgaacaaattaaccggccagctccaatttgcttcttaatgttgtgaagtgtaaatgaggccatgactggcaggtggtacctggaaaaaggtgcttgtttttactaaaaagctgtctgaactttcaaattaaggcagagttcaaaataagtgatagttacttagtggaaaatgaaacctatccaacatacagtttgaggttaccttctagagatgtggcattgagacaatgttggaacattatatacaggcttctgggtgaagaggtggctttgactgaggacggtatgcgattttccagctcttttcctaaatagacccttaagcatccaaacacatgattccgcttttaaccactgacccaaattttaagatgactgtggtaggctagggtgcagcctcagaactgagtggcttatccaggattaaagttgacctcattaggacttaattccatctaagtctaagtcagctggctgtggaccgtaatctaacaagggctccgaaacaattcaaaaaattcaaaaagggtgtgaaaatttaatgactggaccatcctattgatttgcaaaacctaatattcagctctaaaatcttgagtgtgaagattgagtgttccaccataaaaatagaagagaatttgtgttaagctatacccttcacactttttgttcacttgtaagaaactatgtgattattttcattcctgggaaaacctcccaccgctgtctccagttgtgtacgtgggtgtgtatgaaatccgccccaggccccttgtcaccccacagtatttctttacgatcctcattctactgttagaaatccagaggaatgtgaggaggaaagcaagtataaacttcatcataattataacaagttgttaaaaaggttgtgttcatttcagaaaatgtcttcatgaggtctggtggtctttttccctgacaatttgtatctggtgttttgtaaagcattaccattttatatgaagttaaagcagttactttgaaaaagttacatggggtaagtataaaattggaaaggatatttttgtagttttaagaagagtaagacttctccgcgtgaaaaagtgttttcttgtgaattagctgaagctaccctgtattttaatagttaggctcagaggtgacacatgctgtgctttttcttcttgaaggcaggttgggagaaggtaagacaagtagttgttatttttaaagagctgggaaagctgcgtatcatgcaattgaggaggggctgtaggaagttctggtagcagcccctcctacacttaaactttagccaggaagctgattttgcatttgttagaaaaaggtatttgtcacagtacgttcaatttgggaagagtgttttcttgctgtttttgtctaaaatttgaacatcaaaatatccaaatcaacaggtcagatggattgcttgacttgggtgggtacttttgtgtatgttggggatatagaattcccagatgtaatataggacaccacctaaagttttttttcttttctcttttttttttttttttttttgagacagagtcttgctctgttccgcaagctggagtgcagtggtacgagctctgatcactgcaacctctgcctcccgggttcaagtgattcttctccctcagcctcgccagtagctgggattacaggcatccaccagcatgcctggctaatttttgtattttttagtagagacggggtttcaccatgttggccaggctgttcttgaactcctgacctcaggtgatccaactgcctcggcctcccaaagtgctgggattacagtcatgacccaccgcacccggcctaaatttgaatttcaaataaacgtcaaataacttttagtattgttgtttaccttaatttccaattgaactgggattttttttccttctaaatctggcatctctgggtggggcaggggatgaggtgggtgttgacaaaagataatctattattttcagaattcagaatttcaaattggtatctgtttagaacttctattgttctgctcttacctttaacataaatcgctctttttaaacatttttaattatagtattgcctaagtgtaatcttgaacatgggcggtgctgtgagtgctggtgaagacaatgatgagctgatagataatttgaaagaagcacagtatatccggactgagctggtagagcaggctttcagagctatcgatcgtgcagactattatcttgaagaatttaaagaaaatgcttataaagacttggcatggaagcatggaaacattcacctctcagccccgtgcatctactcggaggtgatggaagccctagatctgcagcctggactctcgtttctgaacctgggcagtggcactgggtatctcagctccatggtgggcctcattctaggtaagtgtggaaggagagtctgaaaactcatctgtctcagggaaggaggcatctcctttgacagaaaatgtagtctgctaatggcctgcctgggtcgagaccgcagccttcccagtagttatctgacattgacacatcactgggtggtggatagagggatgagggaggaaggcctgcatgcatctcatgggccccggattctccagagggacctctcctgttctctgtcccctcttcctgtgctgccacagcctgtactgcgcacctgccctctggacagcggaggataaagacagttgtgtaaatcttgaccccactgtgatttctcgatttaattttatcactcattcttccttgtcactccttctctaaatcgatggtaattaacttgaaagtcctttcggagtacttctaagcagtttttgttttgttggtttttttttttttttttttttgacagttgtgccccatcgtctaggctggagtgccgtgacacgagcaaggcccactgtagccttgacctcctgggatccagcaaatcctcctgagtacctagggccacaggcacgcaccaccacccctggctgatgtttaaatgatttttagagacggggtctcgccatgtttcccaggctggtctcaaactcctgggcgccagctctccacctgcctcagcctcccaaagtgctgggattacaggcatgagccaccatgcctggcctacttttttgttttaatactaagagtaatacctgtagattttaaaattagtttcagggatggaagggatttcactatgaagctatttagcctattttccaaacaaatgagttgtgagactgcacatggaaatatggctatttttaataatagcagataactaaggaaaaacatcacttggtgccaaatgctgtgaggggcggggaaggcatctgtttttaactcagtagggtggaaaagttttgccggaggggtgataggagctgatctgtaaacaggaagcaggggccaggctgctgaggcaaagctggctgagaagacgctggatgaaaccagtgcagagaagctggagtctgtattttttctaaatcctgttagaactgacaggatttacgggtggactgtatatgcttgtgaaagaaacgtcaggaatgtggcttggcttggtggttcatgcctgtaatcccagccctttgggaagccgaggtcggaggatcgcttgatcgcttcaagattgcagtgagctatgattgcaccactgcactccagcctaggtgacagtgagactccgtctataattgatttttgtggatatggaatgataattttgttttttttttctaagtctgtataaattggaatttggtgaagttttgagaccgattattttggctttatgctatagattgctaccttcaggtgtaaaagtgtgtagatttttataatgctttttgaccgtaacttctcttcaattgagactgttgtgatccctgtgctttgagaagagaacacagtgcccagattatttatcatttttgaatttgggaattgtgatttcctccaacgtagctgaaaaataggggctatagctaaggtagaaccttggggagaaataggtgatcaagctgactagattagaaatactataggaaagagccaaaatgcttaggaaaagatgacttaaagtaagcctgaaatggtggggcgtggtggctcacgcctgtaatctcagcactttgggaggccgaggcaggcagatggcttgaggtctggagttcaagaccaacctggccaacgtggtgaaaccctgtccctaccaaaagtataagaaagtacctgggtgtggtggtgcacacctataatcccagctactcaggaggctgaggctggagaatcacttgaacctgggaggcgaaggttacagtgagcagagatggtgccactgcactccagtctggctaacggagccagactccatctcaaaaagaaaaaaaaaaagtaagcctgaaatggccttgctgtacttgacatcccctagaagttataaggaaaggccttccaacttgatacagttgcttttctttcctgaatcccctgtttactggaaatttcattggattttgggaggagagaggtctgaaggaaggaaaggcctgttttctgctgtaatggatgtaacatgctgctttgatgcagttgaaggaagtgacttcagggtttgctgtcatggatgcgtgtcttggctgtgtctccagatgctgcagcttttattcaagcttaatagcacttggtgcagagcactccagagtgaaacctcattggcttcccggcgcctgtggatgtgggtctctcatctgacggagttctttactgtgacccccgactgcctttcgcatggcctgagcggcatcctgggtcagccctgttcctgtgcttgctctgtgggctcctctcccctttgctcagggctgtccttacctttgtttgtcatcaaccaggggagaatacagtagctactaagagatggtggctcataagtcacctacctgaaaagtgctgggtgattcggaagcagggcagacctaggagcggctctgccaggggggcctcgctgctctggtttcatgccgtgctccagtgctgagtcccaggtgccgtgttcctgacaccccccggccaccctgtgtcctcctcccctgctagtcatctttgtattaagcaggtgggtcgaggtatttgtgttactactgtttggtgttaagcttcttgggaataggaaccatatctcatatctgttactagaattaactgcttattaagtgtttgatagtgaaggtgaggggtcagtgaaaataagatgagtgggaagaatcaagcgctatttttggtctctggcagagtcgggaattgaagtcggagttgtcagaaggtcttgacgttcagagtaattcaggatttgatgttgtaaacagtgaaaaggggaactctcaggtagggtgtattttgacgaggtaatgttttagcagcagctctgtgtatgaaatacgtggagagaaaagagcagcaggtacagttgtccaaatgggggccagggaagccttggcctgggctggtggctgttgtactaggagggcccacacggtgcaaaggtgtgggatgcacagaaggttgcccatttcttagcatttctgttagattgtagggtccagtgctacatgatcactgtagtagtatatctgtctaccaagtaaagtcctacgtgccttgtgatttttacatgtagatttaaaaagttgacgtgtaacttacccatagtaaatgaacaagtgtgaagtgtgaattctggtggacttttacatatgcatccaccgccatataaactccagccacagcaagatgcagagttgaatcagcaccccaaaaggctcccatgccccctcctcctcctagaaagttcaccagtgttgcatcttccagaaaggtgatgaccgttttgcctttgtcggcaaagatgaattttgcccgatttttaccttcatgtaagtggattcccgcaacagagagacccatttaagttgagtgtcaatactgtgttcccagttaacgtaggggcagttttatatcgggggagcactgtcatcattaagtggacttgtaacatttctcagttgtatttcaaattactgataaatatcctttgatataaaaatgtttcattgtgacttggaagcatagttttatcttaatgatgatgattgaaccctgttttgtgaatattataatgctcacatctgagtgttctgggcaacttttcagggaaaacagaatcgtcttaaatgttacctctggacaaacaggtgaggcctgtgtcagttccatttgcaaatacatgtttcttctttagttcattagtaagacctgaacacttggtttgtctccattttcaaatgattctttaaaagtttgtgagcagagaagcccaggcctcaagtatttacgatgtggtgagccgtgatactgtgatgagacttcaaaactttgtgaatgtctgtagttacacatgttaagtcagacgtgttacagttggtagaagtgaacagatgagcaagagttcttactctggttctacatgttttcttattcttaaaccttttaggtccttttggtgtgaaccatggggtggaacttcactcagatgtgatagagtatgcaaagcagaaactggacttcttcatcagaacaagtgatagttttgacaagtaagatgaaatactatccattggctcagatgatgtgaactgtaattttacaaagttttgatcagatagaaagaaatcatgtggtaggaaacataattaaactgtggtgggatgattctatgtgcctgttctaattttcagaaaagattctgtgttttgagggttttagggtatttcaaactgttacacatacataaggtgttcatttgctcaatattcatgtttcctgttgaagacaactgtttaccacctagtttttcctaaaataaaattgttgcatttgtctctaaacagtatatgtaactagcttttgccattttaaaagaaggcattaaagttcttattttagggattaaaatttttagaaacaccaagtgcagtttcaccacccccacatctcactcattgtgtagtattaatagatcttacataagatgataagaagatgacagagacagcagcgactggagattgtgtgaaatttggataaaacttttgatattcactttcatactattttgtttggtatttctagagttctagttatatagtataattctttttggaagtaattcttggacatttgtaattcttttcttccagctcctcacactgtaaactgtgttacattgctgtgggattttaacctgtggttagcatagatttactgtatagacttgttgcaatgtgatacttttagttgcaggaagcattttttacttccaggtttgacttctgtgaaccttcctttgttactgggaattgcctggagatttctccggattgttctcagtatgatcgtgtatactgtggggctggcgtgcagaaagagcatgaagagtacatgaagaatcttctcaaagtgggagggatccttgtcatgccactggaagagaaggtcagattcccttcataactgacatttctgcacactgtgtgccaaggtctgttctgggcagtgtacggatacttactcttttaacaatttcctgcatttcacaaatgaggaaacagaggcagggacaggtgagggagatgcagggtcacgcacatgccctagctggggccagaagctgactcaggtgggtgcttcagagcctgcacgtgaaacgcttttctccaccttccttctctgtctctctctttttccttcttctgtcccttccccctcacctccctcttccttccccttctccttccccccagctgttctgagttttaattctaattgttaatctattataattgttctgctgttagaattatatataaaatagagtcattctattctcatcattagtctaattgttacatgccttgatgttatgcatttgacaggaatcctttgcctagtgagagtcttgtccaagtttgctgtttggtcatgcttgtttgtctgtgttactgtatgtcactgggaaaaatagtttatagtaaatgaacagattaatcagacatgaattggtcaccaagaagaatgtctcccagtcacaaagaactaggaaaacacaaataataaaaattaggaggttttaattgttttaataaaaatttggagatgagatcttgctctgtcatccaggctggagtacagtggcatgataatagctcactgtaacttcaaactcatgggctcaagtgacccttccgcctcagcatcccaagtagctggcactataggcacgtgctgccatgcccagataaatttattttttaaatatttatttatttatttatttatttagagacagagtctcgctctgtcgcccaggctggagtgcagtggcgcgatctcagcttagtgcaacctctgcctcctgggttcaagcgattcttctgcctcagcctcctgagtagctgggattacaggtgcgtgccaccacacccagctaatttttgtatttttagtagagacagggtttcaccatgttgttcaggctggtctcagagctcctgacctcatgatccgcccacctcggcctcccaaagtgctgggattacaggtgtgagccaccgtgcccggcctaattttatttttttagtgatgggctctcactgtgttgcctgggctgatcacaaactcctggcctcaagcaattgcctcacctcagcctccagagttgttggcatgagccatcacacctggcagaatattgttttaaatgtctttgcttatacaagtgatattacagatctttgttgctatacaaaatgcattggattttttattggaattgtatcatctcgataatttgaggattgtggccatctttacaatgtttcatctgcttatctagaatatgaaataggggtttatatagttttatttaaggttttatacatcatttattgattctattgaaatacttgtttttcattgtaactagaaattcttttaaaaatgtttaaataaacatatgttttgctggtatacaagaatgtttgttgatatttacttagtacgtggcgacttaatccttttagttataagattcatgacatagaatcttagtttttagaggatttactgacttagatatttttagaaaaggccagcatataatcatagcatgaaagaactgaccagaaatagttttgtgacctgtgtaggccacttggagactgacccagccacacagagtgcacagagggtcatgtctaattgtggtctctggtgctcgtaatactttaattcaaaagaaatgttttgatggcctacactggagtgtgttaagccaccagattccggtgctttcgtgggggtgatatcagggcaaggctcatttaaacacttcagtatttgtctccaaagcatgaggataattgcccaggcatccaagatgacaagtttgcatttaaaaaagtaacagggattctgtaacagtatctgttactacagtgcctatcaggacttagccaccctcccaataacaacaggtcaggattcagttggttggtaacgtatctgtaattactttttgctttagaacagacccccttttcaccctcaatattgacttttttggagagtgctagagcattgtcttataagaatccccacactgtctatgtggttgtttcctcttgctatcctataactagtttctctataatatatagtttctgtaaacagaagttaggcctagggcctgaatatattcaggttagcatctttgcaggaatattcataaggtagatgtacttcatggcacatcacattaggggtccgtatgtcaagatatttcattttattgtaagcatttctatgtatttttatagtatgtataggaatgattaaatatgagctaaatagtagccaattcttttgaatattctcattttgtctctgggatagttgactaagataacacgcacaggtccttcagcttgggaaaccaaaaagattcttgctgtttcttttgctcctctgatccagccctgccattcagagtcaggaaaatcaagacttgtccagttacgtaagtataccaatctttacttattttatcttttagatcttttctctctggttagattttaaaaggaaacaaaatttacaacaaaccttttgatattaaaaagcaccactcccatgctgaaactgtaaaattctacaagcaatttcaggcattataaaaattataatctatttttaacctatttcaggtaattttagccgtcttttaaatctacaaagagctgttgccggtcacaccattgaaagccgaggacgcacataaaagggagctcattttgccatgtgggagacttagcctatttgccgcctccactgggaggggcttacagaaagagccatcagccagagggctcctacagagtcatggggcttctgctccccagggcgccaagcgcctgctgcctcatgggtagacaaggttagagaacacattccagctaatctgctggggtgtggataggagactttccgtggaaccttacacagccgagcctttgtgtttcactatttcaggatgcaaactgagcaaggaactgataccagggccagcacgacagcaaaacctcctaatgttttaaaatttaaacggctcacacagaaatgagagttccaattgattttatttaaaataaaactatcaggatgctctctgatcatttagaaaatttggaaaatgcaaaaaataataggaagggaaaagttttgcatagtcttacaaaaaaaaaaaaaagttttgcaaaaagttttacattttggcaaatctcttccagaaaggttttttgatttattaggaatcacctatgaaatgattacactttgctttggtctctactaagtacaggttctaagaactagacacggttcttgaaatttgataatgagcaacaataggacatgcaaaacggttaattagggaaggtttggcagagggtgatgtctgtgcttggccttcaagggcaaaaaggagttccctaaagagagaagaaaggggagaaaagtaccagcagtggcaggacataaatcaaaatgcgtgttccccgtgtagtcagagttgggactgatgggagaaactactggtatgtaggttagaattgggtttatcatgtaggctggggagagctatcagatgctttaaataaaagatacagtgcctgtgtatcctggataagcctggttgtcgtcgggtggagggtgaatctgtcaaatgcgtgctctgaaagtctcatcagaataaccttttaagtaactgccgcccttggcggggagggcaccagcttccagagccttagcagagtttgggaaggcaggggcatcttcggggtatttatgagactttttgagggtctggttgaaacgagccgttccctgtggggttcgtctggccgatgaagaatcatgacaatgtggtgggcagtttggatgcttgttttgaggagatggctttgaagagagtgttagatgatcaacagtaatgtgatgcttttagagtttctgaagtgacccattgagttacttgcaacttttcttttcctgggccagtttcctatactagtaaattcatgttggtaaagacagtggagtagaaaactctgtgagtgtagacatacgtgatatggggtcatgtgagtgtagatgcgtggtgtggggtgtgtaagtttagacctgcacaatatggggtcaaagtgagtgtagacgtgtgtggtgtggggtcgtgagagtgcggacatgcgcaatgtggggtcatgtgtggacatttgcagtgtggggtaatgtgtgtgtgggtgtgcgcggtgtggggtcatgtgaatgtgggcacgcgtggtgtggggtcatgggtgctggcgtgtggggggtgtgggcgtgcatcgtgtggggtcgtgtgagtgcgggcatgcatggtgtgtggtgtgagtgtggtcctgcacggtgtggggtcccgtgagtgagggcgtgcacggtgtggggtcctgtgagtgcgggtgtgcacggtgtggggtcgtaagttcaggcgtgcacggtatggggttgtgtgagtgcatggcgtggggtcttgtgagtgcgggcgtgcacggtgtggggtcttgagttcaggcgtgcacggtatggggtcgtgtgagtgcatggtgtggggtcgtcagtgcgggcatgcacgttgtggggtcgtgtgggtgtgcacggtgtggggtcgtgagtgcgggcgtgcgtggtgcggggtcatgtgagtgcacggtgtggggtcgtgtgagtgtgggcacgtgtgatgtggggtcatgtgagtgcggatgtgcacagtgtgggatcgtgtgagtgcacagtgggttgtgtggacgtgcacggtgtggcgtcgtgagttcaggcatgcagggtgtggggtcgtgtgaatgcgggcctgcacggtgtggggtgagtgtgggcacacgtgatgtgtcatgtgactgcggatgtgcacagtgtgaggtcgtgtgaatgcgggcgtgcatggtgtgcagtcgtgagttccggcgtgcacgatgtggggtcttgtgagtgcgggcgtgcatggtgtgggatcgtgtgagtgaagatatgtgtggtgtggggtggacgggttagctttcagattgaatggaagcaggaacaagtggaaagctgttgaaattttccaggcgagagataaagataaaaactaagacactggctgctacagtggagaagattcagtgatacataaaatggtacagtccttctgaggaagggcacgtgaggtgttcgttgtgatacgtacaatggtacagtccttctgaggaagggcacgtgaggtgttcgttgtgatacgtacaatggtacagtccttctgaggaagggcacgtgaggtgttcgttgtgatacgtacaatggtacagtccttctgaggaagggcatgtgaggtgttcgttgtgatacgtacaatggtacagtccttctgaggaagggcacgtgaggtgttcgttgtgatacgtacaatggtacagtccttctgaggaagggcatgtgaggtgttcgttgtgatacgtacaatggtacagtccttctgaggaagggcatgtgaggtgttcgttgtgatacgtacaatggtacagtccttctgaggaagggcatgtgaggtgttcgttgtgatacgtacaatggtacagtccttctgaggaagggcatgtgaggtgttcgttgtgatacgtacaatggtacagtccttctgaggaagggcatgtgaggtgttcgttgtgatacgtacaatggtacagtccttctgaggaagggcatgtgaggtgttcgttgtgagacgtacaatggtacagtccttctgaggaagggcatgtgaggtgttcgttgtgagacgtacaatggtacagtccttctgaggaagggcatgtgaggtgttcgttgtgagacgtacaatggtacagtccttctgaggaagggcatgtgaggtgttcgttgtgagacgtacaatggtacagtccttctgaggaagggcatgtgaggtgttcgttgtctgtggtagacctgggtctgtgggaggctcaggattctggtccggactggagtagaacctggggagctattggctggcctctgttatttaaagccacagaatggatgtaaaaccaaggactagcagtcatactgagacggtgaaatggtggaaattggaaccttagggagcagcactgggctggatggaagaggaagagcctgcaagagaaaagagctgcggaggtcagagggagcggctgtgccttgggccaggggagcagtgagccacgttccttatcccaagcagactccttggagatctggagaggccggagctgagggccgggaccccgagggcctcggaaggagttgtttcagcctcttggggcaacagccagatcccagtggctctggaagtaatctgtctagatgtgagatgatgaaggaaggaaggatggctgtacttgaggagggagccgggtcacagatggggcaagaggcacgatcgtggtgttgagtgaagagaaaggactgaagacaaaggaagtgccggagcctgtcctggagaaaggagaagggacctcttgtctgtggagtcagaaaagcaggaaaggttgaagggagaaggtgctacttactcactaccaggggcctgggacacaagcctgtttgagggtttctgaagaacagtggagatgctgagattctgtgcaggcctttctgactttggtaataaacgttgtgcacaacacaagagctctccctatagtgcagactgttattatttggagaagttgagtactggaggggaaaagtgatgctgattttcagtttaatgtaattttccctttgagaaatgttgcctgcatgaaatcgtgagctttaattgtcaaatgttctttctccttggtgtgctttggagtttttgtttttcctgaaaaatgtttggatttgcatttccctactttaataaaaatggagcaaatgttcattgtgtaaataactatgaaaatattaacagataaaagaatattaggccgggcacagtggctcacgcctctaatcccagcgctttgggaggctgaggtgggcggatcacttgatgttaggagtttgagaccatcctggccaacgtggttgaaaccccgtctctactaaaaatacaaaaattagctgggcgtggtggcgcatgcctgtaatcccagctactggggaggttgaggcgggaggatcacttgaacccaggagacggaggttgcagtaagtcgagatcacacccttgcaccccagcctgggtgacagagtaagactctgtctccaaaaaaagaatgttggagacatattcactgtattactagtaggtgggtattaatatacacatgaacacagcaaataatagaataatgaaactgggctgtgtcaggaagacaaattgtgacccaggtgttgattccaccactgattaatatagccaagcaatattgcttcctttccctttcaaagttaagaattgatgcatttggaaatatcttttgaaaagtaccatatgattgtaaattagagcactaattgacatttgcttagcatgctctcatattcttgtaacatattcataaatttgccagttaattgaaatgatgctacgggtcttaggtgtgtaggcgttgtggtggtgtcactccgatgcatttgactgtgtctcactcttctgtgctgcagcaccagtggcagttcgcagcctccaggacttggctcgcatcgccatccggggcaccattaaaaagattattcatcaggaaactgtgagcaaaaacggaaacggactaaagaacacccccaggtttaaacgaaggagagttcgccgccgtcgaatggaaacgattgtctttttggacaaagaagtctttgccagtcggatttccaacccctcagatgacaacagctgtgaagacttggaagaggaacggagggaagaagaagagaagaccccgccggaaacaaagccagaccccccagtgaacttcctacgccagaaggtcctgagcctccctctgccagatcccctgaaatactacttgctttattacagagaaaaataagtctcctgtttgaaagggggaaataggaagagcagattgctgagtgtgaagttcgtgctgcctgtgtgctgttgaagggtcacctggaggcagacgttgtggggaagggaactgctgggctcatccacaccatggttttcttctagttcctgattgacctctaaaattctattcagttgtatgatttgtttacatagttccacaagaccttcattgcatagaagattgttttcccaaagtggagagaatcttcatagagaaaaagagaaggctgtttctttttcggctctgacgaaacactgaagtctgcgtaagagagactgtttgatgaccgtccctcatgcaacatgcacggtactcactaaaaatgaaaactgaagtggaaactaacctgtgttgcttataaagtgtgaaagcacaagcttataaatgtataaaatcttttctgggtgtgacgcacctgcgtccaagtttgaatttttatgatatgtaccacttaattactggcactgagtatcactgaatttcttagttttctagtggggaaacattattgagaagccctcccttattttaagtaagttgattaaatcttatgtgagttgccagttgtaatttttcaaaggaaaaattttgatggggtggaggaatgaattgccagataatctttctggaattccgagagaattccaaagagggtttttttttttttttttaggacatcttttgatacctttaaaagaaccactgtcaagtaatccttaaaagaatatcttggaaaaggaaacagattttttcctgtgtgtaagcaataagtgaagttacatttgccctaaccctagggatgattctttacccagttttaaagcccatcatggtattctaaggtgttgacaccctccatcctcagagcaggtcgaaaatattaaatagactggggactctatgatgggcagcctgtgctttttgacttcagtttgctatttttctgtgatcacattagtactgattcatagattctatcttttataattctggagaaaaagatttgttagttttgtaatttttttgtaagaccaaatgtatgtattttagtagctccattgcatgagaagagtgtaactcacactgacttgtgatatcagccttctctgggccttgtgtgtggagagctttctatcttaccaagtggtagggctaaaagaacaacagcctttttggtagtcacatagcagaatgatcagagttacattgcttattccaaaacattggttctttttaaaacatttttttttacccaaagaaaagaataatagaaattactaacaataaatataaattcagagtgttgatataggattcagtatccagagtttatttttaatcttaatcctcagcttcttgggagttgctgggcttcagtgtctctgtggtttcaccagcttagcttgagctctggttattttggatcttttctgctttttttaagtaactgagtcatttttaccacacagtccagtttgcatgtatagctaggaaacatgtattgctctagattgggcagtttaagtcattttaaagaaagttagttcatagttgttgccttttaactcatagtcaagcttcagtctttcaaagagaaatgtgtgattttcatttacttgctgatattttgtagtttggagatccttgtgggcattattctaactgatacgtagacacttacttggaaatttttggacattatattaaatgagtgctatctgtgaaattggttatattaggtggcttgactaatgttttttctataattgtatatggactgcatttttaaaaaaaccgcatttgcctttatgctagattgtaaaaaattatattagaatgcataagacatgtttttccttcatatgctagacttttcctagcatttcgtatttctgtgttgtcagtgtgtgatttttaaaccggaatttggtttaaaaaaaatctggtggtaatatatgtgagaaatactttggtgtttaccttatgaaaataaaggattgtaagtaaagtttcctgcgcaccttataccagaattcagtataatacactactttctgttttcaaacagataaatcataatatagtctgtattatctgtaagatctgtcttgtaaaccacattcttgacaactatttgcttttgagtagtttgtattttaatatgtgacttttgtcttgaaaagtagtaaagccatagacttgtgcaaaacaagtttcaagtttatagatattaagtttgtaatgtgagcatcaaatgtgtatgtaaaaatactttttaccagtctggaacttgggaaaatccagggaatttgaaacatagattttaatgagctggtaaacacaaatcatgtcaataaaggtagtcaggatattttatccttagcattgcttctgcatcctgtgtaggattccaattcttgaatatgttcttttcaaaatcttaagaaaagaaccttttttctttattaacatcatgtgtttactttcagcaaatatttgtattactgcttgattctgtgacagtcacaatagatgtagagaaggcattatttttcattaataaatgtgaaattggaatggacaaatggagaagtggctggctccaagtacataagagaatagggccttgaagattgcggttaacgtttttggcataattttcccacattcaactttctaaggggcagaaaatatttttttttcattctcagttatctgttcagagcacagatgttatttagatcttgaaattctgggaccagtctcccaaagagcttatgttttctcttttattgtatgtgcttgttgggatattttttacattctgccttccaattttttattttggcagttatatattttaagataatttcatgctctctttactgatctctgaattttccttcctgctgtattcgtcagggttctgtagagggacaggactaataggatagatatatatatatgaaagggagtttattaaggagtattgactcacaggatcgcaaggtgaagtcccacagtagggcatctgcaacctgagaagcaaggaagccagtccgagtcccaaaacctcaaaagtagggaagctgacagtgcagccttcagtttgtgactgaaggcccaagaacccctttcaaaccactggtgtcaatccaagagtgcaaaagctgaagaactgggagtcctgtgttcgagggccggaagcaaagcatgggagaaagatagaggccggaagactcagccagtccagtccttccgtgttcctctgcctgcttttatcctagtcgagctggcagctgaatagatggtgcccacccagactgagggtgggtgtgcctctcccagtccactgactcaaatgttaatctcctttggcaacagccacacagacacacccaggaatgatactttgcatccttcaagccaatcaagttgacacagtactaatcatcacacctgcatatactgttattttctgtggttgcagtactatagacttttctgaggatcctaattagaatttttaaaaattttacttcatcggaggtgggaacgtggattctggcccttccttgaacaaagaaggaaacggccagaaagaggaagggatgtggggacttactcctctagaggtgatttatcagtttgatcatgttgatctttcatttcttgctgtatctctttttttttttcttttttaactgttgttggagactcacgtttgcctgtctgtaattacaaaccaggctggagtagggacagtcattggccaacctcatagtgggatgaggagagctggtcttcaagccaggggcctggacatatgaagggtaatggtctctgggaatcagtgagcctccttgatccgtctgcagaaaccccttccttctggttccctgctgctgctgggcatcaggatgctctcccaccattcgagctccttgcaaacctcatcctaaccctaaccctgctgtgccccagctctctgtcagatgcccgtcaccaggggctccacttgcaacctgactctgaacaactgtggaccttgtgcttatgtctttcccttctctttctcttggagacagagatgctctgaacaactgtggaccttgtgcttatgtcttttcccttctctttctcttggagacagagatgtaacccattgctccactatgttggaaccagaatgtccaaattagcacttgaggttctgcatgaaagaggaaatagcagaaagcggggatagagtcatagaccacacgggcaggacgtccctttgacctaggagggccctgggcagctgggcactgggtggttagagcaggggtggagtcatagaccacacgggcaggacgtccctttgacctaggagggccctgggcagctgggcactgggtggttagagcaggggtggagtcagaccacacgggcaggacgtccctttgatctaggagggctctgggcagctgggcactgggtggttagagcaggggtggagtcatagaccacacgggcagggcatccctttgatctaggagggccctgggcagctgggcactgggtggttaggtggttgttctgatggtcaagagggagaacagcatgagccctgccccaggcctgttgttctgtgtcagagatcagggctgtcttaatgccccatatcccccacctggccagctcccccagactcagagggcagcagcagtaactactgtgccttgatccgctaaggtggtgggggccacccctctgccatcccaggaaacacgcagagcctgggccatcccagcccttgccggtagcctttcctgtgaccagcagggcccagagactgtgtgaggaggtgcttgggtggtagctggtcacaggcagaggcacgggctacatgaggacctccagggggtgttgctcactcctatcaggtagcagggtcactcctgaaagttctagaaccatgacttagccagctgcatcatgtccattttggggaaaataaaatctctggagctgacccttggctgggactggacctcccaagaagtggcacctatgcaatggttagaggtctggtccagatggaggctgaaggctcctcctcacccactccacttggcacctgtggggaggggccactgccctcagcatcctcttcccacagcactgccacccctccgccccaacacttcctcctgtcccctttctggccttatccctggcctctctgagaagagggatgtgatcccacggcctgccctcacctccttaaagggccagcctgggcccagtggacacagttgagacaccatcttgtgcctcttcctgtgccttcctgaggcacctttcctagagattaaagggacataacggctgttccaaagtgttgatagctggaggaggagcccggggagatgtgaggcacggggtttgggcagccctgggttttccaggctccagtgacagcaggatggaggctcagggtcagctctgggtacagtggggtggagactcagggaacatcttcagggaggccacctccaccccatccctcctggtccacagagatctgttgtctcgaagttctgaagtccagagtctggaatgagggtgttggcagggccggccctagggaggcatctgttccagggcctttctccagcttctggtagtttctttgcttgtgacagcaaagctccagtcttcacaaaccttcttccctgtgcgtgtttctgtgtccacattccccttttgataaggacataatcatcatgaatgaagcatggccctaatgacttccgaacttcatcatttgcaaagaccctatttccatataatgccatacttgtaggtactgggtgttagggcttcaacatatgaattgttagggatggaactcaacctataaccttgtccctgcctctgccagtgatctccacattcctgctggccccaaaggcaccatggccccttccagggtgccccaggcagatcacgggagggcctgactgctggggatggggctggtgctgggatcctctgcccagtgagggctgggatgagactattatggggttgggggtgctgaagttttgaaggcagggtaaaacagaggctgggtccctctctggaccccaggctccagggaacacctctcctgggagttcccatgctccctgtggcctgggcaaaaaaaaaaaaaaaaagtacttgcagtccgaggccccccaaaggcaaaagcctggctccgataagcatcctccccaccctgtgtgcctttcgagcccctgaggtttgtggggagtctcagaggttttgtggggagcctcagaccagatcctggtcagcagggttgaggcaggcctgagaatgtatctttagcatccagagattgggagggtgtggacggaagcaaggttcaggcatcctcagctctaactaagtatcaaatactagtgtgaatccacttcctggagctggcctctggggagccttgggttggtgtacataaacagggtctgcctgattcatcaggtttctcatggggcctggaccacctcatgatcacaaaagtgaccgcacagcttcaatgcctctcctgtgtgggctggacacacgttcatctgactcacaaactttccctgggtggcacctggagccctggctctgggctggaacctgagtgtgaagccactggaggctgtgggattgcaggtcaggtgagtcactcagccacctgagcctggccctccgctctgcacaggggactagctatagatagcagggagttcacctgagcaagacaccagcacacgttggtgctcagaaaactctgatttccttttattgagatgggacaacccttggagaccatgtgtcaaggtctggattacagtaggacaaggttcaaagggccctgtgagccctgaggtgttgctgatccctgggtgtctgtgaaggcgagagaaggtgacctggatctggaatgaggaaacggccatgggtttaggagctggcagacatgtgtccagaatgtggttggccaggcctagacagcgctgggctgtggagggccttgaaccccaggctaagggagcatgtgggaagagggctcaccctggtgagggaatgctggggtgggattttgtttttttattcaggtaaaatccacataatataaaattaactgttttaagatgtaaaattcagtgacattgtgaacctgcaaaatattgtgcaaccatcacctcttagttccaaaaccccaaaaggaagccccctacctattaagcagctgctacccaatgtgccctccctccgacccccggcgaccactaatctgctttctgtctctgtagatttacgtattctggatattctccatgaatggaatcatgaagtatgtgaccttttgtgttcagcttcttgcttttagcatgttttgaggttcgtccacattgtaatgtcagtgcctcaacccttttcacagccgaatattatgctgttatagaaatagaccatatttgactttcctgttcatttgttggtggacatttgggctgtgttttgttgttgttgttgttgtttttgagatggagttttgctcttgtcacctaggctggagtgcaatggcgtgccctcggctcactgcaacctctgcctcccaggttcaggtgattctcccgcctcagcctcccgagtagctgggattacaggcacctgccaccactcccggctaattttggtacttttgtagagatggggtttcaccatgttggccaggctggtcttgaactcctgacctcaggtggtccgcccgcctctgcctcccaaagtgctgggattacaggcatgagccaccgcacccggcctgtttccaactttttaaaattgtgaataacaccgttataaacatgtgtatacaagtttttgtttgaatacctcttttccattcttttatgtatatatatctaggaatgaagttgctgggttctatggtaattctgtttagcgttttgcagaaccaccaaactatttcccacagtgtctgcaccatatgacatgcccatcagcaatgttcacgtttctctacttcctgacactgcatgttagtttctgtttctttctttttttgtaataaccattctaataggtatgaagtggtatctttttgtagtttagatttgcatttcatttccctaatggttactgatgttgaatatcttttcatgtgttatttctgtatcttctttggagaaaagtgtctttaattcttctgcccattttgcatgggaggtgggtgggggttgtttgtctttttgttcttgagttgtaagagttctttgtatattccggatactaggccactgtcagattctcagttctcaagcatccaaaatgattaacaaaatgacaatttctagggcttctgtgggagagtatggaaggtctttttgaactttttaatgctgtcaactaaagaatgatgaggttcataaatatggaaaggagagatttctatatttttgtttatttttatttttttgagacggagtttcactcttcttgcccaggctggagtgcaatggcgtaatcttggctcactgcaacctccacctcccaggttcaagtgattctcctgcatcagcctctcgattagctgggattacagaccctcaccactatgcctggctaatttttgtttttttagtagagatgaggtttcaccatgttggccagtctggtcttgaacgcctgacctcaggtgatccacctgcctcggcctcccaaagtgctgggattataggcactgcacccagtgaggtatttatttcctgtaaagggttgcagcctgcagggtagtccttctgataggctgggaagcatagcctccagccagaaactagaaacaagacacttcaaggaagaggtgaaggaaacagtaatttatgctgagtggcatggccaaatacacatctttaataagctctaggcggagtcatgaatatttatgaaaggggaaatgcgtgcatgcacaactgagttccttggttcttcatgggtcccatgtacaaaaaatagcagtgttagcatcatcccagggtggagttttcagccctctgacattaaaaggtgaagcagaggacatgaaaactcgctctgtgcatcctctgtgtgctgtccagaacctctccgtcatgggtggtctcttatcaggcaagaaaggagaggttgatatcagtggtgattttgaaagggctggtttctgttaaatccttagggaagaaagcctcatcatggtttgcaaagcagggggtataatggggtgtacctgactcccatcatcccattctggccaagctgagaactcagttttgaaagttactctggggtcccctcagccaagagtgggtctgttcagtcagctgggagcttaggatttcattttcatttatcaatgctaatgggaatgagcagtctatcttcatggcagctgaatttgcaagaaacttcgtggatggggttaacggcagctgtattttctgggcgctccatggatggggttaacggcagctgaatttgcaaggaactccgtggatggggttaatggcagctgtattttctgggagctgtgctttaattggataaagtaagttctggtaagatttcttccttcatcttcggtatctcaaatgttttcatttaaataatctttataataactcttgatgtctgagggggttcccacacagtcatctattgtaagactttctgattcctttttttcctttggtcattatgaatagggcttctgtacataattgcatggtagcttttgtttggaaatcacatcaaagtggttgtcaaaatacttaggaatgtcgtttttggattgtaaggagagacttatttagctttggaaaaaactgcccaacttgtaataggtgaggaaaaataattttctctctatcttttcagaattcttagattggaccctctgtaacaaatgacagattaaaatgagaaaaatgtagaaaagtttaaaaacatgtataccttatggatacatgggcgatactcagggaaaaatgagtaaatctccagcaggtggttttcaattcaagtgtaaatactatcttcaacttgaagatttgaggcacagtagtggggagttaaccagcaaaaccacattagacaagagtaacgtttgttatgcagactgaagtccatgcgtcctccattgataagactctagtgatttagttatccttctcttcttggtgccgagagagaggtagcttttaaatggggatttcctttatagatgtaaattttccttacagaagggtaacttctactctggttttggaacttcctttgttagcattttttttcaaaataatcatcttggaataattcttatgccaaagggacatattttggggtggcatattctggtcttatacactgtcttccaccagcaatgaaaagagttattgtctttcttgcagcaatttgtgatttttttagagtttagcagttctaatagatatagaccagctgtgctatctcctggttttcagttctgtagtatgttgagcatctttttgtatgtttacttgccatctgtagatcttctttggtgaggtgtctgttcagatctgtgtgcatttttaattgtgctgtttaacttgtttagttttaagaattttttatatattttgaatacaaattctttctcagatctgtattttgcaaatattttcttcaatatgtggcttgtctttttgttctcttaagaaggtctcttccagagtataaactttaaagattaagaaatccacattgtcatttcttctgtgtatatcaaccttttgtgtcatttgttaaaattcattaccaaatccaaaggcacatagcttttcttctatagtttcttctagaaattgtatagttttgcatttttagtgtaaggatgattttgagtggttatttgtgcaagttgtaaagttttcatctacatgcatatcacttcttatggtttccaattaatcattccctcactatttttggaaagacacaggatagtgggctctgttagagtttatatatagctagacatgaacaggaggggagctcctagaaaagggaaagtctgggaaggctcacctggagggaccaccaaaaattcacatattagtagcatctctagtgctggagtgcatgggcacttgtcaattgtgagtaggagggagaagaggtacctatgcagaaagaaacaccctagaactcctcttaagatgccccaatcatcattcactctgcaataaaaatgtcagaatattgctagctacatgctgataagaaggacaaaggggacattcttaagagaaacctggcaccataagtgcagattagggcaaagaaggacattcaaaagagataggcaggcacactaggtacaaacgtgaccgctgtcagcctgcctgggatggcgggaaggaggctggtgccagagtggattcggattgataccacacatgtacctcaaccaacagtgaggaggtcccacaagcctaagtgtggcaagtcggggacctaaggcagtagcaggaaaaccagacaaagagaacaggtggagacttgagacagagacaggaatgtgaagaagtccaaaataaaattccctgcacaggactcctaggatgttttcatgcacgatcagcccactcctccctatttttctacaatgagctctttacactgtatttcttttcaatgaagttgtctgccatttttgtactgcctcttggtgaaaatctttcttccaagttagacaagaactgggacatcagctctccctagtactagctccgtttcagttgaatttacagaactgatggggcttaaaaactgatgctctgactttaagtggtgcaggaggcagccagtaggggacgccaaccgtcacactgggagcaagagacccccgcctagtccccatctgcctgcaggtggcgtgctgcctcgacactgccaccaagagggccaggcagtgtctccagctgccagcaggcggcgtacgacgactacactgtgagcaacagggccctgcagtgtccttagctgccagcaggtgtcatatgggcaccacaccatgagcaagaggaccccgcagtgccctggttgccaacagggggcgtgctgccactacactgtgagcgagaggttcctgtagtgccagcaggtgccagaagagggcgtgcccccactgcactgcaagcaagagggcccggcagtgtccccagctgccagcaggggagccagccgccactacactttgagcaagagggcctggcagtgtccccagctgccagcaggggggtgtgctgccaccacactgtgagcaagaggaccctgcaatgtccctagctgccaccaggcggcgtgccgccgctatactgtgagcaagaggcccctgcattgccccggcgccagcagggggcgctggccaccactataagcaacagagccctgcagctgccctagtcgccagcagggggtgcactggcacagcaccgtgaccaagccagtcctgtagtgcccagctgcaagcagggggcggtcgagcccggcttttcgaattattgaggttcctcccgtctctgcgccacgccgctgcgacgggcgtctccgcgcctgcaccgcgctcccctccccagcacaggggcgtgcgactgtgctcctgcaccacgccaccccaacccaacccccgcccggcagcgtgctctctgcgcatccgccgcgcctcccccgcacgtcgcgccagcctgtgcgcgcctgcgccggcgcggtgggcctctctgtgcccgcgccggcgtggggtgcctttgcgggggcagagctgcgttctgcttaacacagacccggggcacaccgcaaaggtggagcagctttctcagcacacaccttgggggcacagcctcgctttgggacaactcggggccgcatcgacagtgaacaaaatcctttctgtttgcagccctgaataatcagggttagggttagggttaggggttaggggttggggttggggttagggttagggttagggttgggttagggttagggttaggggttagggtttagggttagggttagggttagggttagggttagggtagggtcagggtcagggtcagggtcagggtcagggttaagggtcagggtcagggtcagggtcagggtcaggggttagggttagggttagggtcagggtcaggggttagggtcggggtcggggtcggggtcaggggtcaggggtcaagggtcggggtcaggggtcggggtcagggtgagggtgagggtgagggttaggggttagggttagggttagggttacggttagggttagggttagggttagggtagggttagggttaggggttaggggttagggttagggttagggtaagggtaagggttaggattaggggttagggttagggttagggttagggttagggttagggtagggttagggttagggttagggttaggggttaggggttagggttagggttagggtaagggtaagggttaggattaggggttagggttagggttagggttagggttaggttagggttagggttaggattaggggttagggttagggttagggttagggttagggttagggttagggttagggtttaggggttagggttagggttagggttagggttattggttagggttagggttagggttaggggttagggttaggagttagggttggggttagggttagggttcaggttcggggttcgggttggggttgggtttggggttatggttagggttaggttttggggttagggttagggtttggagttaggggttagggttagtggttagcgttagggttagggtaggggttaggggttaggcttagtggttagggttagggttaggcttagggttagattacaatttctaacctgttttattttgttttttttctgagacagggtctccctcttttgtccaaggctggagtgtggtagtgctatcacagctgactgcagcctcaaccttccaggctgaagcgatcctcccatctcaatctcctacgtggctgacactacaggtgcttgccactatgcccaactaacatttggaattttcgtatacgtggattctagaggggtgacagcgaaacgtgagtaagcatggattttggtatatgcagagatggagggctggaactaattctgtatactgagggacgacgactgtatatgtttttacaattacgctgtaggatacatactgttgcatagccttgaaaataataatttttaattgagtggaataagaataatattgataaaagtagcagctggccaggtgtggtggctcacactggtaatcgcaacactttgggaggctgaggcaggaggatggcttgaggccaagagtttgcgataggccttggaaacaaagggagtcaccatccctacagaaaaatacatgaattagcctagtgtggtggcatgttcctgtagtcccagctacttgggaggctgaggtgggaggatcacttgagcccagggaggctgagactgcagtgagtcatgatcaggcctctgcactccagcctgggtgacagagtgagaccctgtctctaaacaacaaaaaagtagcagctaacatcaactgaccttttactgagtgcctatggataccatagtttaatttcttataactgtttcttattttacttaccaactctgtcttcagttactcccagatttttactgtgtgtgtacagatgaccttttggaggagcctcaacaggcacagctcctccctcatagtggcccatttaggcccaactcatgactgtcgggctatttccaggcctagtgtctgcctcgtggctgactgttgaagcccaaaacttcctcaaatcagccttttgcccaacttctgtctactgtcggactctacaggccagcctctgcctcacagtggaccctccagacccagatggtgtctcactgtggcatcctcaggcgaagctcctgccttttggcagcctctccaggcccagctcctcctgcctcccagtggcctctttcggcccagcccagctcatggctctcggcggccttcccaggccccgcttttgacttttggcagcctcttcaggcgcagaacttgatctccagtcggcctttgcaggcccggcctcctgcctctcgaaggcctgcacgggcctggcctcggccttggcctcacagcggactctccacgcccagctagctctcgcctcactgtggcctccccagtccaaagctcctgcctttcggccacttcggcaggtccagctcctgcctgccagtggcctctttaggcccagctcattcctcacgtcggccattccaggccccgtttttcccttccggcagcctcttggcctctaatttgtttatcttttgtgtataaatcccaaaatattgaattttggaatatttccaccattatatattttggtaggtaatttatttggagtgagtttctgcaccatgcccgaattttttattttattttccttattatttggtgttaaacaggtttaatgacggtcatggcaactttttggcacaatgaaaaatatcgcccatgatcaacgtgttctgttctggggaagggggcaaaggcagggtgaatcactttcttaaaaagtatagctcaagttgggagtgcagagggaatggggagaaaaccctcccgctgcctgtgtcgaagtgcaggagcccccacccccatactcacctgagtccagcccctctggggaaagaaggggtgcatgaactccccctagtccacaggcgcctccctgtggcccaaggccctcttcacactccatcttgtagccccagcaggagctattttccgaaaagtgaaaagctctgaaggtcccacaattcatggtatgtacaggggctcggaggagggaaactgcccagctttcccccggcacagctgcaggggtagggggtatagataagaggagcaggccttggccaggcgtggtggctcacgcctgtaatcccagcactttgggagggggaggcaggcagatcacgacgtcaggagatcgaaatcagcctggccaagatgatgaagccccgtctgtactaaaaatacaaaaattagccggacgtggtagcgtccacctgtaatcctagctacccggaaggctgaggcaggagaatggcgtgaacccggcgggaagaggttgcagtgagccaagatcgcaccactgcactccagcctgggcgacagagcaagactcggtctcaaaaaaaaaaaaaaaaaaaaaaagaggaaggccttactctgtcccaaactgaaaggattaaatggcttcacctgggagaagataaccatcctgccctccattgctacccccacatactgtccatgttctcagggggtactgtgagtcctgggatctttggggttgcccacctgcctgtggtagttatggagacccccaggtgttgaggcagggctggggtgtccccttccaaccaggctgtcaaggccccaactctggggcagaggcagtggcagggcagccagggttgcgccagagcctgagcaggttgaggtggggtcaggcagggctgggagtcagggcaggggcagcagcagtggacccgctatgcacacatcttcttctccaaggtttgtgtgcagaacatcctgcccatgctgacccaggagcttcagttggcacctgccccagtccagcctctgggaaccatgcagcagctcccagcggccctgcacccaccaccagcatccgtttcacctgcagttgaagatccgtgaggtgcccagaagatcatgcagtcatcagtcccacggagcagcccgcgaggctgaggctcctcccactggaccgccccccaactggcaccactgctgcccctgcccctactctcagcctcacgtgactctcgggcagaggcagtggtggggcagccagggcagcgtcaagagtctgagccaggtgaggtgcggtcaggacccccacagggctgggagtcagggcaggggcagaacaaaccttggaggggaagatgtgtgcatagtgggcctggagggcggctgtggcctagtggacaggaagaagcagtgggcctggaagagctgcatgatcagggccggcactggtccagggcacgtgcagtgaagaggacagctccttctcggtctccggttccctgagcctgtcctcggcttctccacctgtacaggcaaaggggaagctgtccgcatcacacatggcacacttgggggtgttgggctttggactgcagctggaacatcttctcatcttgcatttgggcgcggtggggtcctccagtgtgggatccatgtccgtggggttccctctgccccgaccccgaaagcccagtcagtttctcttcaggctctgctccccgggtggctcagcccagctcctgcctaggaaagccttagtgttgggagggaccctgatgactgaggagcctggtagctccaggtcgcccacactttcaggtctcttgcaccagaaggtggcaggatccattgggaggaaacaggccaccttggaaggtgtccctgggcccccatccccaggggttgaggccgtagggggcccgctctgctgcgttgaccagactcctgggctttgaaggctcctgggcccagtaagaaggaggtgggtgccaaggttgaggaggaagcatccgagtatgtgtaggaggaggacagggtgtgaccatagactgccaaaagctgcaggtggatcgggggaccctgggggctcaggatccagcaaggggcggcaggagtaaaggaggaaggaatgacaggtgcaaataccttcccaccaaagcccttgttgccctctggctcctccccagagctgtccccactctcagtcggtcacccactccttgaacttgagatcggtgtcggtggtgctaaagccatcatcagcaatgacatcatcaccccctcctcctcatggatgaccgtgtgctcctcgtcactcgctatgtcctcactggccatgtgctgggaatgagcagctcacgtgggcggcagcagggctgcccacgggtcacctccctcaccaggggctgcaaagtggcctggagctccatgctgagtagaaggctttgggccagagtatgatgcagtgccagacaccacctgtgtcagttcccgtagtgcctgacggtctatttccctgccgtccaggctgtgtaccccgctgtgggagaaggcttgggccaggctgagccaggttccctgactgtgtgcagccgttctgccccacagaagctgctccttggcatccgagctctggagtgtttgggctgcaactgacaggagttcagaggacgccccaggggcagtggcagtgcccgtctctgatatgctccgctcccacgagcccttgttacactgctgctagcccctggcttgtgggcttggcctctgagctggacttctttcggtccttgttgcaagtgggccaccttcacctggaaggccaggtcgtatttctgcatctcactgggccccagggtgtaccaccgctcgctcagcatctggctgacggtccggttatcctggttggggtgaccctgctgcgccccgccagggcctggtgccgcttgctgaagatcatgagcgccactcatgggccaccagatgtggtccttgtcccatttgttggggctgcgtccatccttctcagaagatgagtcctgttccttgcgcagggcactgagggactgggcctgacatcatctgagtggtagaggcaactgggtgtcaggagacatgatggagaggaaagcatcatcatggtcattctctgtctcactgtccagcagggactcccctgaggggcccagggctcctcctccatggtgggaggtgagcttttaccaggttccaccacccccaaagtgtgtggggttgcgggccctgggctttcagggcaggtggctccagggggccgcccagggtcaacactccctgtcccacctggtggacgctcatgagcaacagctggcaacttggcaggttgttttctctggttgcaggccactgagtgactggcaggttgctgggcctcgtgtggctgcagggaggggtcaggaaggggatggagtaccaggggaacacagccgcagagtgaccttccacattcctccacacgaacatgctgacgccacgggaggcctcactgaacgcaggcctgggggccgagtacttggtccgggcagggggttcctggcaggggctcacacctcctcgccccctcctcagccaaggtggcttgggcccagagaaggggaggttggagaggagcagaaggccaggcctcaagttttgttttttttgtttgttttgttttttgtttttgaaatgtagtttgactcttgtcacccaggctggagtgcagtggcacgatctcagtggccttcatacctgtctaattttttgtatttttactggaggtggggttttgccatgttggccaggctggtcttgacctcccgacctcaggtgatccacccacctcagcctcccaaaatgggattacaggcatgagccaccgctcccaacttcattcctttttacttgaaaaactccgttaagcatttttttaaggtagacctagtggtcctgaatgccctcagctttgtttgtcgaggaaacacgttatttcttttttctttctgaaggacagctttgtcagacatagtattagttgctggcagtttttttctttcagcactttgaatgtattattggattctgtcctgacctgcaaagtttctttaacttttgactatttgattatattgtgacttggtgagtatctatttggtttgaacctctttaggaatctttaagcttcatggatttagatgtctaaatctttcccatgatttaggcagttttcagccattctttaaataagctttcttctcctttctctactttccttctcaaactcccataacctgacaatggtttgcctaatggtgtcttgttggctttcttttctctgtctcttttttttttttttttttttttttgagacagagtcatgctctgtcacccaggctggagtgcaatgtgtggtctcggctcacattgcactccaacctccgcctcctgggttcaagcgattctcctgcctcagcctcccaagtagctgggactacaggtgtgtgccaccacacccggctaatttttgtatttttagtagagatggggttttgtcatgttggccaggctggtcttgaacttctgacctcttaatctgcctgcctcggcctcccaaagtgttgggattacaggcttgagccaccacgcccagccttcttttctcttttttattctttttttctttgtcctctgactggataatttcagaagatctatattcaagtttacagattctctctcctgttgaagtttactattgtgttatatcacccagtctggtcttgaactcctgggctcaagcgatcctcccaccttggcctcccaaagtgctgagtttacaagcatgagccactgcatccagtcagtcccagcactttgggaagctgaggtgggaggatcacttgagctcaggagtttgagaccagcctgggcaacatactgagaacttgtctgtatattaaaaaaaaaaaaaagtctttgggaggccaaagcgggaggatcacctgaggtcaggagttcgagaccagcctggccaacatggcaaaaccgcatctctactaaaaatacaaaaattagccaggtgtggtggcacacacctgtagtggtggtgcatgcctgtagtcccagctactcaagaggctgaggcaggagaatcacttgaactgggagatggaggttgcagcgagctgagattgcaccagtgcactccagcctgggcaacagagtgagactccatcttataaaaggaaaaaagaaagaaaagaaaaattccatatctgagtgtttactcctgagtttttgagattgttattaagatcgtgctctactgtgatgatttgggtttgtttgataatcagaaaaaagcatattcttttgggtgtttagccacactgctttggtgtcacaactgcacattggtttcacagctgcaggacaaattcgagcatcttaaaatgattcaacaggaggagataaggaagctcgaggaagagaaaaaacaactggaaggagaaatcatagatttttataaaatgaaagctgcctctgaagcactgcagactcagctgagcactgatacaaagaaagacaaacatcgtaagaagcaatagtttctcttactattctgagagccttatcattctacatcccatcttcctgtgagattgtctttgtagcatttaactctaattgcagttctctttttaaaaattggcttgcttattgtatattttccccaactaaagcgtgaactcctagcagggcgtggtggctcatgcctgtaatctcagcactgtgggaggccgaggtgggtcgactacctgaggtcaggagttcgagaccagcctgaccaagatgatgaaacgctatctctactaaaaatacaaaaattagctaggcgtggtggctgggacctgtaatcccagctacttgggaggctgaggcaggagaatcacttgaaccctggaggtggaggttgcagtgagccgagatctcaccattacactccagcctgggtgacaagagcaaaactccatctcaaaaaaaaaaaaaaaaaaaaaaggtgaacttgaaggcaggtcctgtgtccatcttttcagattctgtatcccagcacttaggacatagacaaacaagaagatgacaatcaatatttgccaaaatgaaaaaacaaaagaaacatgtaacatcatgtaaaagaagctggttaggtggagaaatttatttaccatagtcttgcttgtggatccagtagtgacttttacattttatatctaaatagacgctggaggctttgttgggtactcataggcataaaatattatgttatttattatagagttaaatgctacaaagacaaatctaattaataggcctattttcctgtttaagttctactcataatttcttcataatttttatgataaaaggttggattttgattagaactcccatgcttttgtgtcagaattaaaactggtattagaataaataattcaaaagctagagaaagagtacaatgagaagccatgagttgcatttgaattataatattatgtcttacagatttggggtatatgctaaagttaccaaagttgtagaaaataaggccgggcattgtggctcacatctgtaattccagcactttgggaggccgaggtagatggatcatttgaggtcaggagttcgagaccagcctggccaacatggtgaaactccgtctgtactaatagtacaaaaattagccaggcgtgatggtgtgcacctgtagtccttgctactcagaaagctgaggcaggagaatcgcttgtacccaggaggcagaggttgcagtgagcagagattgtgccactgcactccagcctgggtgacagagtgctatgagtcaccacacctggtatgagccaccgtgcctggcccacaatgacttttacacatgttgttaaaccatcttacagattttataatttgggggaagaaaagttttactaaatggtcttttaatggaaactctacaagaaccagaatctttgctttgttcacttatgtatccattcctaggcctagaaaaatgcctgacacatagcggcaattattcattgaataaatggacccagcgatagtacattagctatgctatatgcatacattaaagatgtagattatcgactttcaaaagataattaatgtaacttcttactgcttctgaacatgtttgtgagttatattgctgagggacctttatcttctcattctttcatcttaacccagtgttataaaattgaaatcaccaatattattccatatctaaaattaatatctaccttgtaaaaaatatcactctgctgcatttgacaatagactttttaggtaataatgatgcaatccatagggttttttgggggcacagagggattcatgctaacagaacattttattttctattttcccagagctgtaaaacatgaaattacggtagtataaggcatatttttactctttttataattttttctaaaaaaaattagtgtttgttccctatataacttttaactttataggtaaatatttgtctctttcagctccagttttatgtgaaatagagttttcagatgtatgtagcatggaaagttttaatacgtcagagttactgatttttgccattttctcaattatttcttttttatctttagttgatttttttgtagtgacacattttgtttctagtctcatttccttttgtttatattctatgtatatttcgtttttggttactatgagaattacatataacatcctagatttataacattttaatttgaatttatttcaacttaagttcaatcacataccaaaattctactgctatacatatagctctactctttttatgttattgatgtaacaaattatatctttattcattgtataccagctaacagatttacaattacattttacgcatttgccttttaaattatgtagaaaataaaaagcagagttagaaaccaaattacaataggactgtttttatgtttgtttatgtatttacctttaccggagagctttgtatattcatacagcttgcttatttacttatatagttattgcctagagttcatttatttcaacctgaaggacttaacacctcttgaatggcaaattcaggaataaacggattttttttcagttttaaaaaaaaatccggaaatgtcttaatttctccctcatttttgaaggataagttttccagctatagatttctcaattgacaggtttcttaattattttaaatatataatccactgcctactggccttcaagctttctgccgagaaatcagctgctaatgttatctggatccctatctgtgagagttgctcttctctctgagttttcaacattctcccattatcttttgtttgtttgtttttgagacaaataattgtacatattcatgggatacagagtgatattttgatacatgtatacaatgtccaatgatcaaataaggataattagcatatccatcacctcaaatatttgtcatttatttgtattgtgaacagtcaacattctttcttccagttttttaaatttataaacatttaaattttattacagaaatttaaattttttgattctgaaaaagttatatacatatgcaacatcgttttatcatttatttatatatttatgcatctttccttttagttttgacagagattttctatttaatcattatttcaaaagaactcttacctgtatttatttatcaattatatttcccttgttttttcctagtatattaatttatttacttatcttctaaaaatcctccatataatctgtttgtttcctttctataatttcttcaataattagttctgttctattttccattaaaatatttaaatcttgtatgaatttttatcagattagaaatttagggcgtttcttaatttctctatactctagcttttgacttttttttttctgacctaagaggtatttagagcacattttagattttttattttgactaatcatttaaaatgtatactaatcttcaatttaaataaaaaactggtctatagtgacaaaaattacaaatgagcctaactaataaattatcagctgtgtttatatgtataggcatgcacagattttggtaaatatgtacatagtatattggtgagcttatttttgtcgttcttaactcattgtgtagtctaaacgttggggaaaaaataaaatacaataatcagatggcgtgaataagaaaattgttctaatgtttgtaaaccaagcaacggttttaactgctcccctcttcctgattgacttccaaaagggattaatccatattaggtcctgtcgtatatgtcacggtataacatctccagctataaaatggaaatttgagaataactttgctgctactcagatacattttatttcaaaaacatacactaaggtgttgctgttggatctttccaaaaacatattcacacagaactttcaatcacactgagccatatttgaacaatctttcaaggtcagctctggcataagctaacattataccatttaactcagaaatttctgtagtatttgattaatgggtttatgtttgatatgtaatgtaattttctaatgctaaatcaagtggtaattttgttagtcaagttgatttagtggcttgggaagaaagcttttaatgttcccctaatttttcttacctttgacatgatccttcacatgtcttattttgcttagtgatttttcttttttttttttttttgagacagggtcttactctaccacccaggcttgagtgcagtggtgcgatcacagctcattgcagccttgacctcccagactcaagctattcttccacctcagcctcccaagtagctggtactacaggcacatgccgccaaacttggctaatttttgtattttttgtagagacagagttttgccaaattttcaggctggtctggaatttctgggctcaagtaatcctgccttggcctcccaacatgctgatattacagacataagccacagtacccggccagttttctttttttaaaaatctattggttattaatttgaagccttccttttcatagctgtgctccttaattgggagcaaacatgaatggaccacaacttagccaattttctatatacgatctttgccatcctaatttaaaggaatattaattctttcttttcctctttcattccacaaacctgtattgactacatctaagttctaaatggtgcactggatgttgaaaaagttgatgatgagcaagaacaaaattccacctttcaggagacttacagttcaatatgggaaatataatttgttaaaatataaaagtgcaattgtgttacatgctgtacgaagtacatgttgacatgtgagcatataataaatgggctggaggccagaggattgccaaagagaatgggcctcctgctgagatgaaaagttgagcagggattagttggcgaaagtggagggacgaccctttctaggcaggaggaagaacatgtacagaatctctgaggtgtgatgcgacaaagtctatatgaaaaactgaagaaaggtctaatgtggcttaaatacagaagccagtaggagaggagtcgaaaagaggctggagaagtagaaagtgtctgcattctgcaggaacttatattgtataaaaagaatttctctttattctaagtgcaatgtgaagccaatgaagtgccttaaacaggtgatgtgatttgattgaatttattacttcacttaacaaatattcattacatgcccactgtttgtcagatattgctgtagcccctggtgatacagtagggaataaaacaggcaaaaatccctgtcctcttgcagcttataatggactgcaatgtttaatatgtcagaggaggtccacggaggagtgacttctaagcaagaatctgaaaaaaatgaggatatctaaggagggaacaaatggttcaaaagccctataattgcaagcaggcatgatgaagcaattgcagttgtcctgactctcaacaccgtggaactcaaaggagatggaaagattctttctctccctcatatattttctctctgtctatatatatagaatatgagacatttccctaatcattatgtgtaattacaattacatatatatatatatgtatgtaatatataaacatatatatgtaattgtaattacacataatgattagggaaatgtctcatattctactcaaaaataagcaatatagcaattactgttttttacattttacagttacagtttcagagaaagtttgatatttatctaaaatttttcaatgtatgaactttttcatttggcaaaccataattgtacatattcttgggatacagagtgatatttctttacatgtatagaatgtgtagtgatcaaatcagggtaatttccactaatttaaaatgccacctttatgttattgtaatttatatatatactatatatatacacacacacatatatatatacatgtccacatacagtgtgtgtgtgcacatgtacacacatgcatatgtgtatataatgcccagtataagcaatgtgcgcaaataaaattagctaacagagatagtatagagtgagaggagaggcagattaatctttgaggaaaagcacaattttatggctgaatggagaaagctgaggtggtttctaagatggagaataagatgaaaaatgtaagtacgttgtttgactgaattcaagaaagaagggtaaaagagaagaaagtagtggtcttatcattaaatgccacagagaggtaaagataaaaacaacatattgttttgggtttagtaatttaagggttaccaaattccgttttggaggaggaacagattccatgtccactagaatggaatgaacaagaaatggaggaggaaaataggtagtttttcaaaagttttcaaaaatatgaaaagaagaaatgaaatggtacttggaagagattgttgaaatgggagagactatggtggcttgtttagaagcagttgagatagatccaattgagatagagatattgactatataaacaaaagaatgacaaattaatagtgtaatggataacttgactttggcaaatattgtgaatttttgtgaaagtacaactaaaaggcaatgtcactccaataatcaccagagtaatcaatttgcttattgctgtccctttaaatatagttctctggtatcaactaacatgtttttaactaatgatgcttcttaaagaaaagggaaaagacctttttctttctttcagtcttcaatgattcactgcttcatctcgctccaccaaagataaatgaaatctacatctcttatacattaacaatgcatgacaatttataaatagctaaatttttggagctaacttgaagtacctgaatggaatttaatcaacccactaatctccttctcacttctcagttatttatcaagtttatgtcaagggacaaggaaaaattatccaaacattgtttaaaacaatcatcattaattagtaacacttatccaggggggtttttaacctttcccccactcaaggattattctaatgtcagagtagaataaaaaataagtgcagcgatgctgactcttccaagcttaacatttctcacaagtcaattagctttgtactgggaggagggcgtgaagggctgcttgcggtagttgtgtagcagcagcacaatggccgcagacaaggaaaacagtttctaggaattcctcgtatataattttatatttttgacaagattaatgacccatgctcccttcctctccatttctttttttggaattctgttggtatgtagttactatattttattaaaggaaattagccttatctcttattatattttattaaagaaaattattattcctttatatttttattaaaggattttattattattattaaaggaaattagccttatctcttattatatttttatgaccttcaaagtagtgtctctgcttaaaagtgtaccttggccgggcgtggtggctcacacctgtaattccagcactttgggaggccgaggcgggtggatcacgaggtcaggagatcaagaccatcctggctaacacgataaaaccccgtctgtactaaaaatacaaaaaattagcagggcatagtggcgggcgcctgtagtcccagctactcgggaggctcaggcaggagaatggcgtgaacccgggaggcggagcttgcggtgagctgagatcgcaccgctgcactccagcctgggcgacagagcaagactccgtctcaaaaaaaaaaaaaaaagtgtaccctgaagcacacatcaagcgacatgtagagttcataaattctggccaaatggtcatacctcaaacctcatcagcactaaggctctttacttgcactgacaaatgtgaacgctggggaatttggaaatgatatataatagatatataatatataatagatatataatattatatatgtaatagatatacaatatataatatatatataatagatatatattatatataatagatatataatattatatatataatagatatataatatataactttccatgtgattttcctcttaatttttttctagctgatccatatgaattcctcttattaagaaaaataaagcatccaggattcaatgaagaactatcaccttgttaatcattcagaaacatattgcagacttaagccatttttgatacagatactgaaacaattactttctaagagcaaacttgaaggtatggataaggccctgagtcatcttcctgagctgaatgatagttaagctgaatgtacgtataaaatatgattttctaaccacttgctcgccaacaaggaaaacttttaagtagagcagaacctgaatagacaagacatttctttcttttggtagaaaatgatttaccatcactgtgtagttaattgtagactaggtaattttaactgtgatttattgccggagacattttcttctgtactgtaaagtgtgtgtcaaaaaaaaaaatagcgattttggaggattaggggagtttgataaattgcctgcaattctggcagtatgaactgcatattaatttctctctttctagaacatttttatttattaattccttacaaaaactccctaaactttggaacagctctcaattgcctgtattcttttttttcttattatggtactcttctagagatttggcttgcatctatgaataagccaggacatcttcagaaattgtctgattaaaaacaccaccaatggagtttcattaaatttgtattgatctgactagtgaaacacacacatctatgttgctgaggatattttactgcagtttgagttgtaataatagctctgtttaagatccgtcagtcacttgaatcttctctaaggctttggatgttagaagttaatttgctttcttacaaggccacattctatcttgtaactaaacaactgaattttatgtcttagcgtagatggtttattactttctggtttttctttagtaagaatcctataaaaacactagtatttttctctgagtttaaaattcaacacatgcctactgatatggttaggctttgtatccccacctgaatctcatcttgaattgtaatccccatagcccccataatccccacaggtcaagggagagaccaggtggaggtaattgaatcatgggggcagtttcccctgtgctgttcttgtgatagtgagttctcacgagatttgatggttttataagggattctttcccctttgctcggcacttcttcatgctgccttgcgaagaagctggcttgcttcctctttgtcttccgccatgattgtagatttcctgaggcctcccaagctgtgctgaactgtgagccaattaaacttctttcctttataaattacccagtcttgggcagttctttatagcagtatgaaaacagataaatacacctactatgtaaaacttaaaatacaaaaaaaaaaaacattatctcactaacataggagctaatattttggtgtactttgtttagtattttatattaaaaatatgtacatatatatttatatataattaagaacatgtatgtacaatcgtgcatacatcatgtacatacatctacttaagaaaatagctatgtaatataccattactcaactagattataatttttctccatttctttattgtaatttatcattttctacttttttgttttctcatttttattgcatatttaattatgcaaaaaatacattaaatacattgaaaatatatagtgtagctataagaataaagaacgatggtaaaacaaatgctaatacccactacctgacttaaagaatatgatactatttttttccaattgaaatcccctcaactactcagaattactgctatcccttttatcctttcattaattttcttctagttttctcacatgtgaatctatttctaaatacatttctttattttgcaagtttttggacttcatataaatgtaaccatattgtatatattcttcttcagcttcttactttttcactaaacaatatgttttgctgatacttacattcatatgtacagtaatagttgatttattttaatggctatatattattccattgttagaatacaccaggatttatttttacttattttttttgctggaaaattgggtgtcttttttattttttgatataacaaacaatgttgtaatcattttgtatttacttcctagtccactcctgtaagtttctcttgagtacatactagcaatgaagatgctgagtcactgcatatacatactcacaactttattctataatgtaatattctataaagtagctgtatcagtttatactttaaccagtaatggacaagattttctgttacttcccatctttgttaattattacttttagactctaacttttatcaggctcatggatgtaaaaagcatctcagggtgtttttaatttgcatttatctgctcatctatgaagatgagcttcttttcatataattatgagtcattatttttgttttgccttcttttgtttatgcattttgcttgttctgtgtcttatttttcctgttgatttttgggagttcatatatattctaaatgtatattcactcatatatatgttgcaaatattacagtttatgatttgtcaccttatgatatcatccaaatagagaagctttatattttgatgtagtcatatgttcatttttcctccttaatgtttgtttttcttggttctatgacctaccaaaagtaacaaaaattctcatttatttttaatctaaatgttttaagtattttcctggaattcaccttgaattgatttctattggagataggtatccaatctaatttgcctcatatggataaccacttgttctattactgctgtaacaaatttctacaaactaagtgacctaaaataacacaaacttgtcatcttacagtgtacacaagtcagaaatcaggcatgaattttagtgaactaaaatcaagttgtcgacaggcatgtttctttatggcggctagggtagaatccatatcctggccttttctatcttctagagaacatcagcattccttttctcattgcctctcctctctctttttaaagctggcaatgtcacatttctctgaccattctttcattgtcacatctctctctggactcagctaagaaaggttctccatttttaagaactcatgtgattagactgggcccatctggataacccaggaagatctctccatctcggtttgcatccttaatcacatctgataagcctttattgcattcagtgtaacatattcacaggttccagggttaggcatgggcatctttgcgggccattattctccctaccacattatttgcctagcatctttcattacattgtccatctatttacttactgatttctaatgacatccaaatcagttacaacattttatgtaagcattgtttttatttttatgttattccactagtctatttttctactcatgaattatggtacatgagtttatttttgcaactttaagctcaataacatgttttaagatttcctcaactttctttttccacttcttcagaagttgactcttttggccctttggtcttctatacacattttagaaatgctttgttgaggactaagaggaatgctaagattttgataggaatttcattgaattttgagtatattggcatgctacaatggttagtgttttatacatgaaaataatatatcccttcctcttttcctagtatcatgagatgtttgttaggcagacatgaatattgagttgtatcaaatgtgtttttctgcattattgtggtagtgatgtgatttagctcctttaattagttaatgtaatgaattacatttgtagattgctctaactattgaaacaagcttgaatttctggaataagcccaatgtgatatttattcaacaaatattcattgagtatacctagtatgtaacatgctttaagaatacaccagtgaaccaaacagaaatatctgacattacagaacttaacattccagtatttggagacagacgataaaaaagtgaacatgtatatttacagtttgtcaaggaatgataaatgaagactcttaaagtagatggggaattgggagtgaagtctgtaatttaaatagggtgggcaggaaagcttcacagagaatgggacatttaagaatagacttgaaggacaggcaagagcaatctctatgtttatatgggagaaaaggttccaggcagatgcagtaacaatggcaagtatcctgaagtaggatcatgctggagtttttgtggagcatcaaggaggctagtgtgactgccacagaatcacccaagggaagatgagaagatcagaccagaacagcacttgggcatctaatgggaaaagtttctcaagccatcataaaaatttcacttttactataaatactacgagaaaccatgggatgttttacagtaagaaaggtggcataatatgttacatgttttaaacaaactctatagcttctgagttgaaatagattgtaggggctcatggcagaagcagagggaacatttaggagactactgtaaagaatatcatgaaaagaacaaacaacgctatgtaacatgcttaaatggactgaagaagatgtataaaatcaaaatgatgttaccttcacaccttgaatcagtatgataaacccccctccccaatcacaaaagaaaaactaaacacaaaaaccaggctttggttgctcagacaattttacaggtgagttctagcaaacatgcaaagaacgtttaattgcactgttacagaaattcttctggagacaagaaaatacgacacatcacccaaccaatttcataataacaatgtcaatgtataataacagaaaaagtggatctccgaagaaataaatttatttggaaataaacaagttttataatctgagatatttgtgctatgatcaatcataggtgcatcccaagaggttgaggtaaggaaaatatgtaaagacaaaaagaagtctatgcaagctgttttgaaacaaacatcattggtcacagggtctgatgcaggagctggtgttaacttactggcagaaacagccattgctaggcaagtgttcttgtgagggtggcttatctgaaatgctgcagtcttgaggaattttttatgataggtcctattatagagacacctacaggatgagctggacaaacagagtgtgctgggtgggcagaaatttcttgtgagtttatagaaagtccttgtgatagtgcttatcgtggacacacacacaagatcccctttttcatgacccggctccactttgctttgggtctgatgtaagtgactttgccttgtcattggcaactttcactgtagtataatctgcacattaaagttacctaacaatagtacaaagaaagaaaattaaaggtatatctctttcaaaaatataaaccccaaaattgttaggaaattgtagtgagtataaaagataattcattataatagacatctcaagcttcacagaattctgacctttgctacactctcatccacaatcttttctcctagtaaatggcagctccttctgttaagttgctgaggcttcttattgcttttttcttcaaataacagtcagaactgaacaactgtaatcatcctagtccatacaattgttatattttcatttaaagaagatcaatgtgtggttcttttttatatatttctggacaattctttatattttaatagtcagaatttgatcaggaaaacagaagacatcctatgtattataatgataaaagtttaatattaattagggccttatgctattattggaagagcttggtgaatagatattagaaaagcagctagacaaaatcagaagaggtctgttttatatcagagatcttagcctgagagtctagagtgtgggcacagaacccaagcttataggaatttctgaaaggtctgtaaatcttatccagatggacagtgggagctcataaagaattctgcaagccatcacatctgtcaaacctgctatgtctaatccttaagcctgctttatgtgaagacctcctcttcactcctcacttccagctctcatgagtttctttcataggcaaacccaaacctggaacaatgtgcctgaagacttcgggtgacacagtacccagacttaaataggaggggagccatggtggaagtggccatccagcacagttttcttggtctttactcatagttttgattccttaaaaaaattaaccacattaaaatatgtgtttcataatctacatctaataataaaaatatttaaagtcttttcaagtgtgaatatgctacccatgttgctgctacccccattttgtgtgtgtgatttttgtgtgtgtgttagaagctcatgacctttgaaacctactcttatgagcttgctttgatgatttatttgtccagagaggatttttttttcctacctagcattttggactgctatcaacctgagaccactttgaattaaattctcagcttgcaaatttggaagccacacagattgtatgagttcaggctgaaacctgtttgagagctggattctggctataaactccacagggaacattttctctctccactcagagctgagaccatagggaaatttatttgctagctctctttgaaggtttattttatttatttttttaatttctagtacacgtgctcactgaaggtgtaatacttatgtgagaatctcaaaatcagttgtgttctttgtatgaccctggttttgtttcctcctgctctcttactttcagtgtgtctcattatgtctgctcaatatgtcatcttaaatttcaactgagggtggatcttcttcccagctcactcacatggttcttatctagattcagtttctctccatttgtaggactgaggacctcagttcttcacttagggttggctacaggtaatcatcaatttcttgtaacaggacttacactgggccactgacagcatgccagttggcttcattcaaatgagagggcaagagaaagagagagagggagagggcacaagatgaaattcacagtatcttataatctaatctcaaaagtggcatctcattacttttgttctattctattcaatagaaacaagtacctgggaccagcttatactataggaaagaaattatataagggtataaataccaagaggtagagatcatcaagagccattctggtagcagccacaatatcttatccagaatatttcttattcaggccttcaaatgtgctgtcttttctggtctaatggaaatgaaccttccttccatacaatttcttctcctaaactgtactctggctctcttatcacatacaaacgtctatgttaggtatttgtgtctgtcttgattcttggtaggcttttaaactctgtgaatgttggactgtgatgtagacatcatttcaccacacactctgtaaccaccaaaccttagcagcttattcagtaagcacatacttggctcttaatgagtattgcttaaattgatgaattgaattagtattttaccttctctgttgcttagctaagcagaagaatttgtcatttttttaatttagtgactggttctattaaaagttacctttgtctatatcattttgttatactaaagcacaaatgtataaggtcaaaaaacattctcaagattttgtttaaaccacagccctcagttgtgtatatttatctcttgttttcatatgcaagatttctcctgaaatgggcaacaatttcaagagtttttttcctcttctgaactaagaaaataaatatttaattcacaagtttagaaaagtgaacctgaaaaatcacagggctaggtgggttatgaggcccactggtacatgatagtgttgaatgtggattagaatgaactccgtggattagaatctcagaccataggcaaacatttacttgttttagaataagcacatttgagtctgcaataagtattactatttttaagttgaaaatgtaattggtttctaataataaccatattggctagcattatttcaatcgtgtttaatgttttccaatgtcatttcatgtcagatatctctcttgattcttagtaacaatttggacaagacagcaaatgctattgtccaagttttctaaagaagaatctgaagtgaaatgacatcaagagacctatcaagacctgtatccaggaaaaggtaaatctgagctgaaactgtagcccttgtaaattacctacgtgacataccagatagtgttcatgatccatttagtactctgttctaaaaacgagacaatatccatttattcacttgttcatttatttagtgtttgttcagcccttactgcatattccaggcactattctgactgtggcaggagtgaacaaacaggcatggttcttacttgcatgtaattacagtcttatagtgaaaacaagtgttaaacaacaaaatctcccaattattttaaaattataaacttgattcgatactatgtggccatataattgttcctaatttggttggagaagggaggcagttagggaagccttccctgagttagtgccatttaacctgatttatgatagatgataagtaatttgtcaggggaaaaatactccaggaataaagaacaggtacaaaggtcaggttctgggaagagcttgtcttggtccaggaactaaaaaatgttagagtggctggatctgggaaagagacaaagagttattaaatgaggcagcaggcttcagcaggtgccacattgctcagggccttgtaggccatgctaagtatttgggatgttaatgtcagtacaaacaattgagtcataagcagaaagtaaaagcatgattccatcaaatgttattctctaaacagtcattttataaatacaggttaaatgtgtgtggttccagctactcaggaggtcccagctactcagtattccttttcaacaaatattaggtgcctactattagccaggtacagcccttagctactttgaatgaagcatatattacaaactggcagaatttcttaaacaaagaatctaaagttgtttatacaccataatctcggtattttataaatttcttgaaattatttttatttacactgctttgcagaattttaactggctttgaaataaacaatgacaatagtcctccatgttactagtttcaaattttcccaatacctactaagacattacttaatccacagatttactgtcaatagtttgtatcaaattgtgataacatatttgaaattaatatttcaaattaaagcaaaatcacaaatttatactttatattatgaatgagattcacaaaaggagcatgataatatattctgttgtcatcgcatacaaaataataacatatagagtatgaatcaataatttttcaaatacaaagctattacaattaggaatacaaagaaatcataattaggaatacttctacaatattaacacacaatagtggtaacacttgcaaaatgatggtggtgtttttttgtttttcttttttgttttgttttttttcccgacagagtcttgctcttgttgcccaggctggagtgcaatggcgtgattttggctcactgtaaactccacctcctgggttcaagcgattctcctgcctcagcctccctagtagctggtattacaggtgcctgccaccacacccagctaatttttgtatttttagtagagatgggggtttcaccatgttggccagcctggtcccgaactcctgaccttaggtgatccaccagcatcggcctcccaaagtgctgggattacaggtgtgagccactgcgtccagccagtggtgggtctcatatctcaatgtgggcttttactaactcccgatgcctcagtttcctcatcagttgaaaggaatgaatgaaagatatgtgtttttcatattaccaggtagatgataaggagattttaattttctttttttttttaacttttattttaagtttaggggcatttgttacataggtaaactggtgtcacagggggttattgtacagattatttcatcacccaggtattaaacctagtacccaatagttatcttttctgcttctcttccttttctcaccctccaccctcaagtagaccccagtgtctgttttattctttgtgttcattagttctcatcatttagctcccactcataactgagagtatgctgtatttggttttctgttcctgcattagtttgctaaggataatagaaggtccatccatattccagcaaaagacatgatatcattttttaatggcgacatagtattccatggtgtatatgtaccacattttctttatccaatctgtcattgatgggcatttaggttgatcctatacttttgctattgtgaacagtgctgcaatgaacatttgtatgcatgtgtctttatggtagaatggtttatattcatctgggtatatacccagtagtgggattactgggtcgaatggtagctctgcttttagctctttgaggaatcactattctttgtacaatgattgaactgatttgcacacccaccaacagtgtataagcattcccttttctccatagcctcactagcatctgttattttttgactttttaatgatagctattctgactggtgtgagatggtatctcattatggttttgatttgcatttctctaatgatcagtgatgttgaactttttttttgtatgtttgttggctgcatgcatgtattcttttgaaaagtgtctgttcattccctttgcccaattttaatggggttgattgtttttcttttgtaaatttctttacattcgaaatgttttattattaagttgagctgcctcattcttagtatggtttttcactttaaaaagcataaaggtggacatggtggcatatgctagtaatcccaactactggggagactaatacaggagggttgcttgagcccaggagttcaaggctataatgtgctatgatcatgactgtgaacaaccactgtactgcagcctgggcagagtgacatagtgaaaccatctctctaaaaaaagagaaaatgtaatttaaatctttaaatacatatgtatatgtgtgtatatatgtatatatggtgcatatatcaaaaatagtttgtagtttccattcacagcacatagtaaaatgtcttaacctcctccctcctccctatgtgtgtttttctaagtgtgtgtcttttttaccttaatttttctcttagtgtctcatactcttcttaggtctccctctttcttctgtctttcacacacacacacacacacgcatacacacatgtaccttgaaaaatagcttttctttttcttaaaacttcccaaagctttcataaaattagccctcaggcactcttacgtatctcatccactcttcttcctctctccccttcctgaagccatttgtaacttagtctattacactaggaaggggaagcaaatattcatattattttcttgttatatccttagcattactagacctttgtggtttctatggatgagggacataatatttattaatttattctaaacttcagtcactcataatatacccttttattcctccttcttctgtgatattgggagtgtatagttgtcattgtgacaaaccctttgctgtcagtatctatagtggatggggagaaaaggagggctttgccaatcatcgtctccagtgcatttcccactgtcagcgtcattgtctaatgctgtttgcatccacacagcctaagggaaccgtttaagtgagtgactccctcccttcacttcagcccatcacttgagcatttctctcccttgaaaaaagacaagtggtgcttctaagacttgagtaattctgaatataattgaggactagatgttcctgttttatatcctacagggctggcatctctaatgctgaaagtacaacaaagtgcagtggtagtcactgagtgttcagccatgctgggtcatcaaaataaaaggagatcgtcttcccattcctatcaatggcctcatctctaccagatatataactggaaaaacaatgcatttgcttagacatccacagtgagccacacttgttcggtgttgtggggaaatgatgcagaagcatccttgtttattaaggatccaattttgataggctgaggcatatttttcctcccaagtctgcacatggtcatgtattaaatattaatgagcatcttctctctatcaggctttgggggatatgttcacctcttgggaggtgaacatgataaataagatcctttctctcatggagcattctctccattctttttttttttttgatagggactagctctgtcacctaggctagagtgcaatggtgcaaacatgactcactgcagccttgacctcatggactcaagtgatcctcaagtgatcctcttgcctccacaacatccagctaacttttaaaaaattttttgaagagaaggttttgccatgttgcctcagcctcctgaagtggtgggattacaggtggcaagggaagggaaggatggctatctgccttcaaatatttgaaagggtgtgaaatcaaacagggaaggagtcctgttcagagccccttagaagatgccggggtcagggtggggggtggtgaggcctctcaccttcaaagagcaccttctgccactggaagggtcccaaagtgacagcaaccaccccgcgtcgagccctcactgcgtgccaggcactcggcttgcctgacgctttactggcatcacccctgaattttcccagcaatcccaggagggtggtaccattcgtattccttattttacgaacgggaaacgcgaggctctcactgcttgagatcacacagctagtgaacgactgagtcgagattcaaacccagggccctgctgagaactattatgctgcaccgtaggctgaggagacctacagccctgggaattctaagactgtgatgcgataaaacacaaatataaacatgggaaggccaagataaggctgggagttttaaatttattttttttttgctgaggtgtcttgggtacaaggaagacaggaaaggtggatgctgagtagaatttgtacctcggtgtcaccgtcctcatccccgacccctcctagccgcccccgcctcaatgtccccttcttctccaagggaatctactcgcaccatcacactagccccggctgcggcccgtggaggccgaggagggccgcgcacccagcacccagcacccagcacccagcacccggcccgaaggccccgctgctccccgggctggcggcggcaggagcggcatcgcggaagccccttccgagccccctcgggccgggaacgcgggaggaggcggcgccctgcgccgggaggccccagacaccgtgggcgggcggctgtgcgcggccaggctgcgtgggagcgggcagcggcggcggggggcgctccgcgcgggggttggggcgcgggggttggggaggcgggggcgcccgggccgcgcttcccttcgcgggtgactcagcagccgccttcctcagcggggcggggcgcggcgggggcgcggggaggctgtgggcacgcggcttccccgcgccggggtgcaggtcctcgccgccgcccccgcgaggaagtgcgaggctggacgctgggaggcgcgcgtgggccgggagattccttctcgcctgccggctaccagccggcccgcccacgccgccgagatcccgactccacgttccctccccacggaggagtcggggcagcgcacggaggcggaaaggctttccccaggctggcccggcgagggtcgggggcgcagggactgaggggacaccccaggggggccagctgcacccccgccctcccctcctgctgctcccgggttttacgcactcacggtcggagggagccggctggagatttctggggtcttagatgtggaagtccgtgcagaatttacctcgttctgccccagggcccccgggtacctgccaccttttgttcttgaaagggagagatgcccctctgctgagccagctggagcgtcctttctgtggctcttgccgtgtagaagtcttttttcgtatctaagctcggtccctcctgctgcggtgacccccagacagctctgcttcgccagactcggcgactgggtagagtgggcaagaaggaggaccaagaacgtccccactgagcaggaggggaaatcaaggcccagagaaggggaggggtttccttcaagcttatagctgggggtgtgtgagagaggtgctgacctcagtactcaggagttccggcttctaggtcagagtccagctgcttgaaaagataatattcctccctggtgctgcccagcgcagtgcctctacctgtctctggaaatccctttcaccttctctgatgggttcttaccatgcgttaagtcgcatcaagactgtcggagatgccagatgatgccggttcggaagcatccagggtaaagaccgggctgtgcgcgggaaacacggaggctggacccaagcaggaaattcccacccg

SEQ ID NO: 500 - DNA, 2230 bp, Homo sapiens
atgagacactcatgttagaatgcattaaaattcaaaacaagaaagttcacagggcaggaaaagttttatctcagggaactcttgccaagactgtttctatgagctaaaccggtaaagctttcacaatttaagcaagaacaatcttattcttggtagacatgaaaccccatgaatacaactcggtgactatgctaaaaccataggacagggcactccacaggggagattttcatggcatgtgaactgcatctcaataaagacataagtccctgcaaatatccactaccatgggggctgaaaacacttgcacggcttcccactcagagccagcccacctcaggcctgcagcctgctcctgagcatgcaggcctagcactgaaaggaccttgcactggcatctggctgaccgccataagctcctgcctagtccatgtcccttggcccagctttccagccccaagcctagagatgcccatcagcaggtctccccgcatggcaggagcccagggatggcacactctgccctatgctgtgcaaccacaaggctgtcctcagagatggggctgccctgccctccgggctataccctcttgcttctccactggactcacaggcctgtcctcatggggttagtacaacaacctgtgagctaagagttagtttcctccctttgtagctgcagaaggaaaaacaactccgtcttgtgatttgccaaactctcacagggcataactgtggagtcaaaacccagcttgggtcttgaagcgaaggcccccttgctttcttggggggaacccccacctacactgcacaccccttgcacaaggcccacgaagccccacaccaagcagttctccccacacaagccagcacccccagccccctgcctgcgctcagcaactgcacttgtacaaggagaggggtaccaatgaaaggggctgccccacagtcccacaaagtagcagcagagtccagcctgcccctgctcccaggaccctccacctatctcgatgcacactcctacccatggatctcctgggcttccagtgggcgaggctggtcttcccaacctgctgtctgccagctgtgctccaggagtttactgagtggtcagaggccatgtgctcagtagtcatcagactctgactccagcccctcaggtccccaatccaggactcacttgcgctggtccttccaaccaaagctccgctcgggctggtcccattcctgggccaggacaaagcgcagctcctggtcagtggagaaggtggcgagagagccattcaggcgctggcaggtctgcgcggcatcccagtagttctccccgctcaggtagacccggtagcagctggccgtgccttcgtagtggtgccaccctgtcgggcacttccctaggaaacataaaggacagaaggggagttgtcccccaagttaggatccagctccaaaatggaaattatatgtactccatcagggacaggcacaccttgtaaatcaccctagagaagtggggaaactgaggctcaagaggacaaggtctgcttctgaaaccacattgcagaaatgctcaagtttctctaaaacacagattcaatgatacaagtacattcggtgactcttcccatttctataagatcttttaatttattcactagtcaagaacggctgctgaattaagtcttgtaaagtggatttcattctctgggttaacaacacagcacaactcccatgcagttcactttgggccctgcttccaatgcccagctctcctggcctccgctgccagctagctcactcccctctctcccttttctacttacatgagcatttgcagtaggggctggccaaccctccactaaaacagcagctcaaaggataacagctgggagagccatgacactgtgtgacccgcccctgcctcccacagccgaaaaaaataaggtgtgggcgatgccacaggtggcaaagctaaggagccagccagcacttgagtatcaatgagtctggccagcgtcctctcacttcctccacccatcacttccgactcctacacccacacacgggaatgcctggtaatttacagctcaccttaggtaacaccagtgacctcttttatagaatctttaaccttcaaatgttgggtacctcatattagtacactggagaagagtgacaatttttagcaaagccagttgtaaaattaaaaatgccatttttaaagtgcagctat

SEQ ID NO: 501 - DNA, 1093743 bp, Homo sapiens
  misc_feature (526527)..(526527): n is a, c, g, or t
  misc_feature (526547)..(526547): n is a, c, g, or t
  misc_feature (526549)..(526551): n is a, c, g, or t
  misc_feature (526553)..(526554): n is a, c, g, or t
  misc_feature (526556)..(526556): n is a, c, g, or t
  misc_feature (526651)..(526651): n is a, c, g, or t
  misc_feature (526655)..(526655): n is a, c, g, or t
  misc_feature (526661)..(526661): n is a, c, g, or t
  misc_feature (526671)..(526671): n is a, c, g, or t
  misc_feature (526698)..(526698): n is a, c, g, or t
  misc_feature (526702)..(526702): n is a, c, g, or t
  misc_feature (527906)..(527906): n is a, c, g, or t
  misc_feature (542313)..(542313): n is a, c, g, or t
  misc_feature (549022)..(549022): n is a, c, g, or t
  misc_feature (549028)..(549028): n is a, c, g, or t
  misc_feature (553784)..(553784): n is a, c, g, or t
  misc_feature (553788)..(553788): n is a, c, g, or t
  misc_feature (553836)..(553836): n is a, c, g, or t
cacttatttcattttcatggcactggccaatttctcctttgtttggcaaaaatgtttttccctcctacctccacttccctcatactgctcccttaataggagccccctcctgttttgttcctccagtcagtaggtgccctttgagatcctgccaagtggaccacaccaggccaggcattaagggggatatgaggagaaccagaagaaaagctgaaaccctcagctgcaaagtgtggggaggctgtaactgatacagtttgggactgtgtccctgcccaaaaatctcctgttcaattgtaatccccagtgttggaggtaaagcctggtggaaggacattggatcatgggggagggtttctcgtgaatggtttggcaccatcccccgtggtgctgtctttgtgacagtgagctctcatgagatctggttgtttaaaagtgtggagccaggctgggtgtggtaactcacgcccataatcccagcactttgggaggctgaggtgggtggatcacctgaggtcaggagtttgagaccagcctggccaacatggtaaaaccctgtctctactaaaaacataaaaaaattagctgggcgtggtggcgcagcctgtagtcccagctacttaggaggctgaggcaggagaatcgcttgaacccgggaggcggagattgcggtgaactgagatcgcgcccctgcactccagctccccacttggtctcttgcacctgctcctcccaggtaagacacctgctcctcccaggtaagacacctgctcctgcttggccttccgccatgattgggagcttcctgcggcctccctagaagcagatgctgccatgcttccggttggcctgcagaaccatgggccaatcaaacttcttttcttataaattacccagtctcagctattgtctcacagcagtgtgagaacagatgaatatagtattctaggtgggaaataccaacgctgctttttccctgttctcttgggtgggacaggaggacgccctgcactgcttcttccagcccagggagttatcaagcaaaagcaagtgcttctgtgagaactgtgggaagaagacccgtgggaaacaggtactcattccctaaatcagactcagctgtccctcggtgcatatgggggatttgttccaggacccctgcttttaccaaaatccacacacactcaagtcacacccagtcggccctgtggaacccacgtataggaaaagtcagtccctcatctatgcggttgtgcatctgggatactttatttttgatgagcatttggttgcagatgtggaactcgtgcctatgggggagggcagactgtatttatttacaacaatttgtgtataagcggacccatacagtccaaacccgtgctgttcaggggtcatctgtccttcactagtctggggttgccccccgtggatttcctgatagaatcatcagaggccccgaggacaccccatggtgggtgagaaagggaatctgggtctggctagtatctgggacgctgtggttctgatatctggagccgtggatgtggcttctcatgtcgcatcactgagagggactgcaggagggcgcctgagagcagccggcagggcgtttccctccaggcgagaccagctccctggagcagacgcggtggctccctgggtcctggtacctgtgcagagccctgtgcccttgtgcctcttgtggggggccacatggtggtagaatagccaagttttgcattattctcagaggagctcagcagattcggcgaacaggagccttgaactccgtgatgtcgccccgctcccctctttttgggaagaacgcgttgctagccctgacatttctctgactctctcattccaagtagacttcatctccagagtgattttgatttttcaggtcttgaagctgacccatttgccccagaccctgacaatccacctcatgcgattctccatcaggaattcacagacgagaaagatctgccactccctgtacttcccccagagcttggatttcagccagatccttccaatgaagcgagagtcttgtgatgctgaggagcaggtgggatgatcccgacctccttgccatcctgcctctccccagatgccatgtcctttctgttttcccttccttcacccccagtctgctaggagccacctgttcctcagagactgtccccagcctcaaaagcctttcttctttctaaatattggatttgtgttcatatgcctcacagcactgagggacagaatccagaattcagtaggcttctttggaaataatgtggaatacatagaaatgcataggcaaacatgtcattgtgggttcatagtaccaaccaaactttcttcctcagatggcctgtgcccactttgaggataatcataaagtagccagttgactggaccacatttaatcagagtaaagtttaattcacttgtcctgagataataacttatcaagagattctgagaaaaaaagagacacaaggccaggtgatgtggctcatgcctgtgatcccacacctcaaaaggctgaggcaggaggattgcttgagcccaggagttcgagaccagcttcagcaacataatgagacccccgtctctcaaaaaaaaaaaaaaaaattagctgggtgtggtagcacaaacctttagtcccagctacttgggaggctgagttggaggatcacttgagcccaggagtttgaggctgcagtgagctatgatctatcattgtactccagcctgggcaacagcgcaagaccccgtctctaaaaacaaaacaagaaaaactaaaaaaaaaagacacaaatatctttttttccatagatttgaaatgctacataacaaattttgtattcctgtatgtacgggtctatttttggagtgtctcttctgttttattggtctgtttggctatttatgctctagaaccatgacatttagaaaattaagacctgataatatgttacaatagctcctattataacatgatttctttacctacttaggccgtatacatttcataggattctctttttctttccttctagttctttttatttctacctgcagattctgcccaatgaagtgtatttaaaattgtttttcacttaaaaaagacttttttgactggatgcagtgggtcacgcctgtaatctcagctctttgggaggccaagaggattgctggagtccaggagtcgagcccagctggacaacaaagcaagactccatctttgcaacaacaacaaaaaagactttgttatggaacattacaaatagataccaaagtgtgtagtgaaggaagagttagacagtgaatccttggctgtaacagttaccaaaactcatggcaggtcttgcttttcctataacccaccctcttgtttcacccaaccctgtactggatttttttgaagcaaatcccagacatcatactatttcatttataaacacttcattatgtatccctaaagaataagcactcaaaagataatcatctccatcttgcaattccttaatagcatcaaatatctggtcaacgttcagacttcctgactgttgtgtaatctatgtggtttgtttgactctagatccaaacaacgcctacacttgcatttggttaagtttctttcttttcttgagttccttttagatttccgctccttttcttttccttgcagttgatttggttgaatatttttttcatatgccagcactggctggttgatatcttttaacatgttcctgtaacccttttatttcttgtaaactaatatttagatacagatattgccctgcattttgtaaagttctgcacaaagtctgcaaatggaaatagggataatttcagcctccactgtgggtgactcagctttgcgtctgccgcccttgccctctgtctcccctccccctacaaaagacttttttggctgggtacggtggctcaggttagggtcattcctgggcttgtggagaaacagaactgtgttctgatgatccccacccctcccaggggaaagttctaatcttgccttggctttgggggcctctctcatgacctgccttccatctcttgcgtgctctgccctgccaagctgctgagccttcgcagttcaggatccacactcgggaaagcccctcctggagggtgcccactggctgtgggtcgggactgttttctaatattctaaagtcccagagtcgggcctagtgtgggcaggtataaatgtgtgaggcagtcgtgtttgtggtggtgggtgaactgtctcgtgcctgtctctttccagtctggagggcagtatgagctttttgctgtgattgcgcacgtgggaatggcagactccggtcattactgtgtctacatccggaatgctgtggatggaaaatggttctgcttcaatgactccaatatttgcttggtaagaaacatcatccacaattgcctcctgccctggattggccacctctagcaaatgctgggctcagggctgcgtgggtctctgagatcaagacacactgtgatcctgctgtctgggtgtggggcctttgatgagggttcaagcctttttcggtctgaagtccccatgtggtttgcacctctgtaagggttcaattcacttcacttctaagtttttggtgctctaggctcatgctctgcagcttcctgctttgtgggaaatgtctagagagcaacgagtgttagaaatatgtaagttaggcctctgggataagcatgaccaagtttaaacacagggacaagggcactaaacatacttcattgcacaagacatcctgctgctgttgctccaggctcttgggagttgctaggggtgggcttgtctggaggatgaggggcacattatagcatcctgtcctctgtgggtgcttgtgtcagctggctgcttgaccccatttgtttctggcttccaggtgtcctgggaagacatccagtgtacctacggaaatcctaactaccactggtaagaaacagatttgggtaattggagtctgatgagctcacatagggtccttggagctgcatgaaacgcccatggattcccctgttactaacatgctgatggctcactgtccgcctcatctccagcactcaccccaccaccccatgtttgcctcacacgtcacactccaggaatattaaagtacaggtagctgccaatcagccgtgccctccatctcccgtctgctgtgcacatgcacttcctggccgtattgtcctctcctcgtttaccatctaggccaactccccactcatgttttcatactcatggccttttcctatcctgtgaagcctttgctgattcacccagattcgtaggggcttcttgtatggttttcttttcttttcttttctttttttttttttgacggagtctcgctctgttgccgggctggagtgtagtggcacaatcttggctactacacttggctcctcctcccaggttcaagcgattctcctgcctcagcctcctgagtagctgggactacaggtgtgtgccaccacgcccagctgattgttttttgtatttttagtagagacggtgtttcaccatgttggccaggatggtctcagtctcttgacctcatgatccacctgcctcagcctcccaaagtgctgggattacaggcatgagccaccacacctggccttcttatatgcttttattgcatttgagcatacctcttttacagcgaagatcttttttttaatttaattttatttttagagatggagtcttgctttgttgcccaggctggagcactgtggtgtgatcatagctcactgcagccttgaactcctgggcacaggtgatcctcccacctcagcctcctgaatagctgggactacaggcatacagtctgtacaccatgcttggcatattttaaaaaaatgtttgtagagatgaggtctcgctatgttgccaggcttgtctcaaactgctgggctcaagccatccatccatttcagcctgccaaagtgcttggattataggcatgaacactgcgcctggccatcacactgtttttttgtttgtttgtttgtttgttttgagatggagtcttgctctgtcacccaggctggagtgcagtagcaggatctcagctcattgcaagctctgcctcgtgggttcatgccattctcctgcctcagcctcctgagtagctgggattacaggcgcccgccaccacgcctggctaattttttgtatttttagtagagatggggtttcaccgtgttagccaggatggtctcgatctcctgacctcgtgatccgcccacctcggcctctcaaagtgctgggattacaggcatgagccaataaatatttttataatcattaactaccgaggagaagctggagagaaaaaaggtggatgaagttaaggcagagagactttgtaagtttcttagctgagcttttggagactgtatatcagagatcctatttgaggtgattttcagctacagagataggcctggtcatttgaaaaataatggattaggtgaagcttgcgtttgaaatcctccttctacttttcatctttctctcttgtttattctgaacatccatcttagacacccaatctttgtcactttgtggttgtcattgatttccctgttattgagatcagaggttggcagactttctctgtaaagggctggagagaaagtacttcagactttgtggtctgtgcggtgtctgttgcaaccacttaactctgccctgtagagcaaaagcagccgtagacagtacatgggcagatgagcatggctggggtccagttacatttacttgcaaaaagagggttggagactgggtgcgatctcccacctttaatcccggcaatttgggaggccgaggcaggaggatcacttcaagccaggagttcaagaccagcctgggcaacaaagcaagactccatctctacaaaaaaataaaaattattatagctaggcatggtggtacacatccatagtcctagctactcaggaagctaaaactgaggcaggagggtcagttgagcccaggagcacgaggctgtggtgagctattattgtgccagtgcactccagcctggtgacagagcaagaacggtctcgtcaaaaaataaacaaaaggctgggcacggtggctcacgcctgtaatccctgcactttgggagactgaggtgggcagatcatgaggtcaggagattgagaccatcctggctaacacggtgaaaccctgtctctactaaaaatacaaaaagttagccgggcgtggtggcgggcgcctgtagtcccagccactcgggaggctgaggagggagaatcgtttgaacctgggaggcggaggttgcagtgagccaagattgtgccactgcactctagcctgggctacagggcaagactccattaaaaaaaaaaaaaaaaaaaccagcaaaaaccaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaactaatagaaacatagtgcttatcttcccaggccacctattttgttcctctccaaggtgatggatagatgaaggcctaatccagccgcctggaagtttgctgacgcttgtcctgtcacggattaatgaagcattgttttctgatgaaggtttcatgccgctgtgctgatgtgtcttctcttctctctaggcaggaaactgcatatcttctggtttacatgaagatggagtgctaatggaaatgcccaaaaccttcagagattgacacgctgtcattttccatttccgttcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcaagacattagccctttagttatgagcctgtgggaacttcaggggttcccagtggggagagcagtggcagtgggaggcatctgggggccaaaggtcagtggcagggggtatttcagtattatacaactgctgtgaccagacttgtatactggctgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggattgtgctatagaaattcaaaggcaagggaagtcacttctgttgtggggccctgggaggagcctccaggctggaaagggttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaagacttggaagtttgcacctgatctggtgggtggtgaggggcccttgaaggggcaaggaggcgaggagcactcagctgtgttcttacactgatctgccactggggttagagacaaacgtggtgggaatggaaagccacgcacagtcactagcgcctctagggggagaatggatgtggctggtgagagaacaggggggcccagggagagtccggcaccaacctgggtgggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccggggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctaattttgtttgttttgtcttggagaggaggtcaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagtgggcactcagttccactaacgaatgatgcccgtgtggacagacagaatgatggacaggcagatgaatgcgtgggctttatgtgaaaaaggtcctcttggttgttgacaagatactgttttaaagttccattttgccatacttcgaacagcttgtcattagctcaatttagccacatgtgaaatcactaaggcggacggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctgttctatcaaaacaccgctacatagaaaatccccatgcacatatttctcctaattgtggaaatattttacataaaagactcttgacatgggatgaaattcccaggttattggaattttaatatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcattttaccaaataaaatagctccttgatgtcatatgaatccacgctatgcttaatgagtattggttagtaaaatgcctataactagtaatcttcatctatgcaattaaatattcattcataaaacacttcaaatgtaaacaataattagtaaaagaaaagtacataatacctcaattagaaaaaaatcactccattaaaaagacattatttgtgtgataaaagagattgccatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaaataaataaaagcctttaacccagaatgctgagtaaattggccaaaaatgctaacctatgcatttcaatattataggagttgcatgggtagaaataaccagatgaaatacttctggtatttcaccttcccaacccacacgagccagtgtttttctgtgaataacaaaaacagcagaatttacttgcctctccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagcccactgggctccggctgtttccatcacatggagaatgactcagagcctggcctccagccaccctcctggcctttcttcttctcactctgccactggctcctcatggaccaccagcctgggtgtcctcagacataccacacacttcactgtgggagtcacgcagccctcactgctccttcgccagggagccacggggctttcctcctcaggaggactctgcaagcagctggatgaagggccctcccgtctctcatccttccttaatttttgtcacagttctccttccttccactcagtgcagcgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacacaaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcaaaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaacggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagatacttccgaatgcaccactcttccattatatccagtcaattgctggttaccttgggcctaccaactgggggagggcaggggctgctggccacctcctcatctacagtaagagtcaatgagcagttaaatggatactgaaaaccatttatcctgctggagtgagaaataaatggtttctttcaatagcgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccgatcccgcctcctcactcaccccgggagatccctttaagccaggagtcaacagtgaggatggaaacatgagtgctttttaaagtcctgaaagttcagaggcagactgtcaatttctcctccacccctgggcacacaccaggagaactctgtctccaggttgaaggaagtgcctgtgagagagttgtgtccctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaatatcacagcaccctcatagcccagagagacagttctaactattatgccaataaacccggaaaagaccaaatccaatatgacacatatttcctgtttccttttgatttcatgccccctcccttaacctcccaagcagcatggataccccgaaggcccctgggaactctctccaattggatcttacgtggaaagtagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacattgttttatacttgcaaaatcatttgctctcaccagactccaaatcctccttcccaaaaggagcccagaatcaggtttctgtaccctagagatggcgttttttcctcaggaagtgagttatttcagggtaggtatcattctccagtgtcaatggctcctgcaattatagaaaagaaaacattaggagggtgaaatgatgccatacacgtcacacagatctgatagtctctcgacaacttgagagagaaaataagaaggggtatagtgattgagtcaaaggtcaaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatcgataatgcacactggcagatgttcatgtctacatctgattggaaagaagccaggaaagtaacatttctgttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattagtgatgtcgtatagagcgtcctcattagcgatgtcatatacaatgtcctcattagcgatgtcatatacagcaacctcattcgctatgtcttgtaaagcatcctcattagcgatgtcatatacaacgtcctcattagcgatgtcgtatacagcgtcctcgttagtgatgtcttgtacggtgtccttataagcaatgtcgtctacagcgtccttgttagcatgccttgtgggtgtcattagcgatgtcatatagagcatcctcattggtgatgtcttatatggtgtcctcattagcgatgttgtgtacagcgtcctcgttagcaatgccttgtacagtgtcctcgttagcaatgtcatatacagtgtcctcattagcgatggcttgtacactgtcctcattagcgatgttgtgtacagcatccttgttagcgtgccttgtacggtgtcattagcgatgtcgtatacagcgtcataattagcgatgtcttataaggtgtcatcattagtgatgttgtgtacagcgtcatcgttagcgatgccttgtatggtgtcctcattagcgatgtcgtatacagcgtgctcactagcgatgtcttttttttatatatatactttaagttttagggtacatgtgcacattgtgcaggttagttacatatgtatacatgtgccacgctggtgcgctgcacccactaactcatcatctagcattaggtatatctcccgatgctatccctcccccctccccccaccccacaacagtccccagaatgtgatattccccttcctgtgtccatgtgatctcattgttcaattcccacctatgagtgagaatatgcggtgtttggttttttgttcttgcgatagttactagcgatgtcttatacgctgtcctcattagcaatgtcgtgtacagcgtccacgttagcgtgccttgtcggtatcattagcaatgtcgtataaagcgccctcattggtgatgtcttgtacggtgccgtcattagcgatgttgtgtacagtgtccttgttagcgacggcttgtatggtgtcctcgttagcgatgtcgtatacagcgtcctcattaccgatgccttgtatggtgtcctcattagcgatgtcgtgtacagcgtcctcgttagcgtgccttgtacggtgtcattagcgatgtcatatacggcaccctcattagcgatgtcgtatacggagtcctcattagcgatgccgtgcacggcatcctcgttagcaatgccgtgggcagcgtcctcgttggcgatgccatgggtggcgtcctcgttggcgatgccgtggacggcgtcctcgttggcgatgccctgggcggcgtcctccttggcgatcccgtgggcggcgtcctccttggcgatgccctgggcggcgtcctcgttggcgatgccctgggcggcgtcctcgttggcgatgccctgggcggcgacctcgttggcgatgccctgggcggcatcctcgctggcgattccgtgggcggcgtcctcgttggcgatgccctgggcggcgtcctcgttggcgatgcccttgtcggcggcctcgttagcgatgccgtggacagtatcctcgttagcgatgtcgtgtgtggcgtcctggttagtgatgtcatgtacggtgtcctcatggggagctagaaaaacacagagttaaggtcagtgccctggtggtggagactgtgaatcacccaggggcttgcttggtgtgatgcatggaggtggctgatcacagcatgggtcaagctgatgctgggacatcctcccaggtggacctgcactagtgaagctaagggatgtggctcagaacactttctgcagtgggaatcagtttccaggttcaggtatgcattatctggtgaagtggggaaatataaaaaataaaaattgacaaattcatgaaaagccttccatgagtgcaagtgtgagttttttatccactttacattcagtatgcattcacacatacaaaatatttttacaagaaatcagaaattttaatttttgtcagttatgtgaaatctaacttagctgccagcataaagattctatctcatttacttggtctcgagaaaatctagcacatagtaagtagaccaaaatgtttattaaatgaaaacacagagcagagataggggggctgctaggcagactgggttgcacctgattacctggatgataataaactgcacaaaacctcggtcaaattaatattgaaactgccttttgcttgggctcatttcccttgcggaagaaggatgaccaagaagatgaacaggaaagaaatgagaaacagaggcctttgcttagtagctaaaggccaccttctgtaacatgaaatagtctacaagtggccttgaactctgccgtgatttagtgacagagttccctcatgtcttctacccaggttgaagtccagcaaaattgcgactgtcctctttacaacttgcgagaccacactgcttctgcatttgcctgttgtatgtatgagatttacacttgttttagagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaagtacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaacaaactctcatgacacacatttatatatgtagcaaacctgcacatcctgcacatgtacccctgaactgaaaagttaaataaaaaaaagggatctgtgagctgagccaaacacctggggatctttgtgcttttgacacactgatgactatgccggtccgtggggagatgagcctataactgccctgggttgtgtgaccacggaggccactttatgatgatgggcagtgtctggggcctcttgggctcgttgctttagggcttatacatgaatgctggactccctgtgtggtggtgaacaccccatgactaagtgcatgtcagcgtcagcactggcccacactcctgggttcgtgttttcactgtttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggaggctcttcacattgaaaccaggcaaggatgccacacctttcttggcatccagattgttttcttggcaagtgattccagaatacttactagattcaagcctcagaggggccacctgcaccacctgcaatacagaaacaaagctttttgaggggtatgtcatgttgtggattgtttgcacaaggctctgtttctctcaatgaatactgaaaacttgatcagaaagtgtagtcaacttcaaggcctccaaaacaagagtaggatacacactggaaaagacatcagcttctggatggtggatctctcaggtccacgtaggttggcaagtgcaaaatactgaatccaaggagaagacattgcttccaaggacaaggaccccaaggatacagtctacaacctgaagccgtcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcgcgttgactggcctctctccatctcctctgtccttgtgaactagagactcctcagaggctaggaggacacagagcaacagttagtcatagatgcttttgttcatgagttattcagggagctctgcttaatgtggacaacaggacagtgtgtgtggatgtgtttcattaaaagcacagcttgagctcctgctagaaaatcttccctcgtggaaagacaggcaagaacgaggagctaaggagcgagaaatagagtccctggcattttgctgatggcaacttaagaaaatgggaatgagtcagtctacaaatggtactgaagcacatgctatagtttgatgagagtcccactgctcacactgtgaggtttgaaacccagctaaatggttttctaaacctgtaaaaacaatattagcttgcaggatttatgtcccaagactacttttacctctgaggatccacagtggctgtcactgcagttatgtgttttagcattttgcacttgaataaaagcaaagtttaatagatagattggattcaattctaggcaaaacagtctatggtatttattcactaatcctttgttataactgctgatgggagaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacatgggttgaatgctggtgtgttttaactctgcagtgcaaacagctgcaacaagtgtggtgaactaaacaccagatggccctttgctgccttatttgtcattgtgccttacatgtagcttgcaggatttgattacgcttatgttttgtggtgatcatactttcaactattcctaaaatactgcttcagtcttatctgtttggggtcaactgccgaggatttcatacaaattaatgaagtttgtgaatctaaagttctacacaaaggtggaaatatttgcaaatcatttatcttgtaagagactaaaatttagaatatattttaaatatatttaagatatattcaaaaatctacagcaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgtaaccctgatacattgatggtagaaatggataaagttgcagccactgtgaaaaacagtctgcagtggctcagaaggttaaatatagaacccctgttggacccaggaactctattcttaggcaccccaaagaatagagaacagaaatcaaacagatgtttgtatactaatgtttgcagcatcacttttcacaggagccaaaaggtggaaataatccaaccatcagtgaacaaatgaatgtaacaaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtgggataggaatcaccatgggctggaaatagggggaaggtgctatattgcttattgtggacaaggttttgtaagaaatcatcaaaattgtgggtgtagatagtggtgttggttatgcaaccctgtgaatatattgaatgccatggagtgcacactttggttaaaaggttcaaatgataaatattgtgttatatatatttccccacgatagaaaacacgcacagccaagcccagatgccagtcttgttagctgccttcctttaccttcaagagtgggctgaagcttgtccaatctttcaagattgctgaagactgtatgatggaagtcatctgcattgggaaagaaattaatggagagaggagaaaatttgagaatccacagtactcaccctgcagggccaagaactctgtctcccatgctttgctgtcctgtctcagtatttcctgtgaccacctcctttttcaactgaagactttgcacctgaaggggttcccaggtttttcacctcggcccttgtcaggactgatcctctcaactactgaccatttcacctccattcatgtccatgccacatcaggctgtgttgtctagatggaatgaatccaccccaaatgtccctttctggaggaagccaccattatgctgtacctccaagcataatggtacgtccacacacaccaaggcacctcgctcatgcaaggtgtgtgtcctctaacaaagtttcacgctctaaacccagataacttttgaaacccaagttctgttgattcccctactttgggtgctccatagatgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttactttcatcatttcttacatattggggcctaccatacattgtacggtgaaattagtgctatgcatcatggtagaaatataaattggcaaaagtaatttagaaaatagttcccttctttcttaaaaaaattaggctgggtgtggtggctcatgcctataatcccagcactttgggaggcagagatgggtggatcacctgaggctaggagtttgagactagcctgaccaacacagcaaaatcctgtctctcctgaaaatacaaaaattatccaggcatggtggcgtgtgccagttgtcccagctactcgggaggttgaggcacgagaattgcttaaacctgggaggtggaggttccagtgagccgagattgtgccactgcactccagcctgggtctcagaaaaaaaaaaatttttttgaccaaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaacttgggtgagggaaacatatttaaattagatcgtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagcattaattcaaatggttgtcacaggtcacttaaagttagatagttgtcctacaaatatagggtgaatgttattcatgaatttcctgaatctattgcaataatcacatttttttccattaaactcttgaggtagctaattttatttattgcattttcaatgttaatctactatttcatatattgagattaactcacattagtcagaatttacagtattttaaaatatcacagaatttaatttaccttatctggttttggtttcaagactatactagccatttcatttaattgtacatgtagggtattctaatttatggaaaactattacatcttccttgatttttttttttttttagaaattacttctagggatctatatggtagagtccatggagaattgttttaattcttcattcatgtcttcagtgggtataggattggtcatattggtcatagttttctgctcggatttcaataagaaacttgtggaagaacctgaagggtgggatctttgagggagcctaagacagagcaagacaagctaagaaggagggcagtgccacagcagaactgccattgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgctttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccatcttgggtggtggcaagatgaggtagacgactgcttttgcaacacacacctgacaacaaaaaatcaacaactgtaaaagagccacaaaatccccaaatatttgcaaattagcaatgcacttttaaataactgttgggttaaagaagaagtctcaatagaaaattaaaagtacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgcagacttcagataataatgtgtcaatattttctcattattctagcaaatgtaccacagtaatgtaagatgttactaataggtgaaattaggaagtgagggtgaggagacagaataatatgggaacttcgtgtattatatactcaatttttatttatttatttatttatttatttatttatttattttgagatggagtttcactcttgtcacccaggctggagtgcaatggcatgatcttggctcactgcaacctctgcctcccgggttcaagcgattctcctgcctcagcctcctgagtagctgggattacaggcgcctgccaccacacccggctaatttttttggatttttagtagagatggggtttcaccatgttggccaggctggtctccaactcctgacctcagatgatccgcctgccttggcctcctaaagtgctgggattataagtgtgagccaccacacacggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttatattctctatcagagaagatgctggttaatgcatttacaatagatagggctgttgacatcttgctgacagaggaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggagaatacagcaggatgactgtgagtgcagggctggtgcagagtaggggcccggattcaaattccactaagccatgtggacctggcaagctcatgtcctccctctgccctcagttctctgcactgtcataatgtaattttagcaatactttttaggccctatttaggccctacttcttagtatcacagtacagggctaaaaaatcactaaatacaggaaaaccttagagaggactggtacttcagtaatgttctctaagtgtttactacaggccaggaggaataagctggacactcagcagtggcggaatatggagggggaacttggatggctccggggcagtggagcatgctttcctgttcggcttttccgtgggcatgatgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcacgccctgtgccagagacccaagagacccctcactgtttttctccagtcctcctagcccaaggtgtgtgggtggacaaaggtgatgctctggaggaaatgcctgagataaggacaggtccttaatgataaagaattctccttcctctttcagatccttgacctcccagtatgacagcttaaaggctgtcatctctgtggcctgcctcccctttcccttcaccctgccagctgcctctcagtgactgtctcctccagtgactacactgagggaccagggactgcttgcctcccgaggctgctcagaccttccgacactgcaaaatgattgtcaaaagatgggtctgcaaagagtaacttcccttccactgatcaaacctgaatatgcaagctactgtgaattaactggaaaagtggccgtgtgggctggtgctttggtgatttaatgaattaagtctgcaacccccactgcctccttgactattgatcagagctgcctgcaataaggtctggctaagaatgggcagtggctgcaccagctctgggtaaaatttgacctaaaatgaccagtctcattcactaacctcaccatagtcttatgggttcaatggacctgtccaatcctttgctctgttctctccatcaccttcctgtgtaattttcctccaccacgcacataagagaaacatggcacaggggagctaatcgcctcttttatcccccacttcaggctcacacgtaagtttatagtaaaagccttttcaaatgactgctttaactgctgctacagcatgtgtcatcagttgaatggaatctgtcacgtgactttaagcaaccctttgctgagagacaagattcaatactagggacagtattctagtgtactacatcattgattttatgttatgaagatcatcatttattgaaaatgtataaataatgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagtggttgtagttcaggccttcaacattagcaccgtatgaggaaacattttgactcttcactatgcagcaagtgaaccagggcacatttatttatgtggcttagtttctccatctggcatgtgggctcaataaacaagctcacaacatatgggcatgatgatgatgaggtgtgaactaatgtaagtaaagtatgtggtctgatttgttaaattaagaaacatggcactgagagttgtgctgggtaaacacaacatttttttcctaggggaaacacacatagacacacattcacaagcaaatcatgcagacttgcacacagaccacctcaccccacccccgccctaatacacacatacccacacacaacctaatgtgaacatgttcccagaaactatacatagataaaaagagtatgtcaccaggaaaaccagtttcttttactataccctacatcctcattcccaccagatgtcttggatcatggaggctctccagacaaaagccagcagttaagctccagatttcctgtagaatccttttctaacaaccagtgagtgattccagaatacgtaccattgaatgtgctccctgaagtcacctgtaattagagaaggaaaacactctgagaatcaggctatgctatggatggctcacacaggtcttttgttcacttggaaactctgggtaaccaagactggaaataaggttcaagtcaaaagccccaactctagagtagagttgccttaggaaagcacaggagcttttgttgaagaatgtttctgtctaggtaatttttgagtagcaattgcagaattcttatctaaagtggaaagcttgttcctgaagaaaacatcccttaacacccagtgtactatctgacactgccaattttgcacgtcctctggaatcaggtgtcagttggtaaaatacacctcctccatccccaaggaaatattatctaacacctataatgtagtggagaattttcccatagctgatatcaactgaaaaataaaggatccaagaaaacaacatttacatcttaggcaaagacaggctactttaccttggtagtagagtagggcttccttttcacacgctttttggaaggcttcttcgagtcacctaggggatgtggagggacacagcatggctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaacgtgaaataatcaactccaaatgaacaaatgctaaaacacatgctacgattcaaccacagcatcctgtcacttcttcagaccctttaaaagcccagcaggactgccactaccttcttgacatcgaccaagtccctttcaacctccacagacccacatacactgctactgcatttatcatggagggtatagggttctgccctgtttatgtgtgaattttttaaaaactagatttaataccatgcaccagcattaattgtatttatttcttttcttggttatgaaaataatcagtcaggcatagtggctcacacctgtaatcccagcagtttggaaggtggaggtgggtggatcatttgaggtcaggagttcgagaccagcctgaccaacatggtaaaaccccatcattgaagataaatgttttatatccatggttaacagatgagatgaccatgaaatgaacaccagtgtactgggtggagcagcttatctattcagtcttcggcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattcacaagtaaacaggttttcaaagccctctacatgcaaatttacacaattatccttttaatttttatcttcatatatatgtacataatctacttgcttctgagtataaatcaaactgtatgttcttagttaatagtctctataaattcactctatttatctttctgagttgaaatactgcatctcattggataacaaaaaaaaaaatttgactaagattacactggaaaggtgagtaggttgggtgattgactgtgattgacaattccatgattctggataacttccaaagcataaaaataaatgtgtgttttctttcacacgtagacaatacacatgcttattactttaaaaaattaatatgtgcatggaagtgacttactacaaatatattaaagtaaatacacatttcacaaaaaaagaagagaggaagggaaaaacatgttaaaaacaaagagagttacattttattgtgtgaaaagcctccaacggatccttactactgtggctttgttccaaagttttggaaagtaatgatttcataggttcttaattgggttaaaaacagcattaaaatagacttcgccatattctccccaggggaataacttaatctgtggggtgggggatggaacgttgaaggatgcaggttgaaggatgcaggatgtaaaaggaaattatatatatattatgacatatattatattatatatattatgacatatattatattatgacatatattatatatgacatatatataatatatgataattatattatgtatataatatatattatttatatatattatatatattatatatatgatatataattatttattatatattatatattatataatatataatatataattatatatcatatatattatatatataatatatattatttattatatattatataatatataatatatataatatataattatatattatatattatatattatatattatatataatatataaataatatatattatatacataatatataatatataatatatataatatatataatatataatattatacatattatatataatatatattatatatactatatatattatatataatatatattatatatcctatatatattatatatagtatatatattttatatataatataaaatatatataatatattacatataatgtatatattatatataatatatatgttatatatattatatattatataaaatatatataatatattatatattatatatattatatatatatatataaaatttgggaatttgggaataaacggactcccaattcacactgggactacaccagctgccaccatgcctggctaattgattgtatttgtagtagagacagggtttcactgtattcgccaggatggtcttgatctcctcaccttgtgatcctcttgccttggcctcccaaagtgctgggattacaggcctgagtcaagatacatattttttaaatgaagaaaaatttcaaagatactctgcttggtacagtaatcaaatatataaattgaggaataaaacataatcatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaatggttcaatctgctctgacctttgaaaaactcagcacagatagtggcacgtaggaccaagggcaggagatccctaatcccatcaccatggtgatagggcataaacattccagggtgaaggcacaatccacactgtgaggtccaactgctgccatgcagacaggtgggcttttacaactacaggaaggtcatcaaaggctcagtgttttgtttcaaaaactgaatcccaagcccacacattattatgctggcttcttaaaataagttatgagatgggaaatagggcacccaaaaatatatatatatataattatatataatataatatatagtatatatataatatatttaatatattttttatatatatatatataaaatttgggaatttgggaataaactgaatcccaattcacactgggactacaccagctgccaccatgcctggctaattttttctatttgtagtagagacagggtttcactgtattggccaggatggtcttgatctcctcaccttgtgatcctcttgccttgggctcccaaagtgctgggattacaggcctgagtcaagacacatattttttaaatgaagaaaaatttcaaagatactctgcttggtacaataatcaaatatataaattgaggaataaaacataatcatgaaacatatttataactgcatatggaaaatacagaggctaattttttaaataatatattttgaaagtattaactagtaatttgaaaagatcgcatttgacaggccagtaagaacataccttgaatgcagccacacaggttccccataagaaaaatcaaaatcagggaaaatgaaaccacaatggttcaatctgctctgacgtttgaaaaactcagcacagatagtggcacttaggaccaagggcaggagatccctaatcccatcaccatggcgatagggcataaacattccagggtgaaggcacaatccacactgtgaggtccaactgctgccatgcagacaggtgagggcttttacaactacaggaaggtcatcaaaggctcagtgttttgtttcaaaaactgaatcccaagcccacacattattatgctggcttcttaaaataagttatgagatgggaaatagggcacccaaaaaaatatatatatataattatatatgacataatatatataatatatataacatatatataatttccttttacatcctgcatccttatattatatataatattatgtataatataataggtattattatatataatataatatatatgaatatatatagcaatataatataatatatgtaattatatataatgatatataatatataattatctatattatatataatataatatatataatataatataatatataatatattatattatatagtaatatatattataatatattctatattgtattatataataatataatataatatatattatatataatatatattatatataatataatataatatataatataatatataatataatataatatataatataatataatatataatataatatataacataatatataatataatatataaaataataattaatatttaaattaattattattaattaatattaactaatattaaaaataatataaaatacaattaatatatctaatataacctataattattatatataatataatatacaattatacataatatatataataaaatatatataattatgtgtatttattacatataatataatacataaattatatataattattacatataatataatatatacttatatataattattacatataatataatatataattatatataattattacctataatataatatatataattatataattatatataattatatatacaagataataatacataatatatataatatattatacaatataatatattgtataatatattatataagatattatatataatatgttgtataaaatatatatattatatataatataatattatgtataatataatatataatatatattatattataacatattatacaataatatattataatataatgtatattataatctaatatattatatattataatctaatattatatattataatctaatataatattatatattataatctaatataatattatattatatataacattatatagtattatatattttataataatataatatataatatattatgatatattatatataatattatataatatattatgacatattatatataatatataaaatgatatattatatatattacataatatattatgatatatattatatattatataatatattatgatatatataatataatataatataattatatgtaatataacattatatatcatatattatatattatatatcatatattatatatcatatattatatattatataccatatattatatattatatatcatatattacatataatatatgtcacatattgtatgtaatatatgtcacatattatatgtaatatatatcatatattatatgtaatatatatcatatattatatgtaatatatatcatatattatatgtaatatatatcatatattatatgtaatatatatcatatattatatgtaatatatatcatatattatatatgtcttttattatgtaatatgtatcatagatattacataacgtgacatataatatatattatttatatataatgtatattatattttatatatattatatatattatatattatatgttttatgtaatatatagtacatataatatacattatatatatataattttttttagacagattcttgttctgttgcacaggctggaatgcaatggtgccatcttggctcactgcaacctctgcctcacgggtggaagcgattgtcctgcttcagcctcccaggtagctggggctacaccacactgggactacaccagctgccaccatgcctggctaattttttgtatttttagtagagatagggtttcgccacattggccaggatggtcttcatctcctcaccttgtgatcctcttgccttggcctcccaaagtgctgggattacaggcttgagccaagatacatattttttaaatgaagaaaaatttcaaaggtactctgcttggtacaataatcaaatatataaattgaggaataaaacctaaccatgaaacatatttataactgcatatggaaaatacagaggctaattttttaaataacatattttgaaagcattaactagtaatttgaaaagatcgcatttgacaggccagtatgaacataccttgaatgcagccacacaggttccccataagaaaaatcaaaatcagggaaaatgaaaccacaaaggttcaatctgctctgacctttgaaaaactcagcacagatagtggcacttaggaccaagggcagcagatccctaatcccatcaccatggcgatagggcataaacattccagggtgaaggcacaatccacactgtgaggtccaactgctgccatgcagacaggtgtgctttcacatgtacaggaaggtcatcgaaggctcagtgtttcatttcaaaaactgaatcccaagtccacacattattatgctgtgcttcttaaaataagttatgagataggaaatagggcacccccaaatatatatatatattatgtataatataatatatataatatataacatatatataatttccttttacatcctgcatccttatatataatatcatatttaatataatatataatattatgtataatatatattgttatacataacattatatataatataatatatataattatgtataattatataattatatatgaaatataataatgtataattatatatgtaatataataaagtataatagataatatatattatatattatacaaaatattatataatgtaacatgtaatatatagtatatcataatataatatattttataatataatatattatatattatatatgattacattatatgatattatattatatattatataaataattatatataatataatatataatatataatataatataattatatataatataatatatataatataatataatataatataattatatatcatataatataaaatatataatatataatataatataatataattatatataatatatcagatataatatataatatatatcagataaaatatataatatataatatatatcagatataatatataatatatatcatatattttacataatatatatcatttattatgtaatatatatcttttattatatataatatatatcatttattatataatatatgatatatcatatatgatatatatcatctatatcatatattatttatcatctatatcaggtatgatatatcatctatgtcatatatacgatatatcatctatatcatatatgcgatatatcgtatatatcatatatgatataccatgtatatcatatatatgatatatcatgtatatcatatgtagtatataatctatatcatatatattgtatataatctatatcatatatattgtatataatctatatcatatatattgtatataatctatatcatatatattgtatataatctatcatatatgttgtatataatctgtatcatatatattgtatataatctgtatcatatatattgtatttaatctgtatcatatatattgtatataatctctatcatatatattgtatataatctatatcatatagtatataatatatatcatatattgtatataatatatatcatacatattgtatataatatatatcatacttattgtatgtaatatatatcatacatattgtgtataatatatatcatacatattatgtatgatatatatcgtatatattatatatgatatatatcatatgtaatatatacgatatatatcatatatattatatatgatatatatcatattaagttaagtttggggatagcccagaattatatatggattttcaactgcacaggagctggtcccctaacccttgcactgttcaaggatcaacagtatgtataatactacagattttattcatattttagagtgtagtactactactcattaaaaaaaattaactatgaaacagcttcaggaaggtcttccacgagttcttccagaagaaagccttgttatcatagagaatgacagctgcatgtatgttattgccactgaagaccctgaagacctttcacttggacaagatttcgagatggaagacagtgatattgattatcctgacccttacaggactaagctagtgtgtgtgtttgtatcttagtttttaacaaaaatgtttaaaacataaaaaatcaaaataaatgaagcttatcaaataaggatataaagtatttctgtacagctgttcaatgtgtttttgttttaagatgtgttattatcaaagaatcaaaaaattaaaaaaattaaaagtttataaagttatgataagctaagatgaacttgttaaagaaagaaaaaatttaaatacatttagtgtagcctaagtgtacagtgcatataaagtctatagttatgtacagtaatatcctaggccttcgcattcactcaccaggtactcactgactcatcagagcatctgccagtcctgcaacctctgttcatgctaaatgtcctttactggtgtaccactctctttaaattttgtaatatatatatatttttttctttgttttttttgagaaggagttttattttgttgcccaggctggagttcaatgatacgatcttggctcactgcaacctctgcctccggggttcaagtgattctcctgcctcagcctcacgagtagcagggattacagccccacgccagcacgcccagctaattttgtatttttagtacagacggagtttctccatgttggtcaggctggtctcgaacttctaacctcaggtgatccgcccccctcggtctcccaatgtactgtgtttttactgtatcttttccatgtttagatattactactgtgatataactgcctacagcagtgggccccaaagttttgacaccagggactggttttgtgaaagataatttttccacggagtggggatggctttgggctgaaactcttccacctcagatcatcaggcattagttagattctttttttctttttttttcttttttagactgagtctcccactgttgccaggctggagtgcagtggcacaatctcggctcactgcaacctctgcctcccgggttcaagtgattctcctgtctcagtcccccgagtagctgggactacaggcatgcgccaccacacccagctaatttttgtatttttagtagagacggggtttccatgttggccaggattgtcttgaccttgtgatccacctgcctcgacctcccagagtgttgggattacaggcgtgagccacagcacccagcctagttagattctcataaggagaacataacctagatcccttctatgggcagttcacaatagggtttgtgctcctgtgaaggtctaatgctgctgctgatctgacaggaggcggagctcaggcagtaatgttcggctggccagccactcatctcctgctttgtgcccaattcctaacaggacacgaaccggtgctggtccatggcttgggtgttggggaccattggcctactgtattcagcacagtgacatgctgcacaggtgtgtagcccaggagcaataggctgtacgatatagcctaggtatgtagtaggctacgctgtctaggtttgtataaagtacactctttggtgtctgcacagccacagaatcacctaatgatgcatttcttggaatatattaccattaaatgagatttacctgtattagtgtcatctcaggtttattgtctagtaattttaaaagtatttgtatattctttcccagacacatcatcatactctggtgcatatctctattttattccctagacccactcttaatttttctgcattctgctttgttccttaggaggctcacctgaattggatacttcagagatctcccttaccctcatgcttttattggggttcagctaatggagggggtggcagaagataggtgagagaagagtgtgtttatcccccacctctgcccctgcagggtcagcacaggcagactgtgtccctttgctgaagatcacagcttctgtctggtgccttcttggcaagctggcactgtctctagtcaggtgactgcttggccccttactacttacactcttctgtctggtttctttgtgactttcctgctgtgctgtaagtagtccctttattagaatccatccacattacccagttatataaagacaaatagttggtcactgatgtagttcactccctgagaatcagccttcatcaaagatccctaacagtcacatattctgttggccgctccattcctgctccccattattctagttgtgtcttccttgtctctagtgcagtcacaaagcataagcgcctccactgtcacttgttctttgcaactctaggatcacatcattccccttgaaatcagagaatctgcaatctccccaagcccacaaaattcagccatcacagtacttttcaagcatgccagcagccctccccaacaaacgaatccttaatttcttagagaaacatcttctgggcttcctgtgggacacagtgcgggtcggcttggcatgtggatcacacctgatatttttacccccacctcctactattcctattcctttgtatgcacctctctttattatgctaggaaagctctggcaacacaacctcaaaataagcaggccagtgtggattcacagtttctgtcagacaaacaaacttgagcaccccttctaacttcttgggctaagactttaacttcagaatctctatgtatctatgttgataaacttagcctatgtcaagattatattctgcatgccttagtcaaacaccatgtaaatctatacctcatatattctctaggctttagctgatagggattagcaaagtagtgtggttgttttggtctttaaacaatgtccattttctaccagctttccattgcactctttttttttttttttttttttttgagatggagtcttgctctgtcgcccaggctggagtgcagtggcgcgatctcggctcactgcaagctctgcctcccgggttcacgccattctcctgcctcagcctcccgagtagctgggactacaggcgtgtgccgccacacatggctaattttttgtatttttagtagagatggggtctcactgtgttagccaagatggtctcgatctcctgacctcgtgatcggcccaccttggcctcccaaagtattgggattacaggcgtgagccaccacaccgggccgaatccattgcactcttacagaccatgttgacaaaattataactgcaacagtcaactacaatagcaattttacctctcatgtaccactttaaaaaacacatcattcccaataaccacatttgatgatttaagtaatcatgataccaccgtacactacagatgatcaggtttctgtctcctcccgacaacaaggtcaggaattcattcagactgaaacaggtcagcaaaccacttccagattctcatctataaagatctatttctagaaccatttctagtacctatacaatattagaatcaagtcaggaagcagaaaacattctagatattttaaacagaaaacaattcatggagagatcaattacaagagtatgtgtagcaaaagatgaaagggtcaggtaacttgataaatctctgcttcttttgtgttgggtgataaaaatgttgaccagagatcagtggcagatgatccaaggcgtcagctgtccaagctcagcatctggagccggtgctgaggaaatgtgcatttctaggtctgggcgccattggaccatcactactgtccttgaagctgccaccgtgagaactcacatctcagctgctatagccacagctgatattgtcattgcttccagaattatttcccttgctccatcgtggggatcccgcaatactgctgctgctgaaatcactgttgttgctccttccagaactgtcggcaccgcagcattattatcactgcagctaccactggagatggctacagacaccagaaacggaagagcacctctcccctcctccggcagtgtgactttcagtcggctcctctcgtagccagatggtatagaaatgacacaccaatgtccttcagaacatacatgcaaaatagtttaaatatactagaaattctattccccttagaaaactaagtccacctacatatttttcaaaaatccatcagcaatacagaataaaggcattggttctatacagcgttgcaagaatattttaacaatagaaggtattttaatgtcattcaccacattaggagattgaaaaagggaaaacacaggattaccttagcagatgtaggaaaaaaaataagatggtaaaatacaacattcatttatattaaaatctttataccaaactaggaaaagcagacaaatttcttaacctgataagcttatctataacaaaaccatcgacaccaccatatgtaatgttgaagcataatcgttattttttataaaagctaggaaagggaatgagatgtctgttgacactgctcgtatttatcattgtcctggggtttctggccagttcagttaagataggacaaagaaatattatagaaagaggaagaaaaaaagaaaacacatacgttgtcattgtgtggagtttctgtttgtttgtttatgtgtttttgtgagatggtgtctcactctgtcgcccaggctggagtacagtggtgtgatcttggctcactgcaacctcattgtgtggagatttgtaattacccatagaaaatccaagaaaatttgtggatgcactaatcaaatcagcaaggttttcagatatgaaggcaaagtaaagagaaaatgaaattcttataaacagtagcaaccaattaaaaatattatattataatatcacattcatggtaacataaaacattaacgtatctaagaattaattcagaaaacacatgatctttcatttaattttattaaagttatttcaataaatataccaccagtatttttttagaacttgattggaaaagtcatattaaaataatcaatggaaaggaagaaccaaagttattctgaacaataatagcctatcaatatttaaatgtgttttaattataataattaaaatggtttgctttggctcagtgatacaccgttaaacaatgggaaaaaatggaagcaccaagaaatagatccatagatatgctgaatacattggacttgtaataaaagatatgatactaaaagtcagtagaaaaattatactattcaataaatgatgtcagaaaaaacatataaatttttatccatatataaataaaaatctgtatattacagcatatcacaaaatcctgtatctatttaggttaaagactcaaatcttaaactacttgtgaaattacttatgaatattacatgtttaagatatttaaaagtatatacagagaactaatgacgttgggcaacaaatggcttattaatcaaatgccagaatgcatgaagaagaaaagaaaagaaaaataaattagactgtattaaaatgaaaaatcctaggcatcctaaataaaggttaaatgcaagccagaaaattgggtaaaatatttacaaaatatataattgaaaagtataatatccattatataaagaggatttctacaaattcatgatataaaataaataatatagtagaaaaaatgattaagaactactacacaatattcacaacagatgataaatagtgaattattgtgaaaagacaattgaaaagagcaaggtacaattcaacagcaataagactttatgcccttttctataaaaacacaaaactatgccaagggctttaggaaccgtgaatttatacacggcgaaggggagtttaaatctgccactttgaagagttttttggaaatatatagtaaagttgaaaatatatacatatgtgtatatatatatacccacacacatacacatacacactagaaattccacagggtaaaccttctccaagagaatacacacacatttgcagaagagatgtccaaaggtgtttgttgaaacattattggtaatagctaaaaattggaaataatcttaaagctcattactaggaaaatggaaaagtgaatcgtggtatgtgcatataatgtaaaactatacatcagttaaaattaattgtctgaatttatatggatcaatttttatatattgaaacatcgttgcattccaggaataaatcccacttggtcatggtgtataatccttttaatatgatgctgaattcagtatgatagtttttttttagacaaagttttgctcttgttgcctaggctgaagtacaatggcatgatctcggctcaccacaacctccacctcccgggttgaagcgattctcttgtctcagcctcccgagtagctgaggttacaggcatgcaccaccacacatggctaattttgtatttttagtagagacaagagtttctctatgttggtcaggctggtcttgaactcctgacctcaggtgatccacccacctcagcctcccaaagtgctgggattacaggcatgagccaccgtgccccacccagtatactagcatttttagagtttttgcatcaatgatcagaggcatattgatctgttgttttattttcttacagtgtttttggctttggtatcagggtaatgctggcctcatagaaagagttaagaggtattcactcctcttccactctttggaaatgcttgaaaagaatcagtgttagttcttctttaaacgtttggcagaactcaccagtaaagctatcaggtccaggacttttctttgtcatgagattgtcttattactgactcaattcccttactaggttaggtctattctgactttctgtttctttataattgagtcttggtaggttttgtgtgtctaggaattcatctatttcatctgggttatccaatttatgagcacacaattatttatagtaatcttttataatcctttctaggctgggaatggtgggtcatgcctgtaatccaacaatttgggaggccgaggtgggaaaattccttgaggccaggagttcaagatcagcctggataacatggcaagatcctgtctcttaaaaaaaaaaaaaaaaaaaagagctggcatagtggcgagcccaggaattcaaggctgcagtgagccgattgtgccactgattctggttgcatctgattgttgccagggcaatagagctagaccttgtctctaaaacatagacaggcagacagacagacagacagacagaaatatataaagatattctcaaatacatttctgttttaagtaatttagattgtttcccttttccttagtcttgtcagttttattaatctttttgaagaaccaacttttggttttgttttttattgtttttctattctcttttccatttatctctgccctgatctctattgtttccttccttctgctaactttgggtttagttttattcttctttttctagtttcttaatgtgtaaacttatgttgttgaattgaggtgtttctttttttaatgtgtttatagctataaatttcctccttagcactcctttcaccacaactcataagttgtgtttttttgttgtttctttgttttttgagacagagtctcattctgtcacccaggctggagtgcagtggtgttagctcagtggtgcaacctctgcctcctgggttcaagaaattttcatgcctcagcctcctgggtagctgggactacaggcacgtaccaccactcccagctaatttttgtgtttttagtagagacagggtttcaccatgttggcctggctgatcttgaactcctgacctctagctatccacctccctcagtctcccaaagtgctgggattacaggtgtgagccaccacaactggccacagcccataagtttggatatagtgtgctttcattttcatttgtctttaagaattttataatttctttgtgatttctttgatccattggttgtttgagagtgtgttgtttaaattctactaatttgtgaacttttttaaatcttctgttattgatttctaactttatcctgttgtggtcagagaagacactttgtatgatgtctatcgttttaaatctactgagcttttttccttttttgggacagggtctcgttctgtcagtggtacaatggtacattttctttgtcatgaagtacaggctggagtacagtggtacaatctctgctcactgcagcttcaacctcctgggctcctaagcaattctcacgcttcagcctcccaagaagctgggatcacaggcacgcaccaccacgcccagctaatttttgtatttttagtagagatggggtttcaccatgttggccaggctgatgtcaagctcctggcttcaagcaatccacccgcctcagcctcccaaattactctgggattacagatgtgagccactgcacccagcccctattgagaattaatttgtgatgtgttatatggtctatcctgaaaatgtcccatgtatacttgagaagtatgtgtattatgttgttgggtagaatatcctgtgtatgtctgttaggtctagttgttttttcaggtgttgttcaagtgctgtatttccttacttatgtctggtctggttgttttattcatttgtgaaatgaagacaagggacaaaatcctaagacatcccccttaaaagggaaggaccacccacagaaaaggactgagagacccccagaatctatagcttagctaattgatggtctttctctcctgaagttagtaaagagtggaaaagatgactccttcttcaaacatgaagaaagcaatctaagtcttcaaagaacaggaagcatgagaaaatatgacaccaccaaagaaacaaaatgaaactccagtggctgactccaaagacatgaagatctacaaattgcctgacaaagaattcaaataatcatcttagggtgacatcagcaagatggcagaacaggaggccctccactcacctctccccacacaaacaatgatctggcagccattcatggacaaaactgcctttgcaagagttttaatatccaggcaggaggtggcaaaactctagcaaagcccaaaaccaaggagagctgctttgagaaggcaggtccacacaccagtgacaggttaccagttgcagactgaaagcagctttgtcctcctatggacttgggtccagctccactagatcatggtcttgcaactagccccatccactaagcacctaggaggaaccatgaccatttatgcccccagtaacaggccttctaaccatggtcctgactgcagaaactaaagcagccctgacctggcttcagccccactctaccacagtcagtcatgcctgcccaggaattcagtgatgcctttacatacccttggtaacaggcctgctgatctcagtctcagctatggacactaaagtagccctgtgactccattccagtcttgctttgccacagtctgggcacagtccagcccatcctgggacctggtgaaagacataccatccattctcctaataagaggaccaccaatcttgaactcaaatgtggtcaccaaagctgtcctgtgacttggctctagccctgctctactgtggtctggaggcagtcctgtcttcccatggacctacctagtaaaccagcaggagctcaatctgggacccacagggagctataccagtccatgcccttggtaataggcctgatatctgaagacttgactgtagaactagaagtggccccatgacctggctccagtcctgttcaatcagggtatcagaggcagtccagttctcctgaggatccagcagaaactgcatcaccaacctatgccttgatagcggcctgccaatcagagattcagctgcagaccaggcagcagccatgtaatatggctccaggcccacttgactgtgatccagtcaagggatccagcaggaaaaggtttgtacctgctgaaaccaatctataaagacagaaagagattgggcatggtggctcacacctgtaatcccagcactttgggaggccaaggcgggcagaccacttgaggccaggagtttgagaccagcctggacaacacggtgaaactctgtctctacaaaaaatacaaaaaaattagccaggcgtggtggcacatgcctgtgatcccagctgcttgggaggctgaggcaggagaatcatttgaacctgggaggtggaggttacagtgagctgagatcacaccactgcactccagctgggtgacagagcaagactctgtctcaaaaaaaaaaaaaaaaaaaaaaaagaagaggtatttgcttcttcatagacattaatgaaagtctgtagatcatgaagaatcagcaaatatgacactaccaaaataaactcataaatctccagtaatcaaccccccaaaaatagagatctacaaattgcctgacaattcaaaataattaagatagctcagtgaaatttactagaatgtatatatcaactcaataatatcaagaaaatagtagatgagcaaagctaaaagttcaataaagatacagaaataataagaaccaaacagaaattctagaactgaagaatacaatgaataaaatgaaaatgcaagctgggtgccgtggcggacgcctgtaatcccagcactttgggaggccgaggcaggcggatcacttgaggtcaagagttcaagaccagcctggccaacatgccaaaaccccatctgtattaaaaatacaaaaattagccaggcatggtggcatatgcctgtaatcctagctactagggaggctgaggcaggagaatcgcttgaaccgggaggtggaagttggagtaagccaagatggcaccactgcattcaagcctgggtgacacagactctgtctcaaaaatatataaaaataaataaatgaatgaaatgaaaatgcaatagagaatttcaattgcagacttgatcaaacagaagaaagaatctgtgaaattaaagacaggacatttgaaatatcccgtcagaagaccagaaagaaaaaaaagtttataagtaaaaacctttgggatttataggacaccaccatgaagtgggtcaaacatattatggacttcctagaagtaaaaaagatagaaaaggcctgaaagtatatttgaagacataatgggtaaaaactttccaaattcttagaggcaagtgggcttccagacacatgaagttcagaggccccaaaaaaggccagcccaaagaccataataccaagatgtattataattaaaatatcaaaagtcaaagacagagactttcaaaagcagcaagaagaaaggaattcatcacatacaaggaaacttcaataaggctatcagtgaatttctcagcagaaaccttataagccaggagagaataggatgctatattcaatgtattggaagaaaaaaactgccaatcaggaagaccacaacttgtaaagctgtccttcagaaatgaaaaagagatgataaggtctttcccagactcccaccaaaaaaattctaagggagttcatcaccactgcacctgccttataaggcagtttttcaagttgaaataaaaggattctgattagcaacattaaaacattaagatattaagttcacaggtaggccgggcgcagtggctcacgcctgtaatcccagcactttgggaggccaaggcgggtggatcacaaggtcagaagagggggatcatgctggctaacacggtgaaaccccgtctctactaaaaatacaaaaaattagccaggcgtggtggcgggtgcctgtagtcccagctactcgggaggccgaggcaggagaatgacttgaacccgggaggcagagcttgcagtgagccgagatcatggacactgccctccagcctgggcgacagagcgagactctgtctcaaacaaaaaagttcacagggaaaggtaagtatatagtcacattcataacactgtaatattgcagtggtggtgtgtaaatcacttttcactgtagtataaaagttaaaatgtaaaagtattaggcggcccgggcgcggggcagctgctgcggggaggcggggaggcggggggcctggccggacacccctgcgccccctccccgcacccgggcggagggcggcctcttccccctccccctcccccaccacccccggcagccgcctcccccaggacgcaggaggcgggcggaggccgggtccgcccagcgggcgacttgcggcatgggccgggtcgaggtgggggggcggtttcgggggctgggaagctggggtgccggggacaggagggtgggggagctggggaaaggagggctggggggccggggacaggagggccatgcaggcagtggcaagcgggcggcgagggctccgtggggcaggtggacggggatcagcgcctggggctgctccgttccccaggcgggtgtcgtggctctggcctccatgcaactccaggtctgcgcgccccgcgctgctggagccccagtcaaaagtctatttaaaaagcagagagaggatgcttccctctgagtggagcgatgaagacctgatccctgggccatttgggaacactagctgcctttcatcacagtcaacctggactcagagaatgtcaagagcttgttggttgggtcaagaatgaatctaggcatgacgtcatagtttatagtcatccttttaaacctgcaaagaagcatttgcaggtttaaagttatttcacgggtactgcttgccaatctttggaggatgtgaagcctgcagagaaataaagtgtcgcccctctgcgcgtcgctccccatctgccagaatgtttctcatgaatgctcctccagtggttgctctccagcccaaatgggaggcctctgtcccgccagggagctttaggttccccgggtgcttctcggaggctgacaagggcgtggagagcatgtcggtgagcacccgggtgcagatgctcatcagcacgctgcagagcgacagggctgctaggggcaccagcgatgagcgcactgcgcagagggggcagagggatgccacgacgccaggcctgctgccaagcccaccatgcacaaggagctgcctgcgttggctgcctgtggtcttgttgctgactttgaccccgtgggggaggaggaaactgcagactttggcccattggtgctagattcagacagtgacgattccgtggaccgggacattgaggaggccatccaggagtacctgaaggtaaagagtggagcggcacagcccggggccagcggggcccagccatgcacagccttccagggctgcgggcggaggcagtagatgtaagcgggaactggctcacagcagtgcccaactgccctgtgttccccaaaacttgtacctggctcaggtggtgtggccctggcagccaggtgggatccagcaaggaccagggctctgcctccccagtcagcatgagcagagcagactcctttgagcagagcatcagggcagaaatagaacagtttctgaatgagaaaagacagcatgagacccaaaaatgtgatgggtcagtggagaagaaaccagacacacatgaaaattcggcgaagtcactctcgaaatcccaccaagagccggctacaaaggtggtgcaccggcagggcctgatgggcgtccagaaggagttcgccttctgcagacctcccccggttagcaaagacaaacgtgcagcccagaagcctcaggtccaaggtcacgaccacgaccacgcaggagaaggagggcagcacaaagccagcaacccccaccgcccttcagaagcagtacagaataaaagtgggattaaaaggagcgccagcaccgcaaggaggggaaagcgagtcacgagcgccgtacaggctcccgaggcgtccgactccagcagcgacgacggcattgaggaggccatccagctgtaccaggtgcagaaaacacacaaggaggccgacggggacccgccccagagggtccagctccaagaggaaagagcacctgcccctcccgcacacagcacaagcagcgccacaaaaagtgccttgccagagacccacaggaaaacacccagcaagaagaagccagtgcccaccaagaccacggaccctggtccaggggatctggacgctgaccattcccccaagatcccaaaggaaaccaaagctccacctccaacgagcccggcttccaggagcaagtttgtggaatggtcctcttgccaggcagacacctccgctgagctgatgtgtgtagaagcagtcctggacattttcaagacgatcctgccggccctatggagggcagcgatgggtccctgtccgcaagcccactcttctactcccccaacgtgccttcccgctctgatggtgacagtagctccgtggacagcgacgacagcattgagcaggaaatctggacgtttttggccctcaaggtgcagtctagaagtttgctggccagaggtgagagctgccctcaggctgcccagggcccactttcaccacctggcctcagcagccagaccggcagccccaaggcccctctctctaaaacactggacccactcctggctgcaaaaggaagcatagaggcggctgccaagtgaggccatccactcccaagaacatgcgggtggtggggaaagagggtggccaggatgccgaccgcagccaggggagagccgggcccggccatgaggggcgggacctttccatccagggcacagccagcgaggccccgggatgggagggcgccgctagggtgggacctttccatccagggcacagccagcgaggccccgggaggagagggcgccgctagggtgcccggtgacactcgcacgtcacagggccagggtaagacagacgaggcaaggcacctagacaagaagaagagctccgaagacaaaagcagttccctggacagtgacaaggacctggacacagccatcaaggacttgttaaggtccaagtgaaagctcaagaagaggtccagggagcccagggctgtgtgcaggaagaaggtcaggttcagcacctcccagacgcacttccaggagcggctgggcaggctcctgagagagtggaaaaacaggcacctgcaggtgctgaagagctgcctaagtccaagagagacagctgcgagggctccaggaagaaaccccccagtgtctttggcagcagggccgagaggacgaagccccggccttcctggtgaggagacccgcttctgcctccgcctccgaagagaatctattccccagagagtcccagggcccagctcccagccctggctccttgtctgacaacagcagttcagtggacagcgacgatagcatcgaactggagattaggaagtttttggtggaaaaggccaaggagtcggtgagcagttcagaagttcaggcagagggccccaccgctctcgggacagggggcccagccaggccagaggtaccttgcaggaaggagccggccccactgcctggcatgtgcacatttggctgaagggcatcgaggcgtagggagcgcaggagcacagggcgcagcgtgcctgctcagccagggtgggaaggggctccccactgatccggcggaggggatcatgcgccacccaggaggaccagcggcagtgtctccgccaaggtctctcagtgagcaagagaaatgtttacgtttacaaagaccagagcccacgaggggctgagcctgctgccaaaagtgcttttggtcagcggcccagctgtgccacagcgggcaccgaggcaggaggagccagggggacctttcacgtggactgcaggaaccggagcttcctgacccccagcccgggagctgagagggatgctggagcccaggccaaccgcgccccgccctggagtgactttgcccaccacagtcggctgcccagcccatgggcactgcgctccaaaggtagagatgcggcgtggagggggcggcattgggagagagagacaaggggtccgagggccccgcccggggcctgcccagcctgccccttgcgggcttctccccgctgctgtccacccagctcttccactttggaaagggtgtctcctgggggggcagggagaccggcctcttcagcccctacctggggctgcctctgcagggcctgtccttctcggccttcagggagtcccaggccaggcccagccctgtctttggaagcccacacttgctggcgaagaaggactgcggtcaccggccaagcaggaaggtacagacggggctgagtttgcacaacaggaagagctctggctcggaggaaaggattttagacctgaggtatccacgaagggtcaatcagtagagttgaccaggaccaggacaccttgggcagggacaccagtgacttcagcaacacctccgcagaggtgttgctgctgcagtggcggcagctcagtagtgaaggtataagacctcgagctgtgggttcgcgtcctgggttccatgcattcgtggaaagcggcatagccgacgtgtatctgtgcctgtgtgtgatggttctgtggttgcagggaggggaaacagtctgttatacatagtcttgtatatatgtataccaacacgaaacaatgcttttatttaacagatgtgtcctggtaaatatgatttttgtagattttgtacattatttaaagtgatgaaaaatgtttttggaaaatactgttggtcaattttgtagggtgttccttaactgcagttttctgtgttctgcatacaagtcttagattagaaaacatttggtttttatcatcacaaccaggtttacagggactctgatgttttttggttggttgctggtgagaatggccagcgctggctgcaggggtagccttaggaaggccgaggtgccctccccaggaatcgctcacatgccccaaagtgtccgtcaggaagttcctgggacagcactttttatacagaggacacccccccaccaccgcctggcttcatggtccttggaggccagagcacatctgaaaactacaggaacggaaaaccaaactccgcatgttctcactcataagtgggagttgaacaatgagaacacttggacacagggcagggaatatcacacactgaggcctgttgggggatgggggcaaggggagagatagtattaggagaagtacctaatgtaaatgatgggttgatgggtgcagcaaaccaccatggcacatgtatacctaagtaataaacctgcactttctgcacggctaccccagaacttaaagtataattaaaaaaaaaaaaaacagaaaaaataagtagagattaaaccagtaatgaaaaatctcccaacaaagaaaatcccaggaccaaatggttttactggtcaatttcaacaaacatttaaagaattaataacaatccttctcaaactcttccaaaaagattgaagaaaagggaacacgttgaaactcattctaagaggccagcattatcctgatatcaatgccagataagaacactacaaaataagaaaactataggtcaatatccctggttaacatagatgcaaaaatcctcaatgaaatactagtaaaccaaattcaacagtgcattaaaagaattattcaccatgaatccagtctctaccaaaaatccaaaaaaaaaaaaaattagctgagcatgctggcgggtgcctgtggtcccagctactagggaggctgaggcaggagaatggcgtgaacttgggaggcggagcttgtagtgagccgagatcgcgccactgcactcaggcctggatgacagagcgagactccatctcaaaaaaataaataaataataaataaataaaaaacaaaaaaagaattattcaccaggatcaagtgggatttatctctggcatgcaaggatgctttaacatacaagagtcactaaatgtgatacaccacatcaacacaataaacgataaaaatcctttatttttattattaaaaagcacttgataaaattcaacatcctttcatgattaaaaaaaacaacaaactgagcaaattaggtgcagaaggaatgtacctcaacataatgaagaccacatgtaacatactcaacagtgaaagactgaacgttttttcctcgaagatgaagaacaagacaagaattcctactctcaccatttctcctcaaaataggactggaagtcctagccagaacaattaagcaagtaaagaaataaggatggaagtaaaatggtctccatagatgacatatttttatgtatagaaaactgtaaagacttcactaaaagactgttagaagtaataaattcaataaagtagcaagatacagagtcaacatccaaaaatcagttgcatttctatgcatagatggactggagggcattatgttaagtaaaataagccagacacagaaagtgaaatattgtacaatctcacttatgtgtggaacctaaagacgtcaaactcagaagaagagaacagaatggtggttgctgggagctggggaagagaaggaaatgggaagttgatggttaaagtgtacaaatttcagttatgcaagataagtaagttctggagagctatacagcatagtacccacagaaaatgttactatattcttaaattgtttaattaaaaacttttattattattatttttttttagacagattttcactcttgttgctaaggctggagtgcaatggtgctgtctcggctcactgcaacctccgcctcccaggttcaagagattctcccacctcagcctcccagtactttgctcagattataggtacccgccaccacgcccagctaatttttgtatttatagtagagatggggttttgccatcttagccaggctgctctccaactcctgatctcaggtgatccgcctgcctcagcctcccaaagtgctgggattacaggcgtgagccaccgcacctggccattaaaaacatttttttatacaataataataataaagaggcagaaggaaattttaaaaggtgatggatatgtttataggcttgatgataatggttttatggtgtaaatttatcaagatgtgtacgttaaatatgtacagtttttatgtaaatcattcctcaacaaaatggtttaaaaagtaataaagtaattactgataaggggggacttacttctggcattttgctatacattttctatatgccttacagcatttttgtccatttcctgcatgatctcatttgtatttagttgattttttgtagcgaagtgttttaattcccttctcatttacttttttatgttatataatgttttatttgtggttaccatagggattacacttaacattctaaagttatagcactctaacttgaattcataccagctatatttcaataatatgcaaaaactctcctcacagttttgccactcctctttcagttatcaatgtcacaaaattacatttttgtacattgtgtgtccataaacataaactaataattgtttttaatgcatttgtctattaaattatgtagaaagcaaaacatggagttttaaaccaaagttacgataatactagatttaatattttcccatatatttacttttactggcatctttatttcttcatatggctttgagttactatctagtgttctttcttttcaacctgcatgattctctttaagatttcttgcagggcaggtctaatggtagcaaacttctcaactttggtttatttggggatttcccaatttcttcctcacttttgaaggacagttttgctggatataggattcttggttgagaggtagtggttgtttttcttttagccctttacatatgtcatcccattgtcttctgttctccaaagtgtctgatgagaaatctacttataatcctattatatattcctagcatgtgactagttgcttctctcttggtgctttcaagaggccctactggctaattataatgtctcagtatgagtcttttttttttcatcctacttggagtccattgagttttctggatatttattttcatgtctttcatcaaatttgggaagtgttcagctttttttttttcttttttgagacagagtctcgctctgttgcccaggctagagtacagtggtgtgatcttggctcactgcaacctctgcctcctggattcaagcgattcttctgcctcagcctcctgagtagctgggactacaggtacgtgccaccacgcccagctaatttttttttttttaaacggagtttcactcttgttgcccaggctggagggcaatggcacaatctcggctcactgcaacatctgcctcctgggttcaagcgattctcttgcctcatcctcccaagtagctgggattacaggcatgcaccaccacacctggctaattttgtgtttttagtagagacggggtttcaccatattggccaggctggtctcgaactcctaaccttgtgatccacccaccttggcctcccaaagtgctgggattacaggtgtgagtcaccgtgttcagcctcagccattatttcttcaaatgatctctctgcccctttccctctcttcttttgggacttccacaatgtctgcttgctattcaacaatcgtccttatttctgttcctctgacttgatcatttcaagtgtcccatcttcaaattcactgaatctttcttctgttgctcaaatctgcttttgaatccctctggtgaacttttatttcaatcactacacttttagttccagaatttatttattttttttctttttaggttttctatctctttattgatattcccattttgtttacacataattttactgactttctccacatcttccttcagttctttgaccatctttaagaaagttgttttaaagtatttgtgtagtaggttaccatctggtctttctctggaacagtttctgttgttgtttttcctttgaaataccatattttcttgttttttgtatgccttgtgttttgtattgaaaactggacacttaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagtcataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattgggagatatacctaatgctagatgacacattagtgggtgcagcgcaccagcatggcacatgtatacatatgtaactaacctgcacaatgtgcacatgtaccctaaaacttagagtataataaaaaaaaaaaaaaaaaagaaaactggacacttgaatataataatgcagtaactctggagatgagactctcctcttcctcagggtttgctgttttggggttttgttatgttttacattgttgtaggttgtctccatgctgaggatcaacctgagttgtaagcttgaggtcttctcaggtctgaagctgctcctttccctgggcacacactcctctctccaaggatgtgtggtaactttaatttcctctgtgtatgccattgcttttgagtgtcctagtctttaatgtttggctcccaaaaaaggaaaagagaacaacgaaggggaagggaaatggggttctggccttttctatctcctagaagttgcttcagtctggtaagggcttgcagcagtggagtggggagttgtgagcaataatggctgccggcctctgtgtttgcccttccataatcaaaagtagcaatcaacaaccagaacgcagatgctaacacttggaggacagagtgcttatcgcccatgattgttcccacaagtcttagcccaagaagttagaagtggtgctcaagtttgtttgtctgacagaaactgtgaatccacactggcctgcttattttgaggttgtgttgccagagctttcctagcataataaagagaggtgcatacaaaggaataggaatagtaggaggtgggggtaaaaatatcaggtgtgatccacatgccaagccgacccgcactgtgtcccacaggaagcccagaagatgtttctgtaagaaattaaggattcgtttgttggggagggctgctggcatgcttgaaaagtactgtgacggctgaattttgtgggcttggggagattgcagattctctgatttcaaggggaatgatgtgatcctagagttgcaaagaacaagtgacagtggaggcgcttatgctttgtgactgcactagagacaaggaagacacaactagaataatggggagcaggaatggagcggccaacagaatatgtgactgttagggatctttgatgaaggctgattctcagggagtgaactagatcagtgaccaactatttgtctttatataactgggtaatgtggatggattctaataaagggactacttacagcacagcaggaaagtcacaaagaaaccagacagaagagtgtaagtagtaaggggccaagcagtcacctgactagagacagtgccagcttgccaagaaggcaccagacagaagctgtgatcttcagcaaagggacacagtctgcctgtgctgaccctgcaggggcagaggtgggggatacacacactcttctctcacctatcttctgccaccccctccattagctgaaccccaataaaagcatgagggtaagggagatctctgaagtatccaattcaggtgagcctcctaaggaacaaagcagaatgcagaaaaattaagagtgggtctagggaataaaatagagatatgcaccagagtatgatgatgtgtctgggaaagaatatacaaatacttttaaaattactagacaataaacctgagatgacactaatacaggtaaatctcatttaatggtaatatattccaagaaatgcatcattaggtgattttgtggctgtgcagacaccaaagagtgtactttatacaaacctagacagcgtagcctactacatacctaggctatatcgtacagcctattgctcctgggctacacacctgtgcagcatgtcactgtgctgaatacagtaggccaatggtccccaacacccaagccatggaccagcaccggttcgtgtcctgttaggaactgggcacaaagcaggagatgagtggctggccagccgagcattactgcctgagctccgcctcctgtcagatcagcagcagcattagaccttcacaggagcacaaaccctattgtgaactgcccatacaagggatctaggttatgttctccttatgagaatctaactaggctgggtgctgtggctcacgcctgtaatcccaacactctgggaggtcgaggcaggtggatcacaaggtcaagacaatcctggccaacatggaaaccccgtctctactaaaaatacaaaaattagctgggtgtggtggcgcatgcctgtagtcccagctactcgggggactgagacaggagaatcacttgaacccgggaggcagaggttgcagtgagccgagattgtgccactgcactccagcctggcaacagtgggagactcagtctaaaaaagaaaaaaaaaagaaaaaaaagaatctaactaatgcctgatgatctgaggtggaagagtttcagcccaaagccatccccactccgtggaaaaattatctttcacaaaaccagtccctggtgtcaaaactttggggcccactgctgtaggcagttatatcacagtagtaatatctaaacatggaaaagatacagtaaaaacacagtacattgggagaccgaggggggcggatcacctgaggttagaagttcgagaccagcctgaccaacatggagaaactccgtctgtactaaaaatacaaaattagctgggtgtgctggcgtggggctgtaatccctgctactcgtgaggctgaggcaggagaatcacttgaaccccggaggcagaggttgcagtgagccaagatcgtatcattgaactccagcctgggcaacaaaataaaactccttctcaaaaaaaacaaagaaaaatatatatatatatattacaaaatttaaagagagtggtacaccagtaaaggacatttagcatgaacagaggttgcaggactggcagatgctctgatgagtcagggagtacttggtgagtgaatgcgaaggcctaggatattactgtacataactatagactttatatgcactgtacacttaggctacactaaatgtatttaaattttttctttctttaacaagttcatcttagcttatcataactttataaacttttaatttttttaattttttgattctttgataataacacatcttaaaacaaaaacacattgaacagctgtacagaaatactttatatccttatttgataagcttcatttattttgattttttatgttttaaacatttttgttaaaaactaagatacaaacacacacactagcttagccctgtaagggtcaggataatcaatatcactgtcttccatctcgaaatcttgtccaagtgaaaggtcttcagggtcttcagtggcaataacatacatgcagctgtcattctctatgataacaaggctttcttctggaagaactcgtggaagaccttcctgaagctgttttatagttaattttttttaatgagtagcagtactacactctaaaatatgaataaaatctatagtattatacatactgttgatccttgaacagtgcaagggttaggggaccagctcctgtgcagttgaaaatccatatataattctgggctatccccaaacttaacttaatatacgatatatatcatatataatatatatgatatatatcgtatatattacatatgatatatatcgtatataatatatacgatatatatcatatataatatgtatgatatatattatacacaatatgtatgatatatattatacacaatatgtatgatatatattatacacagtatgtatgatatatattatacacagtatgtatgatatatattatacacaatatgtatgatatatattatacacaatatgtatgatatatattatatacaataagtatgatgtatattatatacaatatgtatgacatatattatatacaatatatgatatatattatatactatatgatatagattatatacaatatatatgatagagattatatccaatatatatgatagagattatatacaatatatatgatacagattatatacaatatatatgatacagattataaacaatatatatgatacagattatatacaatatatatgatacattagatacaatatatatgctagattatatacaatatatgatatagattatacacaatatatatgatatagattacatacaatataaatgatatagattatatactatatatgatatatatgatatatcatggtatatcatatatataccatggtatatcatatatatatcatggtatatcatatatatgatatatacggtatatcgtatatatgatatagatgatatatcgtatatatgatatagatgatatatcgtatatatgatatagatgatatatcatacctgatatagatgataaatcatatatgatatagatgataaatcatacatgatatagaagatatatatcatatatgatatagatgatatatatcatatatgatatatcatatattatataataaatgaaaaatattatctataataaaagatatatattacataataaatgatatatattatgtaaaatatatgatatatattatatattatatctgatatatattatatattatatattatatcttttatctgatatatattatatattatatctgatatctgatatattatatattatattatatataattatattatattatattatatattatatataaaatttatgatatatattatatattatatataatttatgatatatattatatattctatataatttatgctatatattatatattctatataatttatgatatatattatatattctatatcatatatattatggtatattatatataattatattatatattatattatatataatataccataatatatcatatattatataatatataatataatataatataatataatcatatataatatataatatattatattataaaatatattatattatgatatgctatatattacatattacattatacaatattttatataatatataatgtatattatatattatactttattatattacatatataattatacattattatatttcatatataattatatatattatattatatataatatctgtataataatatatattatacataatattatatattatgttatatataatattatgtataatatatattatacagaatattatatattatattaaatatattatatattgtattaaatataatattatatattatattaaatataatattatatattatattaaataaaatattatatattatattaaatataatattgtatattatattaaataaaatattatatattatattaaatataatattgtgtattatattaaatataatattatatataagggatgcaggatgtaaaaggaaattatatatatgttatatattatatatattatattatatataatatatatatatatttgggggtgccctatttcctatctcataacttattttaagaagcacagcataataatgtgtggacttgggattcagtttttgaaacgaaacactgagccttcgatgaccttcctgtacatctgaaagcacacctgtctgcatggcagcagttggacctcacagtgtggattgtgccttcaccctggaatgtttatgccctatcgccatggtgatgggattagggatctgctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatataaaaaattagcctccgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccaatacagtgaaaccctgtctctactacaaatacaaaaaattagccaggcatggtggcagctggtgtagtcccagtgtggtgtagccccagctacctgggaggctgaggcaggacaatcgcttgcacccgtgaggcagaggttgcagtgagccaagaaggcgccattgcattccagcctgtgcaacagaacaagaatctggtctaaaaaaaattatacatatataatgtatattatatgtactatatattatatatatcatataatatataatatatataaaatataatatacattatatataaataatatatattatatgtcacgttatatatataatatattatatataatatattatatataatatacattatgtacataatatattatatataatatatttacataatatactgtatacataagatatattatatataatatattatataaatgtattatatataacatattatatataatatattatatacctaatatatattatatataatatattatatataataaatatattaggtatataatatttactatatattatatataatatatgtaatataacatatataatatatgacatatataatatatatattttatatagaatatataatatagataatatacatattatataatatgtatcatatattacataaaatatatatcatatataatatatataacacatcatatatattatatataatatgtatgaaacatattacataataaatgacatatataatatatgatatatattacatataatatatgatatatattacatataatatatgacatatattatatagtatgtgacatatattacataaaatctgtgacatatattatatgtaatatatgatatataatatataatatatgatatataatatataatatatgatatatgatatatgatatataatatatgatatatgatgtataatatataatatatgatatatatgatatataatattatattacatataattatattatattacattatattatatatatcataatatattatataatatataatatatatcataatatattatagaatatataatatataacataatatcttacataatatataatatattatataatatatatcataatatcttacataatatataatatattatataatatatatcataatatcttacataatatataatatattatataatatatataatatcatcacattcccataaatatattatatattatattattataaaatacataagcctatataatgttatatataatataatgttatataatattatagaatataatattatataatatagaatattatattatataataatatatgatattattttatataataatatatgatattattttatataataatatatgatattatattatataataatatatgatattatattatacaataatatatgacattgtattatataataatatataacattgtattatataataatatataatattgtattatttaataatatataatatattatataataatatatattatattatatattaatatataatattatataatataatattatataatgttatataataatatataatataatattatataatattatataataatatatgatatattatataataatatatgatatattatataataatatataatattatatttaataatatataatattatataataatatataatattatataataatatataatattatactatataataatatataatattatactatataataatatataatattatactatataatattatataatattatattatataatattatataatattatattatgtaataatatgtaatattatattatgtaataatatgtaatattatattatgtaataatatataatattataccatgtaataatatataatattataccatgtaataatatataatattatatcatgtaataatatataatattacatcatgtaataatatataatattacatcatgtaataatatataatattatatcatgtaataatatataatattatattatgtaataatatataatattatattatgtaataatatataatatattagattataatatacattatcttataatatattattgtataatatattatatattatattatatataatattatattatatataaaatatatattattttatacaatatattacatataatatattatataagatattatatatatcttatataatatattatatgtaatatataatttatattatatattatcttgtatatataattatacatattatattatatgtaataattatatataattatatattatattatacgtaataattatatataagtatatattatattatatgtaataattatgtataatatatattatattatatgtaataattatatataatttatgtattatattatatgtaataaatacacataaatatatatattttattatatataatatatataattgtatattttattatatataataattattgattatattatatattaattatattttatattatttttaatattaattgatattaattaataataaatttaaaatattaattattattttatatattatattatattatatattatattatatattatattacattatatataatatatgttatattatattcttatatattataatatataatatattataatatatattatattatattcctatatattataatatatgatatattataatatatattattatctaatataatatattatattatattatattatatatattatattatgtataatatataattatgtattatattatatataattatatataattatatatatattatattatattttattattatatatattcatatatattatattatatataatacatattatagtatacgtaatattatatataatataaggatgcaggatgtaaaaggaaattatatatatgttatatatataatatatattatattatatataattatatgtatatatatttgtgggtgccctatttcccatctcataacttattttaagaagccagcataataatgtgtgggcttgggattcagtttttgaaacaaaacactgagcctttgatgaccttcctgtacttgtaaaagcccacctgtctgcatggcagcagttggacctcacagtgtggattgtgccttcaccctggaatgtttatgccctatcgccatggtgatgggattagggatctcctgcccttggtcctaagtgccactatctgtgctgagtttttcaaaggtcagagcagattgaaccattgtggtttcattttccctgattttgatttttcttatggggaacctgtgtggctgcattcaaggtatgttcatactggcctgtcaaatgcgatcttttcaaattactagttaatgctttcaaaatatgttatttaaaaaattagcctctgtattttccatatgcagttataaatatgtttcatgattatgttttattcctcaatttatatatttgattattgtaccaagcagagtatctttgaaatttttcttcatttaaaaaatatgtatcttgactcaggcctgtaatcccagcactttgggaggccaaggcaagaggatcacaaggtgaggagatcaagaccatcctggccattacagtgaaaccctgtctctactacaaatacaaaaaattagccaggcatggtggcagctggtgtagtcccagtgtgaattgggattcagtttattcagtttattcccaaattccaaattatatatatatatatataatttccttttacatcctgcatccttcaacgttccatcccccaccccacagattaagttattccccaggggagaatatggcaaagtctattttaatgcagtttttaacccaattaagaacctatgaaatcattactttccaaaactttggaacaaagccacagtagtatggatccgttggaggcttttcacacaataaaatgtacatctctttgtttttaacatgtttttcccttcctctcttctttttttgtgaaatgtgtatttactttaatatatttgtagtaagtcacttccatgcacatattaattttttaaagtaataagtatgtgtattgtctacgtgtgaaagaaaacacacatttatttttatgccttggaagttatccagaatcatggaattgtcaatcacagtcaatcacccaacctactcacctttccagtgtaatcttagtcaaattttttttttgttatccaatgagatgcagtatttcaactcagaaagataaatagagtgaatttatagagactattaactaagaacatacagttttatttatactcagaagcaagtagattatgtacatatatatgaagataaaaattaaaaggataattgtgtaaatttgcatgtagagggctttgaaaacctgtttacttgttaatgctgttttgatgtattgtgtctttgttctcccgacccatcgtccagagctctctgcaggagctaagtgctcatcagttccatgacttggaaactgtctaagtttagaggcacttgtatttgttagtaaataaggcaagatgatattgtttcacaggttttagtgccgaagactgaatagataagctgctccacccagtacactggtgttcatttcatggtcatctcatctgttaaccatggatataaaacatttatcttcaatgatggggttttaccatgttggtcaggctggtctcgaactcctgacctcaaatgatccacccacctccaccttccaaactgctgggattacaggtgtgagccactatgcctgactgattattttcataaccaagaaaagaaataaatacaattaatgctggtgcatggtattaaatctagtttttaaaaaattcacacataaacaaggcagaaccctataccctccatgataaatgcagtagcagtgtatgtgggtctgtggaggttgaaagggacttggtagatgtcaagaaggtagtggcagtcctgctgggcttttaaagggtctgaagaagtgacaggatgctgtggttgaatcctagcatgtattttagcatttgttcatttggagttgattatttcacgttgctttcatttgccattacctggaaagccaagggctctactctcatttccttgctgctctttctttgccttccttggtccgtgaagaagatggtccaggagaagctcattccatgcttgttaaccaggcacgcccctaagttccagtccctgagtcattcatgagtagcactgccaatgaactgacagccatgctgtgtccctccacatcccctaggtgactcgaagaagccttccaaaaagcgtgtgaaaaggaagccctactctactaccaaggtaaagtagcctgtctttgcctaagatgtaaatgttgttttcttggatcctttatttttcagttgatatcagctatgggaaaattctccactacattataggtgttagataatatttccttggggatggaggaggtgtattttaccaactgacacctgattccagaggacgtgcaaaattggcagtgtcagatagtacactgggtgttaagggatgttttcttcaggaacaagctttccactttagataagaattctgcaattgctactcaaaaattacctagacagaaacattcttcaagaaaagctcctgtgctttcctaagggaactctactctagagttggggcttttgacttgaaccttatttccagtcttggttacccagagtttccaagtgaacaaaagacctgtgtgagccatccatagcatagcctgattctcagagtgttttccttctctaattacaggtgacttcagggagcacattcaatggtacgtattctggaatcactcactggttgttagaaaaggattctacaggaaatctggagcttaactgctggcttttgtctggagagcctccatgatccaagacatctggtgggaatgaggatgtagggtatagtaaaagaaactggttttcctggtgacatactctttttatctatgtatagtttctgggaacatgttcacattaggttgtgtgtgggtatgtgtgtattagggcgggggtggggtgaggtggtctgtgtgcaagtctgcatgatttgcttgtgaatgtgtgtctatgtgtgtttcccctaggaaaaaaatgttgtgtttacccagcacaactctcagtgccatgtttcttaatttaacaaatcagaccacatactttacttacattagttcacacctcatcatcatcatgcccatatgttgtgagcttgtttattgagcccacatgccagatggagaaactaagccacataaataaatgtgccctggttcacttgctgcatagtgaagagtcaaaatgtttactcaaacggtgctaatgttgaaggcctgaactacaacctctatttatcagccagtgaagagatcactattcaccatgcaagggagttccagcaccctctatgcctggaattacccacgcctgcagagatcccaaacgccatccctcacataagacagcctcatgatctcataatccaggtagctatgtagacatcttcctgcaggtgtcacatagtccttagtgtgaaaccaacatagaaagcccatgtttctgatcaaatcacaggttctgaaacactaagggaggcactaagtaggacaacgtggtgcctgcgtgtcatagctgggtctcctcaagacatggatcaagtccagtaagaattggggagatgctttagagtcttgatggagttatcaccacaagccctctgagctacacactttagggatcatgaccattaagtactcaaattaccatttggttgttatccgggtatccgtcgtccttgtggcaaccctcttgtgaagctggtgtggacagcctcagtgctggagctgtgcctgccttctgagtggaccctttctgtgttagcaggtgggtacaagcgtgggggtcagcacactcagtggatttacacacacagcgttgaagagtaaggctgggcttcgttatttatacattttcaataaatgatgatcttcataacataaaatcaatgatgtagtacactagaatactgtccctagtattgaatcttgtctctcagcaaagggttgcttaaagtcacgtgacagattccattcaactgatgacacatgctgtagcagcagttaaagcagtcatttgaaaaggcttttactataaacttatgtgtgagcctgaagtgggggataaaagaggtgattagctcccctgtgccatgtttctgttatgtgcgtggtggaggaaaattacacaggaaggtgatggagagaacagagcaaaggattggacaggtccattgaacccataagactatggtgaggttagtgaatgagactggtcattttaggtcaaattttacccagagctggtacagccactgccgattcttagccagaccttattgcaggcagctctgatcaatagtcaaggaggcagtgggggttgcagactttattcattaaatcaccaaagcaccagcccacacggccacttttccagttaattcacagtagcttgcatattcaggtttgatcagtggaagggaagttactctttgcagactcatttttgacaatcattttgcggtgtcagaaggtctgagcagcctcgggaggcaagcagtccctggtccctcagtgtagtcactggaggagacagtcactgagaggcagctggcagggtgaagggaaaggggaggcaggccacagagatgacagtctttaagctgtcatactggtgaggtcaaggatctgaaagaggaaggagaattctttatcattaaggacctgtccttatctcaggcatttcctccagagcatcacctttgtccacccacacaccttgggctaggaggactggagaaagacagtgaggggtctcttgggtctctggcacagggcgtgatgaagaggtggcagtttttcaggaatctctctctctagggaaccaaatacatttcccatctcaggtccttcactcagcggggttgaggttctgctcgtcacttatcatctctgaatgtcagcaccctcaagtgtaaaatctcagccacagcccctcctctgcaccccctgcagggctgatgttctccataaaccataaggcgtcatgcccacggaaaagccgaacaggaaagcatgctccactgccccggagccatccaagttccccctccatattccgccactgctaagtgtccagcttattcctcctggcctgtagtaaacacttagagaacattactgaagtaccagtcctctctaaggttttcctgtatttagtgattttttagccctgtactgtgatactaagaagtagggcctaaatagggcctaaaaagtattgctaaaattacattatgacagtgcagagaactgagggcagagggaagacatgagcttgccaggtccacatggcttagtggaatttgaatccgggcccccactctgcaccagccctgcactcacagtcatccggctgtgttcccctctccaggaaggcactgcccacgcagtctgtctgatagaggtgttgagtgctcactgaactccgtgatcttcctgaaacccaactttgattcagtgggctctgcttggaagcctgtaaagaaaaggatcataagtttaaacttagaacagattatcactattttccctctggccttctgtcagcaagatgtcaacagccctatctattgtcaatgcattaaccagcgtcttctctgatagagaatacaagaagatatgctgtgcacaccaaccagtgtaggagacctcatggctcccgggtaaagaagaagaggtacccacaagaaggtactgtggaagttcattaattaagttgattcaagaattgcagttgcggggagtattcagtgtcccatatgtaagaggaaactatgaagagactaagccatattttttaatgtgtcaggattctaatttgcctggtcagtaaatattgctaccaccacaaaagtaaatatctacttaaaagtcaattttggttcatgtttaatgatagacaatgtttcaagctaatgtctagaacttacctggttgttaaacaaaagcatagatctccctgaaagagtggtgctatattattacttttcaattaatatatttctttagagaattttaaattgacataaaaactgagcatatggccgggtgtggtggctcacacttataatcccagcactttaggaggccaaggcaggcggatcatctgaggtcaggagttggagaccagcctggccaacatggtgaaaccccatctctactaaaaatacaaaaaaattagccgggtgtggtggcaggcgcctgtaatcccagctactcaggaggctgaggcaggagaatcgcttgaacccaggaggcagaggttgcagtgagccaagatcatgccattgcactccagcctgggtgacgagtgaaactccatctcaaaataaataaataaataaataaataaaaattgactatataatacacgaagttcccatattattctgactcctcaccctcacttcctaatttcacctattagtaacatcttacattactgtggtacatttgctagaataatgagaacatattgatacattattatctgaagtctacatttgcataatgttcattctttctgttatacatatatatgaattttgaaatatttaaaacattatgttcacccttatggtctcataaagaaaatgttcacttccctaaaaatcctctcttctcattaatctctgtcctctttctccagaaaccttggcaactattaatatttttactatcgcttcagctttgccttttccagaatgtcatatagttggaatcatatattatgtagttttttcagatgaatttattgcactaaattgatgtatgctttagctgctttcatgtcttttttatgccttaatggcaaaaaatggcacattaaatcaccaaataatattgcattaaatgaatttttgtctttttattcacctgttgaagaattcggtagatttcatgagagaaaccatctgggcctggtgctttctttttcggaatgctcttaatgtgaattcaacttatttaatagacataagtttattcaaattaggattctagcgtgaccttgggaagattgcctttcaaggaattgatacatttcactgaggttatcagactgcggtcatagaactgttcataatattccttttaatgcctaacagttcagtagagatggctcctcttttatttctgaaattggtcatttgtgttatcttctttttcttggttagcctgcatatcaattcattcattgtaatgagcatatcaaagaaccagcttttggttttattgattttctgatgatttcagtgttttaattttattgatttctgtgatgttgtttattacttttacttgctttccattgcattcctctattttctatagttccctaattgaaacatgatattactgattttaggtcttgtgatttttagtatattgcatccaatgctgtagatttccctctaaggactgcttttgctacatccagaaatcttgccaagtgacattttcttttaatgtagttaaaagtatttttaattttctattgagacttcttcttttacccatgagttatttaaaagtgcattgctaatttgcaaatatttggggattttgtggctcttttacagttgttgattttttgttgtcaggtgtgtgttgcaaaagcagtcgtctacctcatcttgccaccacccaagatggcccaggatgtgggctctccctgagtgaatctttggcaatctgccaacctgatgtgttcggcctccttctttagtctgagcttgccttctgcttagaaagggccattctcagttctggcagggagttttcccaacattgagaaggtggcattcttactccccactgcagcctgcacctctgaccggtggtcagcagacaggacagaggtcctcattagacagagttcagcagggtctctgaccaaagtgcatcttcagagtctgcacctacccactgtgaccacgggcaggctctgagtcctaaagcaggaggaactgtgcgaccatcctgattggaaatttgtgaggatcaccgtgttactcaagtaaggtctttggaaagtgtcgtattactactgtttgtgaactgcttgttggtggcctggctgagccacacactttatgaaaaccaggacccctcagctggtgtgggtgtctatgcagcctgagaccctcatgtgaacagcctcgtggcagctgtctttgccccttgccaccatcagtgcctccttgttcctgggcactgctttctctgatggtgctccattgttttcctgcacctcagtgtctacagctggatgtctcttccacagtctaggcgagggggcatcaatggcagttctgctgtggcactgccctccttcttagcttgtcttgctctgtcttaggctccctcaaagatcccacccttcgggttcttccacaagtttcttattgaaatccgagcagaaaactatgaccaatatgaccaatcctatacccactgaagacatgaatgaagaattaaaacaattctccatggactctaccatatagatccctagaagtaatttctaaaaaaaaaaaaaatcaaggaagatgtaatagttttccataaattagaataccctacatgtacaattaaatgaaatggctagtatagtcttgaaaccaaatccagataaggtaaattaaattctgtgatattttaaaatactttaaattctgactaatgtgagttaatctcaacatatgaaatagtagattaacattgaaaatgcaataaataaaattagctacctcaagagtttaatggaaaaaaatgtgattattgcaatagattcaggaaattcatgaataacattcaccctatatttgtaggacaactatctgattaactttaagtgacctgtgacaaccacttgaattaatgctgctttcacagcatatctcttggcttgttaaaaacccgacaagaatttccgtaacattatttttaacacctatattgggtgtgaacccaccataaagtttgcccactgaaaaggtctagaatttgatgctttattaaattgatactgtgtgcacccaacaccacgatctaatttaaatatgtttccctcacccaagttctctcttgcgcactggcagttaatccccactcccatctccagccctaagcaatactgctgtgacattccatctccataaatttcccacttgctttatagaaatggacatatatatatatttggaatctgacttccctcatttagcatactatgtttgaagttaattgacgtgttagcacgtgctggtcatgtgttttccttcatagtctgctgtgtttattcatacagatagtgtttattcatttatcagttaatggacatttaattgttttgttattttctttgatgagtaatgtagctttgtgcattcatatacagtcatgtaatgcataatgacattttggtcaaaaaaaatttttttttttctgagacccaggctggagtgcagtggcacaatctcggctcactggaacctccatctcccaggtttaagcaattctcatgcctcaacctcccgagtagctgggacaactggcacacaccaccacgcctggataatttttgtattttcagtagagacaggattttgctgtgttggtcaggctagtctcaaactcctagcctcaggtgatccacccacctctgcctcccaaagtgctgggattataggcatgagccaccacacccagcctaatttttttaagaaagaagggaactattttctaaattacttttgccaatttatattcctaccatgatgcatagcactaatttcaccgtacaatgtatggtaggccccaatatgtaagaaatgatgaaagtaacacataaagattagtataagacaaatgagattatcgttgttgctatcatctttgtcaaattctgaaaacaatctgagtatatttttatataaatatgcttggcaacatagctgaaaaaagcattatcagttacatttatcagtaacaaagacataaatttgaagggggaaaaacacttgtactaacaatgcaatgtcagaattaacataaaaattctgctggtcactttggaatatttaattgcctggggcagtgtttagtagacacatgagcatctatggagcacccaaagtaggggaatcaacagaacttgggtttcaaaagttatctgggtttagagcgtgaaactttgttagaggacacacaccttgcatgagtgaggtgccttggtgtgtgtggacgtatcattatgcttggaggtacagcataatggtggcttcctccagaaagggacatttggggtagattcatgccatctagacaacacagcctgatgtggcatggacatgaatggaggtgaaatggtcagtagttgagaggatcagtcctgacaagggccgaggtgaaaaacctgggaaccccttcaggtgcaaagtcttcagttgaaaaaggaggtggtcacaggaaatactgagatgggtcagcaatgcatgggagacagagttcttggccctgcagggtgagtagtgtggattctcaagttttctcctctctccattaatttctttcccaatgcagatgacttccatcatacagtcttcagcaaccttgaaagattggacaagcttcagcccactcttgaaggtaaaggaaggcagctaacaagactggcatctgggcttggctgtgcatgttttctatcgtggggaaatatatataacacattatttatcatttgaaccttttaaccaaagtgtgcactccgtggcattcaatatattcacagggttgcataaccaacaccactatctacacccacaattttgatgatttcttacaaaaccttgtccacaataagcaatatagcgccttccccctatttccagcccatggtgattcctatcccactctctcgtatgaatttgactattctaggcacttcatgtaattacaattatacaatatattccttttgtgtctggcttatttcactaagcataatgttctcaatgtccacccatgttgtatcatctatcaaaatgatgttcattttttacagatggatgatgtagcattgcatgcagaccaccttgcttttattacattcatttgttcactgatggttggattatttccaccttttggctcctgtgaaaagtgatgctacaaacattagtatacaaacatctgtttgatttctgttctctattctttggggtgcctaggagtagagttcctgggtccaacaggggttctatatttaaccttctgagccactgcagactgtttttcacagtggctgcaactttatccatttctaccatcaatgtatcagggttacaatttctttacatccttgttcacacttattttcctttaaatcatcctagtaggtgtatattggtggctgcttgtgtttttcatttgcatttccctaatgactaatgatcctgagcagcttttcctgtgctactatttgtggctatatcttctttagggaaatatatgttgaagtcttttgcccatttttaaagagttgtctgatttttatttagttagtttgttgctgtagatttttgaatatatcttaaatatatttaaaaatattctaaattttagtctcttacaagataaatgatttgcaaatatttccccctttgtgtagaactttagattcacaaacttcattaatttgtatgaaatcctcagcagttgaccccaaacagataagactgaagcagtattttaggaatagttgaaagtatgatcaccacaaaacataagcgtaatcaaatcctgcaagctacatgtaaggcacaatgacaaataaggcagcaaagggccatctggtgattagttcaccacacttgttgcaactgtttgcgctgcagagttaaaacataccagcattcaacccatgtctcctgtcttgaagtaaactgtcgtatgttggctggcctgaacaagcgtagatattctccatcctcagttaatatgcatgcatgacaaagaaaaggaggcctggatgaaaaaatattgtgtgattaataattatgctttaattaattttaaaggatataatttcagtacttctaattctcccatcagcagttataacaaaggattagtgaataaataccatagactgttttgcctagaattgaatccaatctgtctattaaactttgcttttattcaagtgcaaaatgctaaaacacataataactgcagtgacagccactgtggatcctcagaggtaaaagtagtcttgggacataaatcctgcaagtaatattgtttttacaggtttagaaaaccatttagctgggtttcaaacctcacagtgtgagcagtgggactctcatcaaactatagcatgtgcttcagtaccatttgtagactgactcattcccattgccttaagttgccatcagcaaaatgccagggactctatttcttgctccttagctcctcgttcttgcctgtctttccacgagggaggattttctagcaggagctcaagctgtgcttttaatgaaacacatccacacacactgtcctgttgtccacattaagcagagctccctgaatagctcatgaacaaaagcatctatgactaactgttgctctgtgtcctcctagcctctgaggagtctctagttcacaaggacagaggagatggagagaggccagtcaacgtgagggtaaggttgccttgctttctctgaaatagaaatgttcctttcttgttgtctttctttttcaactgactttacatgtgaaaagatgacaatgtccatgacaggtattaaatgcagttttctgagggggaggaagaagtgactcttagcaactgatatgtaatccaaaatggcatttagctatgatggcttcaggttgtagactgtatccttggggtccttgtccttggaagcaatgtcttctccttggattcagtattttgcacttgccaacctacgtggacctgagagatccgccatccagaagctgatgtcttttccagtgtgtatcctacccttgttttggaggccttgaagttgactacactttctgatcaagttttcaatattcattgagagaaacacagccttgtgcaaacaatccacaacatgacatacccctcaaaaagctttgtttctgtattgcaggtggtgcaggtggcccctctgaggcgtgaatctagtaagtattctggaatcacttaccaagaaaacaatctggatgccaagaaaggtgtggcatccttgcctggtttcaatgtgaagagccaccctgatcctgggattgtgataggaataagtataggggaagtgtttttttaaaacctgaattccccagggaaaaattatggccaaattttgaggaagcagctgtgctcccttttgggtggtgctgagttgggtgcttgaggattggtggtgtcttgtgtgaggctgcatcgtgtggtgtgaatgtgtgtgtttctgtacaggtgaggctgtgtgttttctcaggagagatttcccacttatacaacccaatcaccagtgtccacttctaacaataaaatccacccccgctctactctctctgtacagtgactcctccaccctcaccagagccatccccgggtctgccttattatccccactgctcaggtggagaacctgaagggccaagggagtggccccagctcccgagttcctgaatgaaacagtgaaaacacgaacccaggagtgtgggccagtgctgacgctgacatgcacttagtcatggggtgttcaccaccacacagggagtccagcattcatgtataaaccctaaggcaccgagcccaaaaggccccaggcactgcccatcatcataaagtggcctccgtggtcacacaacccagggcagttataggttcatctccccacggacaggcatagtcatcagtgtgtcaaaagcacaaagatccccaggtgtttggctcagctcaccgatccttttttttttttttaacttttcagttcaggggtacatgtgcaggatgtgcaggtttgctacatatataaatgtgtgtcatgagagtttgttgtacagattattgcatcacccatatattgagcctaatatcagttatttttcctgatccaccctctcctcccacctcccaccctccagtaggccccacgctcacaaattctaagaggagtgggggaccacaaaggccagtgtggcccacttcagttgtgaagttaatttgctcagcaactggccaaagtctataaggatgggtgatgtattttagtagatttagtaatactatcttcccaagccctaaaatgctcaaatcctgccagccaaaaatggtgaggagggacagataggaactctgtgtggcacttggttattagcctggcttccatcccttagtggcaactctcttgtatatgtgggttaaagaccctcagcctcaagccaagcctcctccatgaggagccatctcactattgaccggctagtgccgggtatggccaccagcccaactgaaacaaaatgttgctttaaaacaagtgtaaatctcgtacatacaacaggcaaatgcagaagcagtgtggtctcgcaagttgtaaagaggacagtcgcaattttgctggacttcaacctgggtagaagacacgagggaactctgtcactaaatcacggcagagttcaaggccgcttgtagactatttcgtgttatagaaggtggcctttagctactaggcaaaggcctctgtttctcatttctttcctgttcatctccttggtcatccttcttccgcaagggaaacgagcccaagcaaaaggcagtttcaatattaatttgaccgaggttttgtgcagttaattatcatccaggtaatcaggtgcaacccagtctgcctagcagcccccctatctctgctctgtgttttcatttaataaacattttggtctacttactatgtgctagattttctcgagaccaagtaaatgagatagaatctttatgttggcagctaagttagatttcacataactgacaaaaattaaaatttctgatttcttgtaaaaatattttgtatgtgtgaatgcatactgaatgtaaagtggataaaaaactcacacttgcactcatggaaggcttttcatgaatttgtcaatttttattttttatatttccccacttcactggataatgcatacctgaacctggaaactgatgcccactgcagaaagtgttctgagccacatcccttagcttcactagtgcaggtccacctgggaggatgtcccagcatcagcttggcccatgctgtgatcagccacctccatgcaccacaccaagcaagcccctgggtgattcacagtctccactaccagggcactgaccttaactctgtgttcttctagctccccatgaggacaccgtacacaacatcactaacgaggatgcctcacacgatatcactaacgaggacgctgtccacggcatcgctaacgaggccgccgcccagggcatcgccaacgaggacgccgcccagggcatcgccaacgaggacgccgcccacggaatcgccagcgaggacgccgcccagggcatcgccaacgaggtcgccgcccagggcatcgccaacgaggacgccgcccagggcatcgccaacgaggacgccgtccatggcatcgccaacgaggacgctgcccacggcattgctaacgaggatgccgtgcacggcatcgctaatgaggactccgtatacgacatcgctaatgaggatgccatatatgacatcgctaatgacaccgtacaaggcacgctaacgaggatgctgtacacgacatcgctaatgaggacaccatacaaggcatcggtaatgaggacgttgtatatgacatcgctaacaaggacactctacaagccgtcgctaacaaggacactgtacacaacatcgctaatgacggcaccgtacaagacatcaccaatgagggcgctttatacgacattgctaatgataccgacaaggcacgctaacgcggacactgtacacgacatcgctaatgaggactccgtatacgacatcgctaatgagggtgccgtatatgacatcgctaatgacaccgtacaaggcacgctaacgaggacgctgtacacgacatcgctaatgaggacaccatacaaggcatcggtaatgaggacgctgtatacgacatcgctaacgaggacaccatacaagccgtcgctaacaaggacactgtacacaacatcgctaatgacggcaccgtacaagacatcaccaatgagggcgctttatacgacattgctaatgataccgacaaggcacgctaacgtggacgctgtacacgacattgctaatgaggacaccgtataagacatcgctagtaactatcgcaagaacaaaaaaccaaacaccgcatattctcactcataggtgggaattgaacaatgagatcacatggacacaggaaggggaatatcacattctggggactgttgtggggtggggggaggggggagggatagcatcgggagatatacctaatgctagatgatgagttagtgggtgcagcgcaccagcgtggcacatgtatacatatgtaactaacctgcacaatgtgcacatgtaccctaaaacttaaagtatatataaaaaaaaagacatcgctagtgagcacgctgtatacgacatcgctaatgaggacaccatacaaggcatcgctaacgatgacgctgtacacaacatcactaatgatgacaccgtataagacatcgctaattatgacgctgtatacgacatcgctaatgacaccgtacgaggcacgctaacaaggatgctgtacacaacgtcgctaatgaggacagtgtacaagccatcgctaatgaggacactgtatatgacattgctaacgaggacactgtacaaggcattgctaacgaggacgctgtacacaacatcgctaatgaggacaccatataagacatcaccaatgaggatgctgtatatgacatcgctaatgacacccacaaggcatgctaacgaggacgctgtagacgacattgcttataaggacaccgtacaagacatcactaacgaggacgctgtatacgacatcgctaatgaggacgttgtatatgacatcgctaatgaggatgctttacaagacatagcgaatgaggttgctgtatatgacatcgctaatgaggacattgtatatgacatcgctaatgaggacgctctatacgacatcactaatgaggacgctgtatacaacatcgctaatgaggacgctgtatatggcatcgctaatgaggatgctgtatacgaattcgctaataaggacgctgtatatgacattgctaatgaggacactgtacaagacatctgtaaaaaagaagatgctgccaatgtaagacacttttctttgtcttgaacagaaatgttactttcctggcttctttccaatcagatgtagacatgaacatctgccagtgtgcattatcgatgtcatctgcagtttaatcaaatgtagacatgaacatctgccaatgtggactatttatgacatctgcaattcccttggtgtggtgctattgattggcggcctctcaccaacccatgccaggcacactggggtgtggtagatggcagcatccacgatccactgcaatgcagaggtgtttccctccacagcagttttcccccatggattaagagttgtgaaactgccaatctagatacactttaaagataaattctgtgggaaaaggtcttgtcttttccacaggtgtcttccgtgccagttttgggggacttcatattttctctctcaagttgtcgagagactatcagatctgtgtgacgtgtatggcatcatttcaccctcctaatgttttcttttctataattgcaggagccattgacactggagaatgatacctaccctgaaataactcacttcctgagaaaaaagcgccatctctagggtacagaaacctgattctgggctccttttgggaaggaggatttggggtctggtgagagcaaatgattttgcaagtataaaaccatgtccagagaggctgtagggatatctgtgagcccagaggaaacaccaggggatcctgtgcgaagcaccatggcttcagctagggtgggaggagtgggtgggcctctctctaatgacttatcctggtgtttgtgtttctaaagatttgattgtggagagcatatctgatgatggggatttgtaggtaggtaactactttccacgtaagatccaattggagagagttcccaggggccttcggggtatccatgctgcttgggaggttaagggagggggcatgaaatcaaaacaaaacaggaaatatgtgtcatattggacttggtcttttccgggtttattggcataatagttagaactgtctctctgggctatgagggtgctgtgttatttaaaggtggtctttcccagaacacctggccttttcttttctgcctctgccaaacatcacagcctttgggttggattagtcagcaccccttgggattgtgcagaagaggtttggggttgcatcgagtgtcacctgtggtgaacagaatctgagggacacaactctctcacaggcacttcctccaacctggagacagaattctcctggtgtgtgcccaggggtggaggagaaattgacagtctgcctctgaactttcaggactttaaaaagcactcatgtttccatcctcactgttgactcctggcttaaagggatctcccggggtgagtgaggaggcgggatcggaccctagcagtctgacggcagcacctgtgttcctctgcactgggccgtggatgacattacacaccttggtgagaatcaggaattgaggctaaccacatctgaaattgagatgggccttgagtcatataaatagtttggaaaagatgcattttactacgctattgaaagaaaccatttatttctcactccagcaggataaatggttttcagtatccatttaactgctcattgactcttactgtagatgaggaggtggccagcagcccctgccctcccccagttggtaggcccaaggtaaccagcaattgactggatataatggaagagtggtgcattcggaggtatctgtattaatgggacccacatgatatggatgagagctattagggtgagaaaaagcctgggagcacaatgaaatatttaaatattaaacaaaacattgttgaaatctccattgtactttagtagttgaagtcattcttgtggtcatcactgcctttcccaagcataacaagctacttaatatcacatggacccgtgccatgaggaatgatgatcagtttgtaaaatgccaataaaacaattgcctatataagccacaatgtttcatccatatatttcaatttccatgtataagtatagttcaaatttcagaaatttattattatctaatagaatatgcatggtatatcaatgagcaattatcatactgtttctattaacaattatttgtatgatgaaaaaagcagactcccattcttggatttttctcagtttgcacacattagcatgacagccccatttccacctgacatgtgccagcaagaggccaggaacagaggcttttcttattaactaagatttctaaatgtattacgtattcacatttagaaactctaaatatcataaaaggttagcaaggaagtttcccttccactctgaacttccaaacaccaagtcaacatttttgtttgcatatcatccctgcaatctatgtgcaaatagaagcatgcacctggaatgcaggctgatgtgtgatcgtgtttacacaaagtcctctgcacctctgcatatatcactgggcaatgcaccttagttatcattccacatttcaaatgtaaatccattgtattgtttcagagctataaagtactgcaccccatgactattcccaaaattacttaagcaccccgctatgggtatccatttgttctgtttccagtcttgctcttataaccaatgctgtagtgaacagcactgtgttgagaagtggtgaacgtgggcatctttgtcttgttcccttcctcagggggaatgctttcaactctcccccattcaggaaaatgttggctgtgggtttgtcatagatagcttttattaccttaaggtatgtccgttctatgctgattttgacgaacggttttaatcataaagaaatgctggattttgtcaaaggctttttctgcatctattcagattatcatgtgatttttgtttttagttttattgatgtgatgtatcacatttattgacttgcgtatgttaaaccatccctgcatccctagtatgaaacccacttgaatcatggtggattatctttttgatatgctgttggattcagttagcttggttgtagcatttcttattattccatctgtggaatgtattggttgaaataatgaaaacatgttctatcctcactgcttagcactttgtgtttctttaatagccttcccaacagggcaacataaaagcaggagccctgctagtctccccttaacccggaatccccccttctccacagctcgctcattggacaggatagactgggcgcccaggcttcaaggtaaggacatgctctgtcacctagaggtgcagtgcttgggaaggccaaccttggagggttgcctgccagctttacagtgacagaggtgttgagagggactgaccaccagtgcagaaggctgtgctttgttggtgacataaaggattgtttcacagattgttggggagggacaatcccaaggcctcccctggccctggtgctggctctgcacaaaggcaataagagagggatgctggtaagggctgacctgttgctgtgctggggaggaaggtgctgggctgaaattcaggaggctgaggatgcagcagtcccataggaggtacatgaccttcaggatacattttcttcattgatgatcaatggaaatgagaaatcactgactattttttctatcattggaatctactctccactgctcatgctgttcctgtcttttggggaagatggaggatcaatcagtgtgcgctgccctgagtggaaggaaggagaactgtgacaaaaattaaggaaggatgagagacgggagggcccttcatccagctgcttgcagagtcctcctgaggaggaaagccccgtggctccctggcgaaggagcagtgagggctgcgtgactcccacagtgaagtgtgtggtatgtctgaggacacccaggctggtggtccatgaggagccagtggcagagtgagaagcagaaaggccaggagggtggctggaggccaggctctgagtcattctccatgtgatggaaacagccggagcccagtgggcttggaggtacaggatgcggtggctgatgacagaacaatgtggagagaggtgtcatttgtcaaatccttactttgttctgggcattgtgctaaaaattctgatggctcatcccatttaggggctgaaagttgcagaggtttaggaagctcacccacgatactggagcccccatctcctgccctagtgctgtccaccttctcacccagccaccacctgtttcgggggaacacacagaagtggtaacctcttatggagaggcaagtaaattctgctgtttttgttattcacagaaaaacactggctcgtgtgggttgggaaggtgaaataccagaagtatttcatctggttatttctacccatgcgactcctatagtattgaaatgcataggttagcatttttggccaatttactcagcattctgggttaaaggcttttatttattttatttatttatttatttacttttgagatggagtttcactcttgttgcccaagctggagggcaatggtgcgatcctggttcattgcaacctccgcctcccaggttcaaactattctcctgtctcagcctcccaagtagctgagattataggcacatgccaccacactgggctaatttttttgtatttttagtagaaatgagatttcaccatgttggtcaggctggtttcgaactcctgacctcaggtgatctgccctcctcggcctcttaaagtgctgggattacaggcgtgagccaccacgcctgccctaaagtcttttaaaattcacttgtataagttgacttagttttctttaaccttgtagaaaaatacaaaaatggcaatctcttttatcacacaaataatgtctttttaatggagtgattttttttctaattgaggtattatgtacttttcatttactaattattgtttacatttgaagtgttttatgaattaatatttaattgcatagatgaagattactagttataggcattttactaaccaatactcattaagcatagcgtggattcatatgacatcaaggagctattttatttggtaaaacgaaaaagcacaagaatgaacgaacgcaagaactgaaacagtggagacacctagaatgacttgtctaagatctaaatcattttgttgtcttcccagcgtacttattatcctgatcattgtcatcagcattgtttgggtccttttagcacagatttctcaaaatgggtaactccataacagttggaagcttacgaattcatataatttgtaagaggtcaatttggaagtacctatctattttaaaattccaataacctgggaatttcatcccatgtctagagtcttttatgtaaaatatttccacaattaggagaaatatgtgcatggggattttctatgtagcggtgttttgatagaatagaaaattgggataaaccaaatttccatcacgaaggaaatagtaatatgctgaataataatacagcgaatattatgcaggctttaaacatcaaaaaagagttcaacttctgacttccgatgatggtgttgaagcaggtcactgctggtttacatttgattttcatgtgggaactctggaagtccgccttagtgattttacatgtggctaaattgagctaatgacaagctgttcgaagtatggcaaaatggaactttaaaacagtatcttgtcaacaaccaagaggacctgtttcacataaagcccacgcattcatctgcctgtccatcattctgtctgtccacacgggcatcattcgttagtggaactgagtgcccgctgtcgagctgacaagcccataacctccctgttcctagtcacacattaattcttcaacaagtcccttttgatagattgtgattaagcttagctactatttccaattgcttccccaaacgtacttctcactgttctcccatcacacccttcagcccatccatgcggggttcctttgcttttcccaccttacaccaaactccctatttttactcccacttttacctcctctccaagacaaaacaaacaaaactagcattttaaaacttagttgtaatctttcttccttcatgaaaatttctccaacagccactcccacggtcctgtgtgttccggatattttaaaataatggctataaggctgagcacttcaggatatgctgttttgctgtgtgcagatggaggcagtggctggagtgaatgaacggcaacacttgctggcaaccggcagaagctgagagacagggaacaggctctcctccagagcctccaggagccaggcctttggacaccttgaatgtgggcttctgggagaccatgcgtttctgttataagcagcccagtctctggcagtttttacggctgccccggaacactcatctatacctgtctgacaaggtcaagctccaaggaagggattctttacatatctacattgtttgcagattttacaataatcatttattcttgcatggctgatcattgttaaccaatacaaataaaataataaagaaatgacccacattttatgttgggagtttgatctgccatttatcaagtatggaatcttgaacaaggggttaaacatctgaatgtctccatcacttcatctctaaagtgggggtgctcacacccactgggctcccccgcccaggttggtgccggactctccctgggcccccctgttctctcaccagccacatccattctccccccagaggcgctagtgactgtgcgtggctttccattcccaccacgtttgtctctaaccccagtggcagatcagtgtaagaacacagctgagtgctcctcgcctccttgccccttcaagggctcctcaccacccaccagatcaggtgcaaacttccaagccttactggatccctttccacattctgagctccgcctgccttcccatcgctatccttccccacctgcctccctggtagagaaaagcagagtgtgtgatgctgtctgaatgctgagcacggccttttgcagccagtccactgtgtacgctgcccctatcggagacctccaccttaaccctttccagcctgtaggctcctcccagggccccacaacagaagtgacttcccttgcctttgaatttctatagcacaagccctactgccccccgttaaaactgcaaagtccttttgtggaaaataactttattcatgactgtgtttatcacactatcttatggagaagagatgatcaataaatatttgctgaataaatgaatagcagttacaaaacactagattcatatggaattaatgttggttctcaaagtgaaaaattacaaacagcactgatattcagccagtatacaagtctggtcacagcagttgtataatactgaaataccccctgccactgacctttggcccccagatgcctcccactgccactgctctccccactgggaacccctgaagttcccacaggctcataactaaagggctaatgtctcgcacagcagcgagcacccaggaccgagcagccacatggccgggtctgctggtgaaagcatccattctgactgatcaggacctgaggggcctcatggttacatattttgataatatccctaattataaataaggctcagttatatagtttgaaaacaatgcttctcctcattgcaaaatctcttagaagactccgtagatccaggaacggaaatggaaaatgacagcgtgtcaatctctgaaggttttgggcatttccattagcactccatcttcatgtaaaccagaagatatgcagtttcctgcctagagagaagagaagacacatcagcacagcggcatgaaaccttcatcagaaaacaatgcttcattaatccgtgacaggacaagcgtcagcaaacttccaggcggctggattaggccttcatctatccatcaccttggagaggaacaaaataggtggcctgggaagttaagcactatgtttctattagttaatatctaaagcggaggttaacaagctatggacacacaagccaaacccagccctcttggggttttttaaatctactttcaacttttattttagattcagcgggcacatgtgcaggtttgtcacgtggatatgagcatactccccaacagttggcctttcacccctcccctccctccccatccagcagttcccagttgttgccatctttaagtcaatgagtccccatgtttagctcccatttataagagagaacatgcattatgttttgtttggtttttgctggtttttttttttttttttaatggagtcttgccctgtagcccaggctagagtgcagtggcacaatcttggctcactgcaacctccgcctcccaggttcaaacgattctccctcctcagcctcccgagtggctgggactacaggcgcccgccaccacgcccggctaactttttgtatttttagtagagacagggtttcaccgtgttagccaggatggtctcaatctcctgacctcatgatctgcccacctcagtctcccaaagtgcagggattacaggcgtgagccaccgtgcccagccttttgtttattttttgacgagaccgttcttgctctgtcaccaggctggagtgcactggcacaataatagctcaccacagcctcgtgctcctgggctcaactgaccctcctgcctcagttttagcttcctgagtagctaggactacgggtgtgtaccaccatgcctagctataataatttttatttttttgtagagatggagtcttgctttgttgcccaggctggtcttgaactcctggcttgaagtgatcctcctgcctcggcctcccaaattgccgggattaaaggtgggagatcgcacccagtctccaaccctctttttgcaagtaaatgtaactggaccccagccatgctcatctgcccatgtactgtctgcggctgcttttgctctacagggcagagttaagtggttgcaacagacaccgcacagaccacaaagtctgaagtactttctctccagccctttacagagaaagtctgccaacctctaatctcaataacagggaaatcaatgacaaccacaaagtgacaaagattgggtgtctaagatggatgctcagaataaacaagagagaaagatgaaaagtagaaggaggatttcaaacgcaagcttcacctaatccgttatttttcaaatgaccaggcctatctctgtagctgaaaatcacctcaaataagatctctgatatacagtctccaaaagctcagctaagaaacttacaaagtctctctgccttaacttcatccaccttttttctctccagcttttcctcggtagttaatgattataaaaatatttattggctcatgcctgtaatcccagcactttgagaggccgaggcgggcagatcacgaggtcaggagattgagaccatcctggctaacacggtgaaatcccgtctctactaaaaatacaaaaaattagccaggcgtggtggcgggcgcctgtaatcccagctactcaggaggctgaggcaggagaatggcatgtacccacaaggcggagcttacaatgaggtgagatcccactactgcactccagcctgggcgacagagcaagactccatctcaaaacaaacaaacaaacaaacaaaaaaacagtgtgatggccaggcgcagtgctcatgcctataatccaagcactttgggaggctgaaatggatggatggcttgagcccagtagtttgagacaagcctggcaacatagcgagacctcatctctacaaacatctttaaaatatgccaggcatggtggtgcatgcctgtagtcccagctattcaggaggctgaggtgggaggatcacctgtgcccgggagttcaaggctgcagtgagctatgatcacaccacagtgctccagcctgggcaacaaagcaagactccatctctaaaaataaaataaaattaaaaaaaaagatcttcgctgtaaaagaggtacgctcaaatgcaataaaagcatataagaaggccgggtgtggtggctcatgcctgtaatcccagcactttgggaggccgagacgggcggatcacgaggtcaggagattgagactatcctggctaacgcggtgaaaccccatctcctctaaaagtacaaaaaaattagctgggctaggtggcaggcgcctgtagtcccagctactcaggaggctgaggcaggagaatggcataaacccgggaggcagagcttgcaatgagcctagatcgcaccactgcactccagcctgggtgacagagtgagactccgtctcaaaaaaaaaaaaaaaaagaaaaagaaaagaaaagttcttctgacatttgtgtatgaaatcagccttcactacatggataggaccagcacgcttctgcggcacgactctgcaatcttactacatttttttttactttgtattttatttattccttttgagacagagtctcactctgtcacccaggctgaagtgcagccgagatctcggctcactgcaacctccacctcttgggttcaagcaattctcttgtctcagcctcccaagtagctgggactacaggcacacgtcaaaacgcccggctaatttttgtatttttagtagagatggagttttgccctattggtcaggctggtctcaaactcctgacctcaggtgatcgacctgtcttagcctcccaaagtgctaggattacaggtgtacatttatttatttatttgagatggaatcttgctctgtatttattaatttatttatttgagatggagtcttgctccatcgcccaggctagagtgcagcagtgcaatctcggctcattgcaacctctgccttccaggttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttatttaattatttagagacaaagtcttgctctgtcacccaggctggagtgcagtggcgccatctcagctcactgcagcctccgcctccaaggtttaagcaattctcatgcctcagactcctgagtaactgggactacagaaacttgccaccacgcagggatttttttttctatttttttgtagagacacagtttcaccatgttggccaggctggtctcgaactcctgactttaggtgatctgacagcctcgtcctctcaaagcactgggattacaggcatgagccccttgcccggcctctcactacatttaagtgacgccatggctcatgcctgtaatcctagcactttgggaggccaaggcaggtggatcacctgaggtcaggagttcgacatgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatatcatgccactgcactccagcttgggtgacagagtgagatactgtctcaaaaaaaaagaaaaaaagagagaaaaacatatgatgccggggcatctcggcctcaatacctgggtgagcacagtcatgtccaggccagggctgctggtcgaggtccggccccatctcttccagcagaaagggagtaagcttgcagggcggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgctccctgggccatgccagtggcccggcctcggctgaacacagccccaacactctggaatggggatgagggggcagtcagctcttgctcctagtaagagagatgcaacagggctctgtggctgagctgggtgccttgcctcacacctgtaatcccaacctttgagaggccgaggcaggaggattgctcgagaccgggaattttgagaatagcctggacaacatagccagaccccatgtctacaaaataataataaaacacacagctatagtccaagctacttggcaggctgaggcaggagggtcccttgagtccaggaattggaggctgcattgagctataatcgcaccactgcactccagcttgggtgacaaagtgagaccctgtctctaaaagaaaaaaaaattggcctgtgagcatgggcttgattttcaaacaggacccggagggtagggtaaacgtgtgggtaaatctaaatgaatgttattggtataaaattacagtagtatagaaaatgatatcttgtggggtttaaaagaaataaaacatactgaaatatgtatgggtacagttatatatctgggatttgcactgaaataatgtggggtagagggaagcaggaaagagtatacatgaaatgagcttggccataagattgttgttgaaattgaatggatactcggggcttcattacacaattctctttactcttacatagctctacactctcaacataaataagaataaaaacacaaaaaacacacagatacatctatgcacacacacatatttaaaatacacaaaaatattagcatataagtcactgggggtaaatttagttcctgttccaaggttcttgtactgactaggaagaggatagaagtactaactcataggctgggtgcggtggctcacgcctgtaatcccaacactttaggatgccgaggtaggcagatctcttaaggtccggagttcaagaccagcctggccaacatggtgaaaccctgtctctactgaaaaagaatacaaaaattggccgggcatagtggtgcacacctgtggtcccagctactcaggtgactgaggcaggagaattgcttgaacccaagaagtggaggttgcagtgaaccaagattgctccactgcactccagcctgggcagcagaggaagactctctctatctcaaccacaacaaaaagtactagctcatgttagactttgataagtgaaggatgcatgttgtaagctctaaaataatccagtcatcttttaaaataactctaagactgcacagttatgaaactaatagagaaggaggaaattaaataataaaaataataaatccaaaacaagatgtgagaggagataagaagaaatagaataggcatggaaaacaaattggtggtgggtttcaacccaaataaatcattagttacatttaaaaggacaataaaaattaaaataattgaaaataaagtaaaacccaactaatgccttttatataaggatacagagaggtggaagatcatgaaaaatatgtcatgcatgtactaaccaagaaagctgtataacttttttttttttttttttttttttttttgggagatagagcctcactctgtctcccaggctggagtgcagtgatgtgatcttggcttacagcaatctctcccttctaggctcaagcgattctcccacctcagcatcccaagtagctgggactacaagtgtgccaacttagaattatattagccacacccagctaatttttgtattttttgtagaggcagggtctcgccatgttgcccaggttggtcttgaactcctgggcttcagtgatccacccacctcgacctccagcaaagtgccaagattacagccatgagccaccatgcccagcataactatttttaatgaagtagactttaagaagaaaagtattattagaggtaagagacacatcacagaaaagaagaatttactaggagccaggcgcaatggctcgtgcctgtaattccagcactttgtgaggccaaggcggcggatcacctgaggttgggagttcaagaccagcctgaccaacatggagaagccctgtctctactaaaaatacaaaaattagccaagcatggtggcacatgcctgtaatcccagctactcaggaggctgagggaggagaattgcttggacccaggaagtggaggttgcggtgagctgagactgtgccattgcattccagcctgggcaacaagagcaaaactctgtctcaaaaaaaaaaaaaaaaaaaaaagaagttactagctagtttcggtaattcttaacaaccaggaaactggaatgtgaaagtttttcagagaaactaaaccaatagattatacatagagagagatttatttaggaattggctcacatgattgtggggactagcaagttttaaaatctgtagggcaagccagcaggctataaattcaggtaagagttgatctcgaagtctggaacctaaaatctgtagagcagtcagcaggccagaaactcaggcagggtttgtgtgttacagtcttgaagcagaattcctgcttctctgggaaacctcagtttttgttcttaaggccttcaactgattggaggtggcccacccatattatggtgggtaatctgttttacttaaagtcaattgactgtcagtgttaatcacatctatgaaataacctcccagcaagatattgacaagtattcgaccaaacaacaggacaccatagcttagccaagttgacacataaattaaccatcaggagcaagtagaatatccaaaaaacaacatactaggggtattatatcttatatagctattataattatataaaacatataattatagaatgacgatattaagataaccattagaacaaaaatataaacttttctttccttttttttttttttgagaccaagtcttgctctgtcacccaggctggagtgcagtggtgcaatcttggcttactgcaacctttgcctcctgcgttcaagtgattctcctgtctcagcctcccaagtatctgggattacaggcacctgctaccatgcccagctaatttttgtatttttagtagagacatggtttcaccatgttgcccaggctggtctccaactcctgacctcaagtgagccacccccctcggcctcccaaagtgctgggattacaggtgtgagccaccacacccagccaaaaatcaccttttttacaaggatcaaaacagtcattatgctggagatgacagacctcactgtcaccatgctccttttgtatgtctactaggcacggtgctgggtccacactcacagaaaccttaggaactcgcacccaggggctccggctgtagcagaatcccaagaataaaacctggtgctgaaagagtaggagatgaggccgggtgccatgactcactcctgtaatgccagcactttgggtggccaaggcgggtgaatcaagagatagagaccatcctggccaacacggtgaaaccccgtctctactaaaaatacagaaattagcggggcgtggtggctggcacctgtagtcccagctactcaggaggctgaggcaggagaatcatttgaaccgaggaagcagaggttgcagtaagctgagatcgcgccactgcactccagcctggtgacagagtgagacaccgtcacaaaaaaaaaaaaaaaaaaaaaaaaaagcaggacactgaactctgggagggcctcctggtgagaggtgagcacagaggggagagatggaggcaggagcatgggcttctggtggccccagcagaccctgtggcagcgtggccagggtcctctgcagggaggaatcttggccaggatgacgctgtagcaggcctcttcctgaggcctccagccagcccggccagggtcccagcgtccagtgacccctgtttcacagcagcagctggggccagccccaggctctcttccactcccagcttcttaaaactggaagtggagagagttgtttgataaaacactggggcaaaccacatcctctcttcaccaagggagagttcgaggggatgccggcagagggagctttagagtagagacccctacccaaccagtgaccgtcacgcacacagcagggcatgctatggagacccccagacagtcactcggggagacccagcaggtccagactcttcagagatctgtggcagcaggtccccactcccaaaagccacgtgcccacgggtggtctctggtgcctgagaccccagtctcatttgcatctttgcaacttcgagtttaagtgggtgtcgcatctctgtatgtcctcccgagcagaggaggggcacagcctggggtggcagctgacgtcaaaccctcaaatcccctgagagccactggggagactaagcagtccccagcccccacttgtccctgagctgccattctcagccctgtgggaggagacagaaagccctgaagagaaaccaaaggaccaggtcaggaggggctgggggggtggcatgagcaatcagggcagggaaggatggacagatgggggaatggagggaagaaggaatgaatgaaaaggtgaatgaatgaacaaagagagagaacggccactcctcccttgctttagtttacaaagtactgggatcctcccaacagcctgcaagacagaatttctgggaagcagaccaggtggctggcagggaggggaggcttgccctggcttttgtgggcccaatgggaggcagggggcaagaaggggcatcctgtgtgtgtcctccctgcagcggcagcagcaccttcctggaagagggtcaggaaacacccgctgtggcccctctccaccacgccctcatccaggacaccaagtatcagtcactcagctcacgagacccaggccctgactcagggagagaggatgtgaggggtggggcaccgggctcctcaggactgagagacctgagatgtggccccgggctgggtgtaggggcagactggctatggcagcattgtgtgtaccccagcaggccagtacccacgcagggagcctccaaaccccttcacccatgaccctgggagaagaccgcagccttggagaattggcctcactgaaggggcctgcaccggccagcagggtcaggcggggccagacaggttcccacctgggatatgcaaatgggcctcctgaatcctggagccaggtatggactcacacaccaccattgtccccaagtccccatctgccccacgggcacaccctgccgcctgttctgtgcaagggccctgaggctgtctccttgcgctcaagccctgcaggtgctgaagcccacacacacggctcctgcttactgggccagtgcacgtgcacacacacacacgtgcacacacacacacacccacaaatatacccacacacaatcacacacattcacacatacccaccccccatactcacactcacacatttacacacacccacacacccacactcacacactcacagtcacacacaccctcacacagcgaaacacaatcacacacattcacacccacccacacccccacacactcacactcacatatactcacacacacccacacacacatacacaaacacaatcacacacattcacacacacccacactcacacatacacacacccaaacacgatcacacacattcacacacacccacaccccacaaacacactcacacatatacccacacacactcacacataatctctcacacacacacatgctcacacacacacgccttctccaggaggggctggctgccaaaggccacccagcttcctcccacgtctcactcaccgtacaatatttgagaagaccttggagtcagcagcaacagcggtgtgggcaaaggccgggggtcaaatggggcctggtgtcgagagaggaccacagccagcacaatgacagccagcgccagccccagccccagccccagcaggaccaggtcacccatggctccgtagtcctgggccatggctctgcggcccagaaggagaggggaggccggtgggcagatggagggacagatgggtgggcagatgaatggacaagaagatgcatagatagactcacaggtaattggacagatggacaaacaggtgggggctgaagacagacacgaagatggatcgacagacaggccagatagctagacaaagaggacagtaagagaaagatggtcagatagacaatgggacagagatgggcttacagatgggcggacagacagacaggtctgaacagcgggctgccagatggacagatgggtgaatggacagatggctggcagctgtggcgagctgctgccctcaccaagtgcacactacggagtggccaaactcatgcctcaacttctagttttcagctcctgcttgttcctggcaggaggccaggcagcaaagcgtctgaggggagttttctttgcctagagaagtcagctgctgtgttaactccctcactgctggtaggtccaaaggcccgacctaccgcccaccagagcccatggtcacactgtcgcaatgtgcaggagaacttggtgcgtgctgcactgcggttgccaggtaggggcagggctccctggaacctccacaccattccccaggttctcagcagctctgggaaagcagagctggggccgcttaactctgccctggatccggcaaggctgcccccctcccagagtggagccctgctccccagctcccatctctatcccctaaccctctccgcatggcccagcctagtcagcatcaaggtggagctgaacagaggcagaaggaggaggacccaaggtggtgtcactcaggacccgggttcaagtccttatgcttctgcagcctggcctgggtcccccaactcccccagggtgaccaagggcttcccagtctgcacagaggacagggggtcttgacagcatcaaatgctagtgactacgagacacttacgtgggaaatgcagacagaccatgcctctagcccttggcaccaggcaccatccatccctgggacttgctgtcctggaaatgcagcatggtcctccagggaggggggctgtgccatgtgggggccccaccccacctgcagctctttcccaccctggctgcaggtctgcttccctgaatccaaatccgctactactgtgctggcagcgcagcctctctggggacactggcctggctctgttctccccaggcctcagggtgcctaaatgggaggcaaccaggggagtgaggacccactgaggggctccgttgaccaggctcagcaggggtgcaggtgatgtggggtggaatccttcccacatggcccccacagtcctccccgcttcctccccaactgaacactgcctgctccagatgtctacacctggagtctgggcccctccatctgggcagcagagaaactgaggcacagagacagactgtgtccttacagggcacacagcctgccaggcccctatgtccggccagagcccctggccagcctgggctgcagtgattgtttagaggtaggctgttcccacggctgcctctcacggtaggggggcctgcggacgcctcctcccgcccccacccgactcccaagcctcagtgacattgctcaaccaggagctgaagtgcattcctgggctcaggccagcccacccaccgacccgctgcagtcctggaagcccagaggcctgggcagcaggaacagtggagacagcagtgtgggggacgtccccctcctctccccaccatcctcgtcaggcagaggccagggtgcagggaccgcccgagcaaaggcccagggaaatgaatgggtgtcattctggtcctgacccgaggcacagccaggaaggtccctgtggggaaaagaaagagatatcagactgttactgtgtctatgtagaaagaagtagacgtaagaggctccattttgttgtgtagtaagaaaaattcttttgccttgagatgccgttaatctgtaaccctagccccaaccctgtgctcacagaaacatgtactgtgtcgactcaaggtttaatggattcagggctgtgcaggatgtgctttgttaaacaaatgcttgaaggcagcatgcttgttaagagtcatcaccactccctaatctcaagtaagcagggacacaaaacactgcagaaggccgcagggacctctgcctaggaaagccaggtattgtccaaggtttctccccaggtgacagtctgaaatatggcctcgtgggaagggaaagacctgaccgtcccccagcccgacacctgtaaagggtctgtgctgaggaggattagtaaaagaggaaggcctctttgcagttgagataagaggaaggcatctctctcctgatcgtccctgggcaaaggaatgtctcagtgttgattgtatattccatctgctgagataggagaaaactgccttagggctggaggtgggacatgctggtggcaatactgctctttaatgcattgagatgtttatgtatatgcacatcaaagcacagcacctttttcttaaccttgtttatgacacagagacatttgttcacgtgttttcctgctgaccctctccccactattaccctattgtcctgccacatccccctctctgagatggtagagataatgatcaataaatactagggaactcagagactggtgccagcgtggggcctccatatgctgagtgcaggtcccctgggcccacttttctttctctatactttggctctgtggctctttcttttctcagtctcttgtcccagctgatgagaaacacccacaggtgtggaggggcaggccaccccttcaggtccctgaatgtccttcctcaggaaatgatgggggaaggggcgatgagaatgaaggagacgatttaagtccctcaccccccgaggtagtcctgggctgagccccatgggacctagagaaccagggtgtaccccaccagcatgtcgggtccaggaagcctcgtggccagctcccacttctcttcctgctgtgcaacccagagcaaggcctgcccctccagcttcagtcttctcccctgcaaatggggccacggcctttcctctcaggccaatataaggattgaggccgggtgcagtggctacccctgtaatcctagcactttgggagactgagatggggggactgcttgaagtcaggagttaagaccagcctggtcaacatagtgagaccccatctctattggtttaaatttttttaaaaaaaattaaataaataaaataaggattgaagagtgacttgtacaccagttgagcccacctccatctcacccttgcagagccccagagacacagccctccagagctcagacccagtgggacttgactccacaggcataaaaccctgtttgtctatgggccctttggaatcaccaggttttcggggctcctgaaggatagccccgacctggcctcacctggcccctggccccagtgcccctggtgatatccaggtgctgggctgtgatcaccgcctcccaccagcccacctccaccagcccttcccagaaccctgctccaggtgttggaactgtgcacagaggagggagcaggccccgagggaggcctggaggggctgccaatggtgaaggctgctgtgtcgagctgtttccttccggacccactccctctgggctgcgtccccggctggtccaagccctgatccctgggatctggggacatcttcccgtttgctgttccctgagaaccaggcctccctctggagaggatcacaagcttgggtttcactctgggcttgctcttgggaaccccccaggggcatggctctgaccgagatgttttcctccagcctgttgcccagtccccattcctcggaccctcagcttcacctccagtgtcatcggcagggtgagctggacgcctacgggtctgagaaggcgcccgggttcccagcatcggctggccaccctctgcctaagaaagcgccagggtcgtgacaccccctggtggctgatcctaggtagtgtcactgcccagccccagtaagggagggcctggccccaaagtctgagggatcagggtgggaaggggcagggtttggtgtgaaccttcccctggcccccagccatgtgccttgctctccccatgctgaagatgctgaggctagttccagtgcccgcattgtgaagatctccgaatcccacctctctgttcctccccagccagatggctccatttcacacacaatacactgaggcccagagagtggggagacaggccagggaggccacctggagcctggcacagtggcctcatttattatgctgctctgctgctcacaggggaagcccgtcccccaaagtcctcttcctcatcctggtgagtatcttgtccctggattgcttgtcagccttgtctgcctggagcactcagtagccagcaggttccccgcctttcctggagtccgaggcagctgcccagccaccagccgtgcggacgatggcttgcaccacagcgatgaaggtggacgcgatctgggtgtgatggtgccgggtctccagggctgcagtcactgcctgggggtgggaggagaggggaagcctgagcagggctccagatgccacctgaaccacacctgtgtggtcacaggcctcagcccaggtggtgccatttcaggccaggtcatcaggaagagcaggttggggcctgctgggtctcactggagcagggggcttggccctcatgtcacaggggctccagatggcccaggcactagagagaggacaccaaccattgtccactctgtgatgatccaggcctccagcccaggatgccctgggaccccacaccgtgactcagtttctccaacccccggcccacctggtcaatgtttctctccactgtcgtgacgttgggcagaagcttgttgtgcagccggggctcctccacggccctcttcacgtcatagccgaaccagaggttgtagatgatggcctggggcatgggagtgtgatcagcgtggcttgggggctgtgcagagtgggcagggccagggagaaaaggggtgacacataccagtgcagtgtctgtggtgatctgcgtgcccccagcagctcccaccaccatccggacctggccgtcctggcccaccatgatcgtcgggcacatggacaagagcggctgcttccctgcggccgatgggagaagacagggatgcccgtcagctgcctgcccaggacacccgcccctctccaccccagtcccccaccccccggacctccaccccatacctggctggatgaaattggcaggtgaggggggtgccccaaactcattggtgatgctgggagagctgaagtcgtccattcattattgaacaggatcccactgaccggggagcagaccttggagccaaagctaccgcccagccaggtcagacagcacccgaccttgcctggcccagcctggtccctatccacccactgaggctcaaacatactcactgagaggcccaggataagctaccaaggttgggcctcagtttcccaccaggaaaagaggtgatggagccaccttactggataagtgggcagtccctgggccacccgcccctggccctttcccacccaggcggcccagcagcccctactagaggttgatggtgctggtggcggacacagcactgccgtcctctgcgacgacagacaggtgagcagtgcccccgtcatccggcgtgtagaactcgggcttgtagtaggagatcgggtgagtggtgtggtcagagatctgggaccggagctgggcagcgaagaactcagaggtcatgttgcggaccacctgctgagaccccagagctggcctgaggaggtggggagggggcacaggtctcagaaggcccttgactgtgactctgaccgcaaccctctggcacccacaaccttccgtggctccccaggacccaagggcaggcccaggaccttgcatgaccagtctgactccctgtctctgtcgcgttccagcaactctgaatgtctgtctgcctggtcctcagcctccagacccttgccacattcaatcactcattctttcatgcaaaaaatatttctagaatttgcactgcatgcctggcactggggaatcaacagggaacagacacttaagtcctgccctcatgccaagaaaaacaaacacacacagggaaagtgctgaaaccacaggccaggtaaggggaatcaagaggcatgaggtatgggcagagtggtcagggagggcttctcagaggaggcaacgtgtgaaaagagcctggaaagtggcctaaatggtcagtgcaaaggccctgaggcaggtggcataggctggtgagcgataggcagagagtgaatggagtagggtggggagaagaggatgaagatgcaggctggggcccatcccacaggacctcctaggtcccataacaactggcttttgctctgtgccatgcaggcttagggcagaggaatgaggaggctggggagtgttttcacagggtccctctggcagctatgacggggataaggataaagcccaaaggggaggctgtgggtatcaaccaggcaagagatgatggcctgggtgggagaaagagaagaatcaagcatggtgccgactagcgaggccggcagaaggggccggtttggggatggtcaggagcttgattttggatacttcatcagacccaaagagcatgggtgcacgtataaaaaaaataaataaataagcatgggttcacgggcaagggcgggctgagagatgaacatggaggtattgacattgagtggctgctggatgccatgagcctggccaaggtccccaaggcagtggcgaggaggagatgaggaggtcaaagaggagacagagaggatggacccgaaggccgaagaaaatgcctcaagagagtttcaacaccgggcgcggtggctcacgcctgtaatcccagcactttgggaggccgaggcctgtaatcccagcactttgggagggcggatcatgacgtcaggagatcgagaccatcctggctaacacagtgaaaccccgtctctactaaaaatacaaaaaattagctgggcgcggtggtgggcacctgtagtcccagctacttggggggctgaggcaggagaatggcgtgaacctgggaggcagagcttgcagtgagccgagatcccgccactgcactccagcctgggggacagcctgggggacagagcgagactccgtctcaaaaataaaataaaataaaataaagtttcagcaacaccccacggattagctgaccaatcccagggaaaggtgttctgtctgaatctgccctcaaggaaacagaaaggcaaatccacgatgtgggacattttccaagactactgccctgggctttaaaaatcaacaaaacaggccaggcacggtggctcatgcctgtaatcccagcactttgggaggccgaggcaggcggatcacgaggtcaggagatcgcgatcacggtgaaaccccgtctctactaaaaatacaaaaaattagctgggcgcagtgtcgggcgcctgtagtcccagctactcgggaggctgaggcaggagaatggcgtgaacccaggaggcagagcttgcagtgagccgagatagcaccactgcactccagcctgggcaacagagcgagactccgtctcaaagaaaaaacacacctgtaatcccagcgctttgggaggctgaggtgggaagacagtttgatcccaggagtttgagaccagtctgggcaagaccctgtctctaaaaaaaatacaaaaattatccaggtttggtggcacctgcctctggtcccagctgctcagggggctgaagtgggaggattgcttgagccctggaggttgaggctgcagtgagccaagatcacaccactgcactccaacctggatgacagagactctgtgtacaaacaaaaacacaacaaaaacaaaacagccaagggagcctactgtaggtaaagagaagggacagcaggttgtgtcaccccgacatcctgctgtgctatgttcaagtctcacttttgagacacaccctgaggtgcgacatcagtaacctactgtggaatccctcagaaaaacacgaatcccaatagatgtgggtggagacggagagagttaggaaatccggcagaaatgtccacactgcagaatccaggaaaagggaacattgatgcttgggcagttttgggttttttttacatttttgtaggtgcgaaaatttgcaaaatgaaaactcgaggagagtgtggtgagctgtgtgagatgctgctgagtggggcctgatggggaaactgaggctggacatggcgatctggtggcatggggatagagcaggggaggggataccctgaagggagagaggacatagcccagccatgtttgctctaagaggagcaaaggacagaaggaggcagcagatagaagtttctagagcaacaacagctgccttttttttgggaataatccgtgataaagaaataaatcatcagaggcagacaggagcattgtaggaacagcaccccgagccagcgagtagatgaaggagctggccttagccaaaaaggagggcagagggacacgctgcagtggctctgtcccctcagagagacaagacaccaggtcactggctgcagcgggagtcagaggtgcagaatgctcacagggaaagagaagacaccacccgggcagctgacgcccctcctgggaggtcactggtcagtgtgggggggtctgcagatccgcccaggaatgccaaggacccaagtaggtaaggagggatgtgaggatcctcagcgggaagggatatgacagggtcttatagggacccagcatggagctggggcaactactgggtgagtgggtcaggtggtgcagggctgagggtggcatctgggaagcgttagtttggagtgacagggagtgggtggccgaggtctctgttcacctggccctctccctttcacccatccatctcaccatgcccgagggctgcaatgcccccatgcattcctcatctcagcactgagcactcaagaaccacagcatgtgcaaaggacctgaggtaggagggtggccactaattccccacactgtcagttctgtggggcagaagccaagactgggggtcacccacaagtccatccgagcacacagtaggcccgcaatcaaattctgtggcaggaatggattcataaagcatatgtgaggctgtagccaccctggggagcccacctgatgcctctacggcaggccccacacccacagtgggccagcccctgccccttacctcagtcacatccacaaacttggggtccccaagcagggtcctcttggcgtaggcaaaccggaaagcctctacgatgcggtggtacgtcaggcccttctgctcgggggtctccacgctctcccgggagaagttgtaccctggttgatcagagccaggtgcatgttgctgagccccagaggctctgaggggctcagagggttaacacctgcctgagccactttgcccacctcaaggagcgtttaataatcaatagcagcagctgcttcagaaggctgtggtgagagtgaagtaaggtgagggctcccgagcctggacctcacgtcacgcatcagctctggccattcaatgaccaagtggcagggtcacccactggactggggtaccctctggaccggccctgcagccctgagctcctgcacctctctccctcctgatgactcctgttcctcctccaacccttgagcattgcccgcttcagccctgttgctctgcactgcctccttcaggacatggtgagctgtgacgcagggacacacctcaggagctcagtgatggaaagacgtggcatggggggcgagcagagatgcaggaggggtggggcgtggggagagagaggcagtgtcatgggtcctaccacacggctgtggtgcgaccactcacctttgaggatgttgaggatgagggccagcacgggcccgctgagccgcgcactgggcatgtacagcaccgcgtctcccaggctgatgttcagcgggtgctcgatcagctcagcacagtagttgttcaggtcctcagctgtcacaatgccccctgcaatgggacagcagctcgaatgggcgctgggatggggctgcaccactgcgtggaggatggagctgcaccagtggtgttgggggcaggcatggctgcaccatggtggtggggaaaagcctgtacctaccagggaggacagagtgcactactggaggggtgggactgtgccctgggagggggccacaggcaacctcacctccttgggaacctcaccagctccggcactcctgtctccctgacactgctcaccacccgacagctgggctggggccacctgccctctgcctgcttggcttactggcttcctgtctgccttctctcatctgtggccagagagtgttttcttttttctttttttttttagagatacgatcttgctctgttacccaggctggagtgcagtggcttaatcacagccttgaacccctgggctcaagtgatcctccagcagaccctccccagtagctgagactaaaggcacaactacacccagcaaattttaatttttttgttgtgttttgctatatttctttctttcttttttttttttttttgtgagacggagtctcgctctatcgcccaggctggagtgcagtggcgcgatatcggctcactgcaagctccgcctcccaggttcacgccattctcctgcctcagcctcccaagtagctgggactgcaggcacccgccaccacatgtggctaatttttctgtatttttagtagagacaggtttcactgtgttagccaggatggtctcgatctcctgaccccgtgatccacacgcctcggcctctcaaagtgctgagattacaggcgtgaggcaccatgcccggccgggttttgctatatttcttttcactatgctttgaattttttgttttcttgttccccacccccacccccactatatttatgtagattctcaatattttttttgtagactcactatgttgcccaggcttgtcttggacctcctgacctcaacttctacctcaggctcccaaagtgttgggattacaggcatgagacaccaagcttggcctcagagggccttttctctcttttttttttttgagatggagtctcactctgtggagtgcagtggtgcaatctcggctcactgcaacctcagccccacaggttctagcgattctcctgccacagcctcccaagtagctgggattacaggcacaacccaccatgcctgactaattttgcatttttagtagagacagggtttcaccatgttggccaggctggtcttgaactcctgacctcaggtgatccacccgcctcggcctcccaaagtgctgggattacagacgtgagccaccgcacctggctcagagggccttttctaactggagaattcctgccggtgtccctgctgcttggcctcttctcctcacgatgaatggatagagggagggagggaggctcttaattctcctggagtcagctccagacagggtattggcatgccaatttccagcctcagtggtaaaggtcgacacgctaatcaccctcctccatgaaacagtgacaaaaattacctgaagaaagccacagccaagctccaggcccctgccccacaaatccccttccccatgcctctctcaaggcgaccctcatcccttgtaaccctcttggtgaatcaaagcgccctctactgggccttagcccagctgttcctctgctaggaatcccttcctctctctgcctaacgaagttatctgcagcccagccgccacctcctccaagaagtcctcctggatcttcaggctgtattctagtgcttccctagccctggctcttgcctacacctgcatttaccccaacagggacttgctctcctggactgtgtggcctctcttggttttgatataagcaggagctgtggacccacatggccagtcactgaccctcctccaccaggaacttcctgcaggctcaggcaagacaggaggaccccatggctctgggctacagctcagggtttccactgcagagttcctcacccaggtccttgaggttacccactcaccagccgcctggatgtccttcacaatctgggccatgaggctgccgttgtagaaggcctgggcaccctcgatggccagcatctcgtaggtgtcagccagccgcggcagggtcagtctctccccctcccgaagcacctttctatcccggcagaacacctcactggggcagagggggctcatgtgaggcagcaggtggggtggactcagctagaccaccccccacacctgcccacacaggagaacggagcagaacaggggcagcgcctgtcacaggtgggtggccctgtcactcagcgctcgtcctcctagtgtcccttccgggagcctcctagtgtcccttgccactcaggacacgtggccagccacagtggccactgggaccccacgctcagaatgtgtccccacacgtggtgggaagggtctgtatctcctcatcccattatcagcacagggtcctgaaggcagagggccgctccactgctgctacggcctgcaaggtccttgggctgtgcctgccctgcctgtgtcagggggccgcacccacagacataccacaagacaggctgctgctcgatgacggtccgcttgttttccaggactgccgccaagcccttgcccacggggaagccctggcgggccagctggatgctgggctggaagaggcgagcccagggcagccgcccatgccgctggtgtgccagctcatagcctcggatctccccaggcaccgccaccgacagccctcctggggagagagagccacagttagtgaccctgagtgggggacatcgggatctctcgcaggcagcatcccaggcacagtccctgactcgctttacagatggggcaatgaggcttaggaggaaagatttttttttcttttttgagttggggtcttgccatcttgcccagcccaatctcgaactcctggattcaagcaatcctcccacctcagcctcctgagtcgctgagattacaggtgtgaacagcacacctagcagaaggggatttttaatttttaaatttattttttaattttaattgtttttttttaggaggggatgtttaatttttttttttaggaggggctcagcaggtaggagtgtacatggaccagggatgtctgaggagggcacagcaggggaagcagtagcatgcggctgggttttgctgtcccaggatgaggtgtctgtctgtgcaggtgcctgcatgtctaaaatcctgtgccaggccagaccccctcccatctcgctgaccacaaggccttatcctgtaagactcatgggctccaccagaatgtgccaaaacaagagcagatcccaccttgaccgaggtcaagcacaggccaccttcaagacacagccagccccaagaaagggctccctgcctcttttctactgccccagagaggcaagactgagccttaatctccgtcctgtcccctctcccagcctcagtttctgcatccaactataagggtttttgtttgtttgtctgttttgagaccagggtctcattctgttgtcccagctggagtgcagtggtgcaatcatggctcactgcagccttggcttcccaggctcaagcgatcctcccacctcagcctctgaagtacctaagactacagacataccccactgcacgtggcttttttttttttttttttctgagatggagtttcactcttgttgcccaggctggagtgcaatggcacaatcttggctcactccaacctccacctcccgagttcaagtaattctcctgcctcagcctcccaagtagctgggattacaggcatgtaccaccacgccttgctaatttttgtatttttagtagagacggggtttcaccaggttggtcaggctggtcttgaactcctaacatcaggtgatccatcctcctcagcctctcagagttctgggattacaggcgtgagccaccactcccagcctaattttttatttttattttttgtagagacaggggtcttgctacgttgccaagactggtctcaaactctggcctcaagcaatcctcccacctcagcctcccaacatgctgggattacaggtgcactcagcctataaggggttttgccttccagttctgacttttgaggaggtcattggaaacagacccctgggcctgcttccccccgagccccactgcccatatggacactacagacactgaccctttgcccagaaaggtacaactatggcctctgcccccagggactctcctgctcttgcgagagatgatggggccatttgccttggcttggcggctgtggctctagaactgcctctcccaccctgaagcctggcacaagtttccaagagctggtggtttcaattcctagaagctgcacatatatcccggaaggtctgacacccagcatatgattccttccaccttgtagttagacagaagttcttttttgttttgttttttttttctttgtttgtttttgagatggagtcttgctctgtctcccagactgcagtgcagtggcatgatctcagctcactataacctccgcctcccaggttcaagcgattctcctgcctcagcctcccgagtagctgggattacaggcacaggccagcacgccaggctaatttttgtatttttagtacagatggggttttgccatgttggccaggctgttttcagactcctgacctcaggtcatccacccacctcagccttccaaggtgctgggatgacaggcgtgagccaccgtgcccagccaagacaggagaagttctaatctttgatagcagaccagggtgacgatgcttagcaacagtattttgtatatttcaaagtaacgaagagagcactatggtgctaacacccagaaatgaaaaatattcaaggtgacggagactccaaataccctgccttgatcattatacactctatgcatggaacaagcactcacatgtacccataaatatagaaaatatcatgtatcaatatcagaaaaaaatctcctcctgacctcagcccaatcaggctctcatgccaccacacttgccaagttctctggtgacccccacactgccagacccagtgccccctctcagctttactgggctcatcactctccctgagagccgcccctgcatcccagcacctggctccacccgagtctcccccgcctgccatcctagctcctactctcccctctgtctttgctctctctcctggtggtctgcttgacatctgagcttcagcctccatttatgcactgacaactctcaaattgacctgctggcctggactgctcctccgatcaccagacctgaggatctacctgcctgcttgaagaaagcatctcaaacttcaacgtgcccaaaaccgagctcctgagtgtctgctcaacctgcttcctgagaaccctgcctgtctccattagggtcaccccatccttccaggtacagacaaaagatcaggggtccccggggactccctacacaagcgtcacacccaacccatcctcaaatccacaggctccacttccaagtgtgtctgtgcagcgtcagccacttcccagcaccctctccacgaattactgcagtgacctccggacaggtccccacatgctccctgccccttacacagcaatccaaggggtccatagaccagatccatccccttccagtcacacactccacgagcccccacttccctcagacaggaagcagaggcttcaccataacctaagagatcccgcacaacctgggccattccccttggatcacttgctgcagcctccccagctccccacagggctctgtccctgccatcacacctggatagcagaccaggagataactcccctgaccccatctctgcctctgggtctttgctcagatgtccccttccctgactaggtcaccctccatagagtcccagattttgaggccctccaggtctgtttttctacagcccgtaacacacccgcacttgcctagtttctcctcccacctggagtgtcacagatttcatctgccgtctttgtttttcaccccagcttcaggaacaacagctgattctttaagacaatgctcaatacattctagtcaaataaatggttttaagcgtccacaaggtgccaagcctatgattcccgcattctcttaccctcagcaacttcatgtctacagatgctgagtttctcagtgagtattaaaaacaaatgaaagattggtcgggcacagtggctcacgcctgtaattccagcactttgggaggctgaggcagggggatcacgaggtcaggagatcgagggaccagcctgggcaacacagtgaaaacccgtctctactaaaaaatacaaaaaattagccgggtgtggtggcgggcgcctgtagtcccagctactcgggaggctgaggcaggagaatggcgtgaactcaggaggcggaacttgcagtgagctgagatcgcaccactgcactccaacctgggcgacagagtgagactccgtctcaaaaaaaaaaaaagaaaaaaaaaatcaaagattgagtatgttgcagaagactccaaagggcaccacccaggacccccacctgaagtctaagacctgctatggtgagtgtgtcctgcccctccatcctccaactttttttttttttttttttttttgagacggagcttcgttcttgttgcccaggctggagtgcagtggcatgatctcggctcacagcaatctctacctcgtgggttcaagcgattctcctgccttagcctcctgagtagctgggatattacaggcctgtgccaccacgcccgactaattattgtacttttagtagagaaagggtttcactatgttggccaggctggtcttggactcctgacctaggtgatccatctgcctcagcctcccaaagtgctgggattacaggcgtgagcctgtgaaaaaaaggcccagcctttttttttttttttttttgacagggtctcactttgttgcccaagctagagtgtagtggtataatcatggctgactgcagcctcaacctcctgggctcaagtgatcctcccaccttagcctcccgagtaactgggaccataagcacacaccgccatacctagctaatttttttttccattttttgtagagatggagtcttgctatgttgtccaggcaggtctcctgggctcatgcgctcctcctgacttggcctcctaaagtgctaggattagaggtgtgagttgttgagaccctcccatcctccaacttttatctcacactctattgtgcctcctttggggacagacagtggcttcctggatggacagtggcttcccctcaggtacctggggaatttgggggcctcctccccacttaagaccagattagaaaagagagactccacctcacattctagagcgccatccccacaaatgaacaaatgagtgaatgggatgcctgttgaaaaggcaggatatagacagcctgggttcaattttagcttcaccacctcccagctgtgtgacctcagctgatttgcatgacctgtctgagcctcagcatccccaccctgtaaaatgggaatccacacagcatccccttgcccaaaggagcagggagggttgtgagaggctcgtgggtgaaaagcacagagcagagcatgggccccagtgagccctgatccatgaggtctgctagcataataattattctttccatgtgctgcacagagtggccccggaggccttagcagaaataacagaagctcccggccctttaccatggtgatgatggtcctgaccactcactgtgggagggtgctatggggacaggaagggatggggggtgctagaactgcccctgaaccctgacgggagcaggctcctgtgggcaaggccccttcccggtggctcagccagctctgcacccacgccccaagtctgccgcatggcttacccttctgggactgctccgagctgttgaacatgctggcaaaggccagcctgggggccacctcgcgggcattgatgacctcagcttttcctagaagaagcaggtaggcaggcccacccaccaaaaccctttatgccacgtgagcctgggggccacccagctgtgcctcggcccaacccacaccccctgcccctctccctctccgcttccgaggcactcatgagtggtgctgttgtagatggtgaggaagaggccaaccccgatgcccatgctgtgggcattcatgagccccacacacaacagggctgcaatggctgcatccactgcagagccaccgtcccgcagtgtgtccctgccatgtggcacataaaggcatgagaacctgcaggcttccaccctggccccgcatacacaccctgctgcccacctgcccaaaggaggatggaagagaagtccattcgagttttggggtttttgtttttagtttctttctcttttttttgagatggagtcttgctctattgccaggctggagtgcagtggcacgatctcagctcactgcaacctctgcctcccgggttcaagccattctcctgcctcagcctcctgagtagctgggactacaggtgcatgccaccacgcccagctaatttttgtatttttagtagagacggggtttcaccatgttggccaggatggtctctatctcttgacttcatgatccacctgccttggcctctttttttttttttttttttttttggagacaaagtctctctttgttgctcaggctggagtgcagtggtgtgatcttggatcactgcagcctcagtctcctgggctcaattgaccctcccatctcagcctcccaagtagctgggactatgggcacatgccaccatgcccagccaattttgtttgtttgtgtattttgtagagatggggtttcatcatgttgcccaggctggtcaagaactcctgtgctcaagtaatccacccaccttggcctcccaaagtgctggtattacaggcatgagccactgtgcccagcctttgttttatgagacagggtctcactttgtcacccaggatgaagtgcagtggcacagtcttggctcaatgcagctttgacctcctgggctcaagcaatcctcccacttcagtctcctgagtagctgggactacaggtaagaaccaccacaccgggcaattttttgtctttttcgtagagatagggtctttctatgttgcccaggctggtctcaaactcatggtctaaagcaatcctatcgcctcaacctcccaaagtgctgggattacagtttcttctttttcttttcttttttctttttttttttttctgagacagagtttcactcagttgcccaggctggagtgcagtggcatgatcttagctcactgcaacctctgcctcctgggttcaagcgattctcctgcctcagcctcctgagtagctgggattacaggcgcacaccaccatgcccggctaactttttatatttttagtagggacagagtgcaccatgttggccaggctggtctcgaactcctgacctcagtggtctgcccgcctcaaccccccaaagtgctgggattacaggtgtggaccaccttgcccagacagtttcctctttattaagcaaacaaatgtacatgacttttataattgggacaaaaagggaaattgctatactttattaataacattttttttttccctgctagagatggtggcttacacctgtaatctcagcactttgggaggccaaggtggaggatcacttgaggccaggagttcaagaccagcctgggcaatagagtgagaccatctctacaaaacagtcttttttaattagtcaggtatgatgcacgcctgtagtcctagctactcagggggctgaggtgagaggatcgcttaagcccaagagttcaaggctgcagtgagctatgatcatgccactgcactccagcctgggtgacagaacaagaccctgtctcaaaatatgaaaaacataatattttttctgtttaagtctttaggagggaacttatctttatatataacatgagataagagtctaaaatagaataacacagtagaagccaggcaccatggctcacacctgtaatcccagcactttaggaagctgaggcgggaggatcacttaaacccaagagtttgaggctgcagtgggctatgatcgctcccctatactccagcctgggtgacagagtaagactccaccttaaaaaaagaataagcccttcatgtccctgtttgggcaacagcgttccttggggggaggggggaggggggagggatggcattgggagatatacctaatgctaaatgacgagttggtgggtgcagcacaccaacatggcacatgtgtacatatgtaacaaacctgcacattgtgcacatgtaccctaaaacttaaagtataataataaaataaaataaaaaaaagaaagaaagaaattgtctcctaaccaaaaaaaaaaaaagaaaagaaaagaaaagaataagccgggcgtggtggctcatacctgtaatcccaacactttgggaggcccaggtgggtggattacctgaggtcaggagttcgagaccagcctgaccaacatggtgaaaccccatctctactaaaaacaccataattaggccaggcgcagtggctcacacctgtaatcccagcactttgagaggcagaggtgggaggatcacaaggtcaggagttcaagaccagcctggccaacatagcaaaaccctgtctctactaaaaatacaaaaattagctgggcatggtggcacatgcctgtagtctcagctactgtggaggctgaggcaggagaatcacttgaacctgggaggtggaggctgcagtaagccaagattgcaccactgccctccagcctgggtaacagagcgatactctgtctcagaaaacacacacacacacacacacacacacacatatacacacacacaaatttgttgggcgtggtggcgcactcctataatcccagctacttgggaggcttaggcatgagaatcgctttaacttgggaggcggaggttgcagttaactgagattgcaccactgcactccagcctggcaacagagcaaaactccatctctaaatagatatagatagatagatagatagatagatagatagatagatagatagataatagatagatagatagatagatagatagatagatagatagataggaagaaataagtaaaaataacaaccaaacaacaaaacagtggagtttatccaaagaaacagagactcttagaactgagaaaaggggccctgtttggctctagagacccacaccctgctctcggagtcaccgtccccttcccaaaggctactgagagagtccaagcgaagcttacatgtggggaaactgagtctcagaggggtgaaggtattgctcaggtccacttgcccagttttcagggcccatgtcccatgccctgccccgctcacctcccaatctccaagcactgcttggcatccgcggccacggcagccctggtgtacacatggttgtcaggttccttggaggccgagggcagccagagacagaggccgacaatgaccagcaccaggaccacggccagcaggcccagcaccactaacttcttcttcatggctctgctgcacccacggggtaaggagcagggtcaggcccagcctcagacatgccctggcccctccccaacagggcacagtctaaagtcaggcctcagaaacacaaggcctgtgtctccttcccgcttcccagaatacgtgcaggctgtccggcccccagacctttgcgcaggccatgccctctgccagaagctctgggcctcatctctgccctcccaaatcctccctgcttatcttcagagcccatcctggtaagaaccccatctccagcagcggcccttcctgggagcccccagatttccacacccctctttctgcagggcctggcctacctcctcacagtggctgagcctccactgcttagggagaagctccagcagggatgggcctggcctggtttctcctgtgtcccccaccccagcctagagcctggcactgtccaggagtcctctgaagaccctccaccccacctggagcatggggtttagcttccatagtgcccacaatcagagcgccccacagattcactgccacggggccaggacttaccgtccagcagcagacgggggccccaagccttgcctggggtgttggccacgaaagacaggaggatttggtggaaacagctgaggaaataaccggggtctccctcacactctgctgaagcctgtagccacagaatcttcttcagagactctctgatcaggcagccttctcgttctcctgaaggtcaagggaggttacctgaagcacgcacagcccagacctttctgggggactccgtgttacctccctctgcctctagctggtttctctgtctccagttgaactctggaggcaaagaggctgtcagtaacacatttgtttccatgaattctctcagcatgtctcccaggcacagggttttgcacggagcagggcaggtaggggacagggcattcctgcacaagcccaggatgtgcatgcggtaagcatggcaaagggggctcagggggcaccgccagcctgccctgctctgacgctggacttgccactcacctgctgtggggcctcaggcaaatcactgaactgtccagcctggatgacggcagcacctcacttgccttgctgctgggagtgttgtgaatagagtaggttagactgtgggcagggcttggtgaatggtagctgtgattatcatcatggctgcactggggacacccccaggaggcctgagtggcacaggtctcttgctcactgtatgtcccctgtggactcccttccaggctgtgcagtgagtggcagcagtgacccttgggaagtctcatggctacggcagcaggtgacaggtgtgacaacagggaagagggatgtggtgacagaggttggggttcccctctcccacagtcagtttcccacaaagggcggtgtctgccagcaagcccctccaatgagccccaagcttggtttccctccactccacgctgtcccagtgcagagcgtctgacctcagaggcagacacactgtcccagaggtggtctatgaatggagtccccgtgccctccccacacacagggaacatccaaatgccatcatggaagggtggccacctccccaggcttggtgggcctggggccgatagtgtgatacatttgaccccctcccagccctggatgcagacaccaagagcagagagacctggcagtagtcatgcagcagcgcaccaccccacatcctcagcacaatccaaagcagcccctcatccccaccgtgaccaccacagcctgaatccaggcgccacctgtttctgacctgaactccctcacagcccccgcctgcactccctccctccaacatcacctgcccttcagtcttccagaaagcagctagagggctctgtctgtccaactgcagaacaggccctgcctcctccctgccccgttggacagctcacacccttcaccaggcctgacagcgctcttgccactccaacaccctgggtcccagctgggagtccgggtcagggttaagggttcctgatagagacaccgattcctggaggtccaaagagcctcaggagctgggccagcaatatgcagcatctattatggacacagaacattcccatcacatggccgggtgcagtggctcacgcctataatcccagcactttggaaggcagaggcaggtggatcacctgaggtgaagagttcgagaccagtctggccaacatggtgaaacccccatctccactaaaaatacaaaaaattagccaggcatggtggcaggtgcctgtaatcccagctactcaggagctgaggcaggagaattgcttgaacccgggaggtggaggttgcagtgaggcaagattgcaccactgcactccagcctgggccacaagagtgaaactccgtcacacacacacacacacacacacaagaaaaaaaaggtctcctgctgggacacagactagttagagaaaggaaaaataaacaaatgatagtatgtgtattaataaaagaactagcaacacccactgcttagttgtgataataaaaactggacattaatataggcagaaaaacagaacagccttgatatggttaaccctttgacactggcaaacactgtgaccagtgctgcccacactggaagctcctgcatccctcttcctcatgtttccttcagcattaaggagcaacaagggagacagccagttcatagttccttacgcatggagccaaaggaccttcaatgtacaaggtctgagcaaggacccgcagccacatgtgcttcctgcttcagcagtgccccgtgggtctcagagctacccaaaggcctatccttccgagaggtttctcctctctcccaactgatgtcatacgtctcatcttccttgtcattcagatcatcaaccacaaacgtccttgccttatattttcatatcccttttcaccagttacagggttagttaacttacgaaattcttaacatctgcattagatctttttaaagtttcaccctcaaccacctattatttagaagtgaacacagaaatttagtttccttgtgctatctgttgacccctaaaatatgctgggagttttgggattttttttaaagtcaaatgcatggcataaagcaaaattacactactaaagaactgagtcaggccagacgctggcaacgtgaagacagcttctccttacccactaggttcatctttgcactgttaactcccaaagtattgcttctcggtgctgggtgtgtggcattcatattccccggcatcccgggcctgaagatctgtgatgtgcaatagggttgggttcccctggactctttctatgaagatcttccctccgcggacgcgctgggtgtagatggcataggggaaggaagagtccatggtgctgacgatctgcacctctcgctctggcgacgaaggcaggtaaatggaccactggaaattctgttcagaaggtccctggtagccactcacattgcaccagatagtgatgtgggagccctccgtgcggtacaagggtccttcctgaacggtgacctgccgctgtgctgacaccacacctacgagggagagaaacacacgcaacatgctcacttacttctcagaccaaaatgcaaagtaggcagcaatctccaaagggtttgttatttgtgtgacatgataataatataaacagcttactggccctttcaaaggcactctgtgatttataaatattaattaaaacactctgtggtaaagcactgtccctaatttgcatatatatgggaatttgatcatgccaagatgtgcttttgttacttattcaacagctgacccttgggaatttcatttagcccctctgtttgtcatgtatacggcagttttatatctatttattaatgctgtgtataaagtttttaataaaataagcaggaaaagttgaatccttggcacaaattcagatgaaaacaaataaaagcaaccatctaggaatctggctgaaattaaatgcttcttccttggtccgagtgctggtgggagggagtcctgggagcacctttttactggtgctgcacccttcattttcccatgtagctgctccccaacaccaccccaaggagcattccttagtttctcttccctccataaatggaggcagggctgagctcctgcaggctgctatcgttttaagctgagcacacccaaatacaaatgtgaagggctgaaacagatccctgatgcccagattcccacaaactgacaaaggggggaactaacagtgcccagctaaacctgtgacaaggacagtcaggctacccttgagtttcccactcaagactcccccgctgacctcctgccttctggctcagatactgttctccacggtcacttctgcctgccttctccatgttcttcttaaagtggcatggtgagtttaatttctcatttcgtgccaactcaacattgattgtgcctgagccactcagaaggtgggagggggcacacccctgcctcttcatttcggcagtggtcacgtactgcaggttgtgaaaagcgcaggtgagttataggtgcagctttgccaccaattagagctggttgtgtcatctcagacaacttgcttttcttctccagaccttgatcttctcatctatcacatgatttctaagaacgctttagagagcactagcatgggttccgatgctggctttgtcacttattaactgtgatcttggataagctgcttaacctctctaagcctcagttttctcatcggtaagatggggataataatgcctgtctcatagggttattgagaagatttagtaacatctgtaaagaccctagcacagagcctagcccacaatcagtcctcaataaagagctgctggctaagacatatttctgctggaacattctgtggctctggatccatagaggacaggatttggccaatgactgcttaaggacatttcaacggccccttgacaatgacaccatcactgggctgcccacctcatcccacagctgcagcccattcttgtgatagcttcccttttcccccacaaatgggaatggcggctgccctggctatgcctatctgaagtggatccagctggtgaacagccgggacagctcaaatactagtggagtgcagctctctgcccagcccagcaggtgactgtgcctcagtgtaagctaatctaatctgcaagatgacagacctcaaaacggcccatacaatgaaatgcccatggcttgcaaaactttaattcatgcagaacctttcctcacaaacaaaatcttacacagcaccccatcttggcttcagcagaaccaggaaaaataaaaaattggcaggggaaggaaataaacagaacaagtggtatctgaatttatttgatatattctggttgatggcattaattatgacatttaaagtcaccatgaggacaactcattagtaacatcagtatgttaaaatatggtgcataacatttttaatatatgtacagtcatgcactgaataacatttcagtcaatgaggaaacacatgtgcaacagtgatcctgtaagattataatggagcatatatagagatctaatatatggcacttaatgttggcatggcagatcaagtaggggaaatgactgatatttagtaacagtgctgggacatttgattttccataataaaatatataaatgaaaatatatatcccatctaggtttgttgaaatacaccctatgatgttcacacaagaatgaaattgcctaatgatgcatttcttaaaacatgtccccatcattaagtgacccatgactgtatacacacacacatatggtgacacttaaatcaaatgattgcagtattcctgaaacacagaacattttgcaaacaatttacctacattcataacattaggcatccttagaattgcagtgttctatgacagagcaactacaaccaacccccatccatctcctgcaaagaaggctggaggcaggtcagggtacaccagcatcttcaagaactgcttctcaatcctggacctacactggaatcacctggggagctttaaaaaaaataacagtgcctggaccccacctgacataactggtcttaggattaattagggttttttttgaagctccacagatgattcaaatcaggtgtagcaaagcactgttactttaaagtgtctctacctacgtggtgccagccaagtgctcaaatgaaatatcttaaggctctcactggctttaagtttctctctttggtagagacccaatcactggttcaaggaagtttcattctcctccagtcttccccagtgcaaaagaaaacagctgagacccatcagatactggcttttgtgatgcaataatgagtttaaccagaatgcatccgatttacagaccttacaaaggcactaggccagcggatcatgcacgtcctccccacccaaaggtaaacagtgttaagtggcctgaatgagccaggacagcagggtcaaatcaacttgtctaggctggaagcaggttataaacaatctggacaaataaataactactggattgcactttaaccacacacattcagctgcacctgtttattaaatacctccttattttccctctgccccacaaagggcttctgacccctgaaaataatgcttctcaacataaaaagaattgttttcttcttggcagtttaattccccttccacacatcccaccccaccatttccctataatggtaataccccgctgtgcagacctctgctgcctccaaagagacacaggcgcccaaccctgaccagggcatcctctgacccacagcccctctatctcccctctcagcctacaatagaaagttcctcccaggcaaggatcattttttttaaataacttttttaactttagacattctgtactctttggattactctgcaataagcaaatatgacttctgtaacataaaaagaaagatcaaaatgttatatataactgcatgaaaagaactagaaagaaaatactaggtgacaggatggcaagtgatttttatttttttcttaatattttactccttcccccagtcctctgcaatgagtatgtaccagttttataactagaaaaaaattttagccaaaaagaaaaataatgcatgtttgctatataaaattcactactgtagtatttatatatatatatatatatatatatatatatatacacatacatatttggtctttgtccccagttcctggcactgagctcctaaaccccttggaacttcctaagcaatgggagtaccttttgttatttataagaagccccttttggccatcccagagtttatgctaacgaggtgactgaaggtgagcacggaggcagtttcaaggaaggagctggccacgcttagaattgtggagttttcagccccgcccttagacctccaaggacaagagggggaccgcagattgatccaatcagcattggtcagtgatttgatcagtcatacccacgtaatgaaatcccatatgaaaaccctaaataatggagttaggagagcttctgggtgctggaagcggcgtgcaccaggagagggcatgggcagtgagcactactcccctctcagaccttgccctatgcactaaataggactgacctatgtgaccaataggaaatgcacaaatggtggaatgtgacttccagggctaggtcataaaaagacaagcacgatgttatgaggacatcaaagcagccatatggggaggaccccatgaggcctcctgccagcagctagcactaacttggctagcatgtgactggaagtagattctccagcctcagtcaactcagtcaagccttcagataatgtcaaccccaggcatctttttgttgttgttgagacagggtctcactctgtcacccaggctggagtgcagtggtgcaatcatagctcactgaagccttgacctctgaggctcaagtgaccctcccacatcagcctcctgagtatctgggaccaccagcacacaccaccatgcctggataacttttttatttcttatagagatgggatgatatggttggggtctgtgtacccacctaaatctcacgttcaattataatccccaatgttagaggtggggcctggtgggaggtgactggatcacaggaatggatctttcatgaatgatttagcatcacccttttggtgctgtgctcgttagagttctcccagtatctaattgtttaaaagtgtgtggcacctcccccctctctctcttgctcctgctttggccatgtaaggcgtgcctgcttccccttcaccttccaccatgattgaaagtttcctgtgcttgccccagaagctgagcagatgccagcattaagctccctgaacagcctgtggaactgcgagacaattaaacctcttttctttataaattctccagtctcatgtatttatagcaatgtgagaactgactaatacatagggtctcactgtgttgcccaggctggtctcaaactcctgggctcaagtaatcctcctggctttgcttcccagagtgtagagattacaggcatgagccactgaacctgcccctttccccccaacaacatcttgattgcaacctcctaagagactccgagtcagaagtatccagttaagatgttactgactttctgaaccacagaaactgtgagataataaacatctattgttcctttaagccttaagtttggggcttttttttttacaccaatatataactaatgtagacacctgcagtccctaagattgaatgcaaaattgtgttacatacacatgagtgtgttcttctgggaaaagagtccataaacttcaaaagattctcaaaggaatccaagacccaaaaagattaagaaacattgcatcagacaataaattgtcaatgagcaaggtcctgtccttttagattgggttttgaaatcacccatcccacaaatatatgataccatttaactagtttttcaagatattccttgttcaaagatgctcccactttttctttgtgctcaagtcctagataaacttggctaggggcaggaggtatgattcaggagttagtgagccgggagggctcactgtgcctgggaaagccagcttctcatgaatttttggaatatgccttggctcagaaacctacctctctaggcacaggatccaacttatatgttcaagatgtgtgactgagcatgtgaaagtgtcagagggatcgacctcaccattttacatctacttttccagttgtggcccctacaatcatcaaggctcattcggcaccatgctcctccaaattctgcatgcgactcagccacactaatatctttcttcatctataagatgaaagtaatacaatgcaccatgtagcaaactcacaggagaccctagagatcaaataacactgtgaaagccaccaaatgaatattttaaaattttatctcatttctgccaaggtgagatatcaatctaaaaacaggataaatctttgtaagtacaagaacattaaaaagaacattaagtttgggttaaaaatgcaaaactgcatatgcaggaaaattacgttaaaaaaaaaaaaaaatcctacacctacaaaaacaaccaaacaaaacattgatgatactgggctgattcactgaatggtgagaatatgagtgattttctcctctcctatttttctcaataccttttctctattatctccttttttaaataagcaagtatatattgttctaaaccgaagataaatgatcatgagcagcactttcccaggcactgtcctagttgctctgcatacatcatcgcatttaatcctcacaacagtgaatggggtcgatttcattacagccacatttaccagacaaggaaatggttttcaaggttaagtaaccttctcatgacacagaatgtgactaagagttttcttattccatggctcacactaaatgtgctctgtgaatatcagtgagaagtaataaagcactgactggattttcttggtcaccgggtcctaaaagaaatgatggggaatctatgcagtcccaagttaaaaatgggaactgaactgagctgccacagcatgctgaataggtggagtccaggccaactaagtgcttcatggaacttaaaggctccagagggaaagcaatcgggaaggcacttccacaggcacatcggtgacaacttctggggattcttacctgtcagccttcagccaaggaaggacaggaagtggcatgggctaaaagatcctttgtttgacctctttccagatcaggtgacaggaaaacacaacacttgaacctttccaataaggacagccagcacttactgagccccagccaggtaactgacactgttccaagtactctgcttgtataaccagctttaaccttgcaacagccctctgaggtaaatactcctagtgacctcactttacggatgcagaacctgaggcaaggagttagggagtaaatgaagctggctaaaggcacttgcactggccaggcacagtggctcatgcctgtaatcccagcacttccagatggatcacttgaggttaggggttcgagaccagcctggccaacatggtgaatccccagctctactaaaaatacaaaaattagccgggtgtgatggcacacgcctgtaatcccagctactcaggaggctgaggcaggagaattgcttgaacctgggagatggaggttgcagcaagccgagatcacaccactgcactccagcccactcggtcaatgtcactgccatcaagggacagtctaaccaaggtccagatggcacaagtggagccataaaaccaggacagcttgaggttcagcttcctgagcccacaggtgcaaggaccttatctggatccatactttcatcaaaaatgtcccttgaggccaggcacagtggctcatgcctataatcccagcactttgggagggcgaggcaggtggatcacctgaggtcaggagttcgagaccagcctggccaatatggtgaaaccctgtccctactgaaaatacaaaaatttagcccagcatggtgatgtgcgcctgtaatcccagctactccggaggctgaggcaggagaatcgcttgaacccagcaggtggaggttgcagtgagccgagatcatgtcattgcactgtgggctgggcaacagagcaagactctatctaaaaaaaaaaaaaggtaccttcaggattcctcgagcctgggaggccaaggctgccatgaacaatgattgtgccactgcactccagcctgggtgacagagcgagatcttgtctcaaaaaaaaaaaaaaaaaaaaaaaaaaatggctcttgaaacagccatcaactcccatgtgataaatgcactgccacaatccagcagcaaacctaaagttcggagtgaattcctaagtcttcgccttcactgacttcccacagcatgggcagtagctgtgagaccttgggctggttacttaacctctctgcacctcagtttcctcatctgtaaagtggtataatcgtcacagtgttatggaaggatttaatgagttgctacatttaaaacttaattcctggcacacaataagtgctcaataaatgtttagccgctagttgcagtagtagcaatagtagtgatattaactctagctgtggaactaatttctcccacacaccgtggcaggttgtattctccagacacagcagtaacaatatctccttcccacacgctcttttgcaatgtgaccatgccacacactcccatcaagaggtggagtttagaataattccctcctctgtggatctgggcaggaagtcactgtgtgacttccagtcctaggtcatgaaaagtgatgtagcttccatttcactcagggtcccctgaaccaccacataagaaagccaacggtcctgaggccatgctgtgagggggcccaaggcacatggagaggccctgggcaggtgctccagtccagagctggctccagccaggtccccctgccaccaagtgagtgaatgagccaatcaccacccagctccacctgccaccatgtgagtgaacaagcctcccctgtgagctgcccccagcctcggaacttccagccatgcctgccgtgcctgtaaattctcaacccccagattctgtgagcataacaaaattgttgttttaagccactgaggttgggaaacatttgttacatagaaaggtaacaagaacatatgctatggcttcaatcaacatttttttcagtacctattatgatggacactaggacagaaactgagggagagattaataagacatagttgacaagttgtcctaagctgacaatcctaaaataaatacacataactaatcattttaatggtatacgatagcagtgaggtgcaaagtgcaaggttaagccctttcagaaagtgaaagcattcaaaaagccttcaaaaaagtagtgacatctgaattgggtcccaaagcgcaagggaaatatataccacatgaaaacaccgcagtgcattccaggattagcaagaagtttgcggaggtcgttttgtcacatgactggagggcacatcagtgccaggcggaaaagggcaccgaaaggcacattaataaagtcaaacacctcctctgggacaggggaagttgagaaagagcctaacagaggtaaggaagaagatggatcagatttacactttcgaattatcactctggtggcaggtgaaggacagagcagagggcaggactggaagcagacagaccaaattcacagtcaaatgcgacaagatgagggcctggcctagttttaaatccaaggacaaaaatatcattcattcactctttcattctttctcttatctgaatccccagtggtacctaaaatagagctggtctaaagatgatgattaatgaatgttaaattattgatactacttctaagaagatgtaactgccagctacagaaccagccaaaaggactgcaaacccagtaattcatttcatcccaacctgactgatctctctgatgtctgcactgctgtgtcactagactgcctgattgtcctaggttgagacatttacctactgagccccagggatgggtggctgcttctaagctgctgcctaattccctcattactaaatgttgacgctgcttccttagaggactgctaaaccataactcaaaaatgttttaaacatgctactatttacttagattagaatatttacttaaatgttttaaaaaatacagtattttaagtcttttatctcttctgactactaccactaaccctgcttcccctcatttttccagagattagcactactgtgatttaaggatagagctctccagacttaaaaaaaaaacaaaaaactgcttttatatctagatatatgtaaccactgaaaaatatacattatttttcagcattttttacataaacattatcatccctttcattgagttatgttcctcagttttcctcctcaaagtttttgagatcaaatatagttcccatttttcttctttatatagctgcacagtattccatcataggattacaccacattttatttattccaatattaatgaatatttaggttatttatagttttttttctataaccaacaagcccatgccttctactgcttatcctttccccacctgaatttgtacaatccccagcttctcttatccatgaccactgaaaccccagggaagaccttatcactttcaggatgtccatggctctttcaccctatgccatgcttggaaccaggaaagcccaaaagaccccacttcctgcccttctattctgctcctcctctcctatcgctcatttctttgcctctatcctccactcctcccagcaaaggtagggatagcacctgagtcctgccaccctctcacctgcattccccctcactctcatgcgaaggacagcacagaagcagcatcaaaaaagaaaggcagcgagggagccctgcagcctgccctaggccagccatgcccacagccacaggaatagacactgttttcagccccacctagattcaaggcagcatctaatagaaatgcttataagtaaatataagtgccagtatttgccttctattttctagaggggaaaaaaattaaaaggcaagatcagattacttgcctggaaatgttctccctgtaattactctgaccgctctttctttccctccggttttggagataatggaaataggctgagtgttgggcatttttttttttaaagagggcagcttcatggcaacactccctctgagaagtccagaggctcagtgaaccgcagcttagagtgagttccagtaaaaggaccatcacttgaaccagtaagtgcctcattccttctcacagcatacatttcacagcaattactgttgctattattttacgcttcatttctggacctaggatacctcagtttctccagactctcagtctggtccccaggttttcagtctgagagaaaggtgtctgctggatttcaaacagtccctctactggccgccaccaccaccctctcctaaagaggactggaataactcttccacagctcccgccacactcagcactgcctgcacctcctcctggagctggcagggccccagctgtgcacccctcaatgctctcacagcttcaggaagaggactgctaagcccagggccctgctgacaacatgccgggagcgcatctgcaggcagggtcagaatgtcagctaccaggcagcagagagatgcggggcaccaacagcaaaagcacttggggggctttttcaagtggcatcagaactagacctggatacaaaggggtggccctggcttcaggaagcccatgataagtcagtctgctgtgtccttcaacacagtgtccccaccttctgtctcccaacactaggccatggagacacaaaactagaaaatggggctgcctagctacgaatgcccaggctgtgaattggggtctccaaaggaacctcagagccgtgtcctactcagagcagctccttcagctcttcaccctggaaagcactccggtacaaaacaggaatattcctcttctcctgactctgcccaaggcactgctgtgaccctctcagcagtggaagcactagccaatgtgccatcctcttggacgatagctggataatcgcaataagcagagctccaacaactagctctagtgtgtggggagaagtggggaggatggagaaaggatacaaaaagacactgtgggatttcagggcaacccatgagtgaggatcacagcagagctatgccttgcaaggaccagaactggaaaacctttgtgacttagaccaccctcctcaggacagctcccgccactcttcagggacaaagttcctttactcagccatagtttctgtgctccaaatactcagcttacacatgcctgttgctgctgcactcaccactgtggttctcagtgcaaattccccagaaagcagtctgactggctgggagacctttttttttttaaccaggcccccaaagttgtagattttggggtcatttacaatatgcatttccccaacacactcagatctaggtggacttgaccagatgggcatctgtattccattacccagcatataaccactttgggcaacagggaatgtgaagggccccaaaccgttccccaccaagagtgtgggtggcaggcaccctgaaatatgtctagcacactcataaagcatgaacatctacacacaactaaaaataaatagtgagagccctgacactgcttctgggggttttcccaagcacctgttacgaatgataacaatggatggccgctccttctccctcagctttgactttcattgctggtggctcaggctcctgtgcttggctgtcatcggtgggtagccctggattggacattttccctattcaattcaaggaccatgttcttgagcataactatgaccaggcagtaggcagtgggccctgctctttctttccagggaggcacagataagccagcatcacagatgcaaaaaacagaaccgtggaggtagagactaattcttcagcagcccagagaagagaactgggaaacagggccctcgcagatacacaagaccaagctggagagttcagggacttccaaaagaaggtacaagaatgagcactataccatagtggggtgggtcacaaaagcaggaaaaggtccccaaacaaagaatccatcagtcagttacagcactctccccatgtggtgaaacagtacgcaaccatttaaaaactgcagagaacaatatttatgaacacctaaaaatgctgaaagcacactactaagtaaaaggggagaaaggctataaaaggatttgaaagtattttcgtaaagataaacacccacacacacccacacacctctatatatgtgtggaaaaaggactgggctagtatatttaaaaaacgctaaagggaggtcgggtaataagggattgttttttccttgcactttgtgttttctaagtattctatagtctgaatgaattagattcataattaggaccaacagtcataagcaatttctcagaccacctgcctcataaaacccaaaaaaagaagtcagagaggggtgaatattttggtacagatgaattcaggttgtgtaagtggagaggagggaggtggccaaggagcctgaagtgggggaggggggctgatggtgaaatagggaatgggtggagagagaaaatgattgcaaaattggctggagccagcctggtcaggtcaactttgcaggtgtgtgaagtgtcaaatggttaatcagttgccctctgtttgagctgcttaatgcacaagggcctggttgaacaggtttgacctcatttactttttcttaaagctgtttagccactttcctaaaaactcctattttctgagttattaaactttccattccatgttgatcccttccgagccctctaacgcatctcttctcttgcttcttccaactggatgccttcatgaggcattaacagatactgtgagccctgatgaaaatcatcctttcagggtacaaggaaggcacctgaatgacagatggttggaggaatcttgagaaagcagtttaggcattaacatgcaggctgtcgctgacttacacagagccaaggacgtgacatacagcatggggccatttctaaatccccactgaggacaagggtcctggagggaatgggatttggaacaagatttgggctttgaacattcgctacaggctctgacaaagcagtgatggttcaaaagcctctgccccctggtggcaagccctgcccagatgctgttaaggggctctccaggcacgccctcctaattaggggcaaaatcagagaagcctctttggaagaagacaaaaggcacaatgagatgcggtctcctgaagtagaggctttctctctggttatcacctgaaacaggaaataaggactgagtacctgctcaattccaggcactagccaaatctgcagcaaactagcatttccaaaggtgtcttcttactttaatctcacagccaccctgtgagggaagtgtacattccccatttcgctgatgagatgagcaaactgaggctcggagaaattgtcagtgggatacagagttggcatccaaacccacaatctctgactctaagcttctgtttcattcattccacaaatatatatggtgtctcctctttgctggacactgtactgggctgatgagctacaagacccaatctttacagtctaggaggcagagatagataagtaaacagaggcggcaaagcgtggcactgtgaaagatgcactgaggacaccgagctaggtgttccacaggcgtcaggaaaggcttcacacaagagaggttgcttgtgcccagttctaattaggatgagtaggtatttctgctagatcgtggtggggtggggaggacatcacataggacctcagcagagagcagctcgaatctatgcagagctgcacgaggagccggaggtccagagtactgcagcagtttgacattgatgggtggtagggtccatgaaagtagaggaagaccaagaggaagcagcagacaggggccaggccagggcagggatagggtgctctactaaagagcatgggctttgaactatgagcagtggagagccactgggggtgtaaataaggaaacagatattccaaatcctgccttgggaagattgttctggcaggagtgatgggaaaggggccctggcagaagattccttcatgctcctgcggtgatccaggtgagagctgctgaggaccccaaccaaatcagatcactggacctccactgggagtgaaagggggtggtctggccagagagatagtaaagagatgtagttaacaggcaagagaatgtggggatatccagggagctgtccacaattcgcaggtcttaggcaactgcttgggagaagttgatgaggtcatcactggacagagaatctattccctgggcccaaccaactctctagaccatcctgccatgtgcctctgagaagtgagcttccccagccaagcccacaggaggacatatggagcaaaggtcaacagtcactcagctgatggatggcaagcattcagatgggaggtgcctccacaggccatgataacccatggatccatttgagaaagatgccaaaaaacagttaattcaaggccactttaaaatacctggcattcaatcctcctcaatgtctccatcaactgtagaccctataactaccaaatgagctccactcgccacaaagctcaagacacagaaacggtcagagagcagagcctattcctgaaaagcaaaagactccaaacttccacaactcaaccagtgaagggctggggaagactgacaggttcactaagaaatgagaggaaggacaaacaaggtgttcaaattagaaaatgattccattaatgagggctctgatgatatagttgtggaggttatcagtttgccagagctgcagatttaaaatacttacatggtcatcgaaaccaaaaaatgctgaccatcccccaaaacctcccaccccacctagtgctgataacaggagttatcagttgccttttgtgtacagctagatgagatatggatctgtggggggaagaaggggtgggcgtgctagcatctctcagctagactgtcatcggatggtgacattccccaggactcaagcagcatctgagaagccactttcagtatgactatggaacagctaaccacacaacacagcatactgaatgaggagcctcgcaggctgagaagaaagcaaacccggaaggcaacaaatggatacgtgcatgctgaaggactcgtgtttaattcttcccggtaatcctttgtcaggcatatatttttgtctcctcaaacttaagaaagaaatccatgctctggaggggagaaagagaggctgtactcattaactcagagctgacctcgtctggcaggattaactcgccatacctgtccagcccacagaacctggcctggagcatggagggagaaccacagccaactccagaaaaataaaaggctgcagcgagaaacaagtggggccacagagagaaaggggttttgaaaaagttctaaatccccatggctagggacagtgacatcagtgtgtttaccaagtatttgatttacttgctcaggcaaaattccagaagagacactgggacctgtgtggagagtttcttcactgcagctatcctgccaagctcattgtaaagtgacgaattttgtggacacttacagagaaaaaatagcttcaaatgctatagaccaatgctgcacgctgcagagacacagtctttgggttctgtgagctgtatttgggcattacgcagagttcagctgccatctgtccctttgaaggccagctaagaagttggtcccagcctgggcatggtaccactgtcctacattccagccatttgggatatcctgggttcaagcattccctcccattgctggatcaagcacttcccacctcctgctctgggaaatcagatctcagtaggtcatcaaccatcccagaaagtccagcagagttggttttggtttgggggtgttttttgagttgggtggaagaagagaccttatataatcttttaactttttctctaaggctgaattccctataagcaaaattttaaaattttttttaaagaagaaaaacacccagacaatccttaaaatcccctttcagctccaagactgtgtaattctgtgataccagtattgaaagcccctgcatttccctaactatatattcccctatgccagggaaaggtgcatgtaagtgagagaacaaaaaatttcacaatcgtggggacctcttctttcggctttggagcccccttccctctgtctctgtacggggcagctttttccttctgtcttctcccttccttcttgtctactaaactctctgcgccttagaaccaaaaataaaaaataaaaattcaaaatcatgatcttaggggtgaaagaacactgagaaaccatagaaagcaaaaatgaaaagccaacatagaaaaagtctgacttgaattagaagcagcacttaaaattacaggttcagaaaaagcttgaacagaatccagggctgaggtcagccctgagtctgcaggctctgccctctcacaaaggtgagtagatgggtctggagagggctgttcatgctatggaagggcctctatgccatcgaggctaaaaccaaagcaggagcaaatcagccctgctagtgtgtacagtcggcatcaaagaggcaacaacggtagagaatattttctgaaagacacacatgaaaccagtaacggcgatggtctctggaagaattaggtcagaagcagacttaatttgcactgtgtacattctttggtatcctttttaattgaacgcatgtgaatgcattacctattcaaaaataaatgtgtaaaaacacgtgccacgacaaagcaaaatgaggagacagtataaaaaagacaaggataattttaaatttctcctaataaaacgctgtttaaaaatctaagaggaaaaaagggtaggctccagctagtggagagaacaactgaaaaacaagagccacgtgttcccatggtcctggccaaccccacttctttcccatcctcactcgttcacatctgccttggagcacccacagcaagcctggcttcatgcccagaacatcgcctggctttcctcctctctccctgcccacatctcctcagtcactcgctgcctcctctcttgcttctctcccagttctcagtttgcccatcaaatctcaggtggtactctccattctctgctatgagggagttcatttgttcatgcaatttccccaccggagacaaaatgtatttcccaaagttggcttgcaatgacatctcccatgcctgctctgcttacccatgactttgacactccttccatcgagagggcagaacctgtgtttcctctctctgaatctaggtgggctacagctctggtagaagtgacactctgtgaccttaaggctaggtcacaaaaagggaatgcagcttctgccagcaatcctgggacacacacttggagcccgagctgctgtgtaagccatctgcctgctctgagcccaccacactataaggaagcccaagctagcccacaggagagacgaggtgaagagaatgagatgccagtctccactgctccagctctctagtgtcccagccccagccactatctgactgcaaccccatgaaagactgagccagaaccacgagcccagcccttcctgatgttgacatacagacttcatgaaagagaataaactaatttttgctttaagccactatgatttgggatgatttgttatgcagcactggataactgcaacacctgcttctaaacagtagaatcccaaacgtctaggccccatctctaacttacttcatgttcctgttctcactgattttttgccactgagcttgaccaagcccttgagtcaccaattccagatatttgtttaaacaaattcactgtgactgtctacactatccattcctccaaaacaatccctgttatagttggccttccccagttctcttcctggcatagagtagtctgtgcccttctctcatttcttaatatgaccctcacccatggagtgttcctagattctgctcattcataatgcttcttcacccaccctaacctctccctcctgtagccacagatcatccacttttccaggcctctgcactggaggctgcatcagccacctcccagtacgtcatcctttccaatgccctacaacacggggcagaaaggactcttttttgctgcacatccaggctgtttaagaaaaggcttaaggcagcttaagcacaaagaatgtcatcttcaaacattgtaacggcatcttctttttgggacactgaagtattcccatgattccaagaatcaaatgaacagcatctggttatggggtctctggtctctgccaaggcaaactcataaagcatttcagagcccttcatctggaaaggccttttctccaccccacgcccagccaatgcccactcatactttaaggcccagctcatccgtcatctctgctagggaaccttcctcagtcagtgccttatgcaggcaaccattcctgccttgtgttgtgttgtgttgtgttgtgccttaagtcaaatccttaactcatctttgtgtgtccccttgcatttcagacagtaggtgcccaataaatgtttgtgggatgaatcaactggtaattctcctggaacaccctttcccagtacacctccactcgccagaacaactgtcttcctcacaggtgccagccatcaccccgaccacaccctctcaaaaggcctttgccagtcatcaaacaaagcctcttgtctcctgagagccgctccacaatcaccttcccaagaagaattccccataccgagtccaccattccttccctgatcaaagttgctttcacaggcatcttttcagctatccactcttcacggcttggttttcatgcactctgagttggccctatctcccctttttggcctcaagcacgtcaagaggaaggctggtgacagcctttcccgagctcaggacagttttcatgcaaactcgttcttccaggttcttatgcctggaagaactgctgctctccaatagcatgaagtagacaatgatgttcttagcatccagtcttaaaactagaaaaagtattggcactgctgaatccccagctcctagaacggtgtgtggcacctaaacagagctcaaaaatattaggtgaatggaggaaagaatgaacagtcatctggcccagacttggagaagctgtgatctgtctagcccttctacaccaggagcgaggcctgaaaagctgcatgactcacccaaggtcacgagcaagccagtgaagaggggctggaaccctgtcttttgcctcaaagcacagggccctccttctgtcccacccagctttctcaccacccaccccaccccttccacactccaaagacagcatctccgtgagaagcgttgggcagtgtccaggagtgtttttcttcctggctttaaaacaaattgtgacaaatggctccacagatctaccgggccgtggagctgagcagatgggactgcaattcacgctattaactcaaattctacttgactttctttcaaatcagggcattttatctagaaattataaaaaattgttgggggagtgcctttgtaaggaagtttgccagcacattcatttacaaatcgacttgctcctggccaccctcactgatcacggacttttactcacgctcccttactctctcccatcaaagagtccagcgcatggagagagtgatggaatcttgaggcccaccggtctaaccacccacctaagcttgactcccctgtgcctgtggacatcctgcgtgcagatgcacattcccactaatggcagccaggggaaagcactattcgaaagttcttctttactttgaactcaaattgggctcaggggtcctggatacaggacaaccccaatctcttatttattcaatggacaacaggtgagcacatactaggcctggacactgatgtaggtaggcactaaagcttcagagagatgcaaacgagcaatctttaccctgaaggagctcatgttctatgggttcatttcctttccctgtgtcttacaaacaggttccagtttgtttccgtccttcagagtgtactgcctagaactgcatgctattctccacaagtggcctgaccagcttgtggacaaggatgaagcaagcagaccaccttctttcagtgcagacaagatggctgtttagaggccacatcacgtggcagacacctgccaactaaaaccctccatccttcccacagcctccccctcctacactttgcagctggattcaaaaccttgcattcacccttgttccatcaacagggccaggccatcagtctgtctcatccggactgttttttatcttacttgccaacctacacacttgctgttccttcttgccttaaagtcatacagatgactttaggtgattcagatgagtgtgacctctactttcaccaaacacaatagtcaattcagaaaggtcaaggacagaaccctccagcatgctaacgcagccaaagaagtctgaaaacaatacttggccacactgttttcctgcttacggatgtgggctgctcttgtcctgcctgtaaatatatcggatcgctctccttcttgctggcatccacagtaactatactcaataaacacaccaactttgatgccaaatcctaggccatcccacacatcttaaaaataaaacaaaaatatgttattccagctaccctcactctttttgtggtttcctgcagtccaactagctacaaatctcaaagccaaagattgtagctccctctcttttgttctttcatcaagccaaggagtcctgctcctctctctctagtctctcctgtgtcagtgccacttgtcaactgcctaatccagccacgctgctcttcaatattaaaggtcttcagcatattttaaagttagtctcctactgccactcttttccctactcttgccagtccactcagtaaactactgccatacaggtctcccacagcagtttctcaccagataaacaatggccggagattccactttgccaatcacatcaagtccaaactccgtgtcttggtatccaaggcttctaaagtctggccccactccacctactcactctgacacccaccactccctccaaacattcccggtacgtcttactggattttgccatttcctccaagttgaccaggagtcattcacacctaaaggctatgcttacatcgttttccatctcttgtgttggtgagctaaaaacaagatggaaaagaaaaaagaagaggaagagagaaaaagagaaaaggaagaaatggggaaaacagcaataggaccagctaactcctacagcagagtcttgccaggccctcccctaattgctttatatgtgttacaatgtttaaccctcacaactacaacaggagttgggtaccattccatccccacctgcagatgagtgtggcaccccaagattaagtatctgcccagggtcacgtgaaaagtctgcatgcatgctgaaccattccagctgcaccactgcccaggaaaaaagtcacaggtaggaagacaagtatagaattaagaacaaggcaactaactgtaccaggtgctacagaagggtggtcagcctggaaaatcaggaggtgcattccttgggagattgccgcaatcagagtctgggagtatgcaggagcctggcaggcagcccagggacaggtgaggcacaggcactcattcccttccatgtgagaagtcagggcacgtgcaaagccaaggccagaggacaaaggtgagctcgccaatagggccaatactgggtctggctggaaggggagggtggacagagatgggtactaagaagtgaagatggacaggcaggaccaggtcttaaagggtttgtgtcttgctaaagatgggcccttaattccgtgacacatctattcaaccactcctcattatctacctaaattctactgtgcctttacaaagcccagttcaagtcctttttcctctcaggcctgtcctccctactcctgagcaaaccacaggtgtggagacaggtcccaaccacctgcagatgacagaaggaagctgcatctaggatcggtctacacagaggcaagaagggatcctcctcctctgccttctcctttcatgctgttcttaccttctctcaaaaagaaagaaaatacagtgtcattgcttcttccctaagcttgttaagtcaaagcaagtcaaagcatcagagcttcattacttggctttttctagctataagtgtctggaaaatatcaggagtcactggcctctaggaatccattaagttaaaggagctccatgatctactatcataagatgacaaagaaaatatgcactttctttgggaggccaagttgggcgaatcacttgaggtcaggagttcaagaccaatctggccaacatggtgaaaccccgtctctactgaaaacacaaaaattagctgggcttggtggcaggcacctgtaatcccagctactcaggagactgaggcaggagaatcgattgaacccttacccaggagacagaggttgcaatgagccgagatggcaccacggcactccagcctgagcaacagtgtgactccatctcaaaaaaaaaaaaaaaagaaagaaagaaaggaaggaagaaagaagaaaatatgcattttctcaggattaaataacaaaaaatgccaagtttcttagctccagtcaagaaaatgacatcatgtgacaacagcagccattgcaagtttatcagaagatgaacaattacagatttttcatttctgaataaggaaccatttacacagacacatgtataacaaatgtctgtgcacatcccggacttgtcaaatcttaacattttgccacacctggtttagtttttttatttttcctttcaagaaagaaagcattacaggctgtgcttcaatccctatttcaccccctttcaagccccactattccacccatcccagaaatgacaacatcccgaatttggtatttaccactcttgcacatttatttttatgcttttactacctatgtatgtagccataatatatagagtttttggatgctataaaactgtttaaaatggcatcacactgtatgcacccttttgcatctgttttaattgacaaaacatttttgagggtaatccttgttgacatatgtcactccagggcattcctttcaactgctttataccatggtccactgtctggataatcattatctatagcacaatgtattcattttcctactgataaatttttaagtggtttccaacttttcattgcaataaatattcttgtaaatcttcatccaagggtatcttcaaccacactaggcattgcccaaattgctctgcaacatcagtgcaccaatttacattgccaagatcagtgtttaagtgtttctattctttgatgtctttgtcaaccttggtactatttgactactacacttttcaccaatcagatataaggatgaaatggtgccttcttggtattctgaaaattaattttaaatgggaaaataaattactaataagtgcagcttaatcaacaagagttttcattaacatgtgggaatacaccaggtgttccttggattttcttgaaaattctacagggagggtacgggagtgacggtacagataagattggacatgagctgataattgttggaactaggtgatgagtgtatgagggttaattatcctgctctctccactttggtacatatttgaaatttttcacaatagaaattaaaagaagaacagggcgtggtggctcacgcctgtaattccagcactttggaaggccatggcagaggatcacttgaggtcaggaattaaagaccagctggtcaacatggggaaaccccacctctactaaaaatacaaaaattagctgggtatggtggtgtgtaatcccagctattgaggaggctgaggcacgagaatcgcttggacccaggaggcagaggttgcagtgagccaagatcgtgccattgcactctagcctgggcaacagggcaagcctctgtctcaaaaaaaaaaaaaaaaagaagaagaagaaagaaaacaaagaagaaagaaagaaagaaagaaaattaaaagaaggaaatgccataaagcatctgggcaaagaacatccaaagaagagcactgatcactgcagcagacagccgttcagaatgggcagagagcagagctggcaggaagagaggacaaaaggaagaccaggaagggaagccaggaaaagagattttgcattgtgttattatttcaatcagaagacttaggaacattatttaattatcaaatttgtgtgtctgatgatcctttacaacactgcagcatcaaataaagtgttatcagatttctttcttttttttttttttgagactgggtctgattctgtagcccaggctggagtgcaggggtataataatagctcactgcagcttcaaactcctgagtttgtttgtttgtttgtctgtttgtctgtttgtttgtttggagagacagcgtctcgaactcctgggctccagtgatcctcccacctcagcctcccaaagtgctgggattacaagcatgagccactgtgccccagcccaacatctgatttcaaaagtactattgatattataatcaccattaaaaatcactgaagtttttgtcacccaaagttttactttgaaatatagaacatttcatttttttcccacacacctcacatctgcttttgatttttaacatgtgcatgaattacctcttattagaaaaaaaaacacaaaattttttggtaaaagaattatcttaagtgggtattttttccctaagtctgaaatgacttagtaaggataagaggtcaaaccatatgctttgtagtgaaactgcaactatgatgaataacattagaattctggatgccttccagcagctggaacagggcagacctgaggcgggagtcctcatgcttaggggaaggggctcaggcactgggagtcggtcagggctcccaggatgtaaaagatacacatgaaagaaacaaacagtgggactcgggccagtgcaaaatttggcctggaactgagctaaaaactgtcatactggtgggaagaagcagattggttcaacagggtaaccaaatgtgaaaaagaaaagcctcacaagaattaaaattgatggttggaactgggcgctccgaggctgtgggccggtgtcctgccccgaagggtttggctgccagcaggtgcagcgctgccctgggataccagctcctgggatgcgctgtagtatcatcaatcaccggtgctgctcgctgggccttggaagcacacagtagtagcagatgtcagcagggggccaccagggccacctgccagtgagcccactgcttagctgagtcatggtcaagtttctctgcagattgttgcctgaaaatatttcaccacctggaacctccctgtcccacccatcttcacttgcaatactcactcccctcacctctgcccctaaagcaattattcattaaccacagggatccaccatccaggaacaaaagaggcttgaaagctctatctgtgcctgcacttcttggtccaaaaggcgcagggggatgggggagaggcaccggggtcatggtgcaggctcagctgttgagcctcattccccaaacacaatgtgacaggtatcaatagttctggagttgatcatttcacagaaaggaaactgctgtcaacctgcccaaggccacacagctagtcctggataaattgacttaaagaacccaggtctctgattcccaaatcagtgctcttacccctcccacgccacctctctcttctaaagatccacccaatggaactgccccagggctggtatcccagctacttctccattcatgccgcaggtcaatgattcagggcggacactcctcaagtgaccttcagaggccctgactcactcctccgacagtcctttgtgtctggactcccagccgctcctcagcagctctgtcctcttttgtacatttattactgtcagcctgaggctagcaggaggtctcaatgcctggtgatctgaggccagcctgtcccaggccctcccagtcccgtgaggtcctcctggggatgcaggcacagcgactgacaaggataaggagcagaagggcaggtggctttctgggtgtgagcttggccttctgccacacccatgctcagaaaggtgtttacgggcacgtcttgtgttgtcacaggtgtagaaagggctttgacacgcggcagatcctccaatccctgtgaaagagggatcattctttctattatacagtgaggacgctgaagtccagaaaggtcaggtgactgatgaaaggtcataaaattagcaggaatcagggaaagggcaggaaagcagagcttccagttgcaaggtcagaactcttcagcccagcaggcgagtttgccagccagtctgtgccctggtctctgccctccccaaacacgtgcaccaatttggaggggctgctcccagcacgcatgctgcaagataaacttcagtgctcagccctctcactgtgacaacaatcccttagaaaggggtccacgctgtccatctgggcccctacaccaaagaacacctaattatcagtggtcctcactcaggaaacatgcccacaaataaagacaaaagtaaacccaactacacattcctcaaaatcctcctctccatttcacagaaacaccacaacagagcagaactgcaacctgatagcatccctgtctggttttgactctttcaaaacatcagggacctcacaggaaagcaatgcagaaaactgcagtcatttggccgcttgttaaggagagccctgagcagcaagctccagaccggagatgcgcatataacagcagcagttccacacagccctgcacagcagcaattcagcctctggcagctgtgatgatgctgaggcagtgtccccactgccccagtggcttctgcatgcaggttcatttgggacaggacacctctaactccatctctggccaggagccagcatagtaggtgccatgaaagccaggaagtgaactgcacagaatggactgttccaatgtccatgggctgcaagtgggtcccacgtcacccacaggtgaatcttaattatgaaccaaggtgacggcagagaggatgggcagcaaaggagggtgtgtgtggtgatcagccatcagaggagacggccctgtgtgatgaaaggacctcctcaggaaacctccccaccagcaactggctccaaatggtcagactttccaagaaattcctgtgaaaaggacaggctcagggcatgtgaatgtgatagtcagcaattcgcacctcagcagccagtgacactatggtatagggaaaagaacctagattaggcatcaaaagtacccggtccccttcatacatggctggtggggaggtaggatggtgcagccactttggaaaacagtctggtagtttctttcaaagttaccaaatgacccagcaatcccactcctaagtatttacccaagagaaataaaacctgtgtccacacaaagacttgtacacatcctaatagctgtattcatagtagccccaaactggaaacaacccaaatgcccatcagtttgtgaagagatggacaaaatgtgctatatccataaaacggaaccctactcagcaataaaaaggtgtgaactagatacacacaagaacatggagggatctcaaaagcactgtgctgagcgagagaagccagattcaaagggctacacactgtaggatgccatgtgcatcacattctgtacagtgcaaaactgtagtggcaggattcaggtcccctgaggctggggtcctggaggcaggagaggggctggtagcaaggaggcacaagggaactttttggggacagaggagtggtccatatttgataggtggtggttgtgtggctgctcatgtttgtcaacaaagaattacatattttaaactggtgagttccgttgtatgcaagcaaattataccacaatgaagcaaatctttaaaacactaggttccttttctttatctagagctcaaagtagtggcccatgctggctatgacttggagaaatcacacaagcttactgggtctcaactgcttcatttgtacaggtggctgcataacactccccgggcaggggaactgtagggatgaaatcagcaaatgtgagtgaacacacagaggaagcaacacataggccttccccaaatacccacttctgttttctttcctcagtgtgagtaagtggctctaatgatccacaaaccttccaaccagccaagtcaaggaccagcaggaggactcaggaaagtactgaaatgctggggagaaccaggacagcggctgagcacagccagacagggagggcagcctggtggggccctgggagccatggacgcgactgcgctgggagtggggatgggagatagcaggagttggtgggtggggcacaaagtgggagccagggccaaattgctgctgatttgaccattttgcaaaaggccagcctggctgtggcctcaggcctctcatttcctctaccataatgaggggtcacggaagtgccttcccacaactgcagcatctccctccacatttgggctcaaatacagagtggggccggagacagaaaaagtctccgtgacacactgtgatttgtttctgcactgtgtgaacccttggctctgtgacacagaacacaggtttcagcagttcctgtcacttcccacaggcgaaacagacagagcattcttttgtccggcttctggtgaaacgccattatcgttatttttaggaggaagatggagaattggggtgggtccccacaaagaggatggattcaggagacttccaggaaccttaaacggcttggaaactaattgtgccagttctttttgatgtctaattttactctaaaatttcctctcagcacaatatattaatactgatcagccaagagaaggttaggttttggctcacaaatagtcaaggagagaatctccttcattcattgagaaggcagaagatggcgttaaagagtattcacaggtaactaagattgccagagggagaatcgagtgagttgtcagtggtgaaatacagaggaggtagagagagctacactgagacaacaaaggcagcttaagggaacaaagccagctaagggaacaaagccggggtccctcaggtctgtggccaccggctccagccaggacagcctggtagctgaagagcacgtccttgcccgttacatgcctgtgtttcaagtgatgctaacttgctaatgcagatatctccccaaaccctgcccctggctcaccacccagtgagcaatcactcactttccccaggacaccttcagggaggtactctgccagcaccgcacacttaaacagctactgcaggttcttctctcagacgcagcacggttcctgagatgacgtcagcgctgctcgctgaaagcaccaggcaaggaggcaaaacaaaggaaatcctaaagagcaggcgagagaacagtggaactggcagagagaggcactggtgcggatggagagggcagcaataaaaactgggggacacttagaggcaaaggtatggcaggtgacaaaaaagatgagctgaagctcaggagagacccaggcagcgatgcccaaatgaccggctgaggaatcacctcactgctgctgatgcccttgacagcaatgtctgaggctggcgtgagtgctccatgctcagagatacctagaacccagctacaatggccttatcagactgaaacaagaacaccaagatattccaagggaggtgacaatggggtccaaaggttgtgcatttatggatcacaactatgtgctgagtgtggcccaaatcccagctccatatggtcacaccatgtctacagccaatcagctgaccggggtggcaacccctggctctgctcaacaataatgacaaccatcatttactgagcacttactatgtgccagaccgatgctaagtgctttcctcagatgtttccatttaactcttagaatcaccctaatgagtatctcctattattttacagatgaggaaatgagagtttagaaaagtaacttgcaaaatcatactgctggctccataacaaatgttgattgaatgttgtctgggtggacagaggcaaggatgaccggaacgagacaaacaaacaaaaggctgactgacagaccattcgggtagcacttttcctgggattaagcttagaccttgtaggcctatcagccagaagcagtgtgtaaaataagagtggctgactgggcacggtggctcaagcctgtaatccaagcactttgggaggccaaggcgggaggatcacctgaggtcaggagttcaagaccagcctggccaacatgatgaaaccccgtctctactacaaatacaaaaattagccgggtgtgatggcacacgcctgtaatcctagttactcgggaggccgaggcaggagaatcgcttgaacccgggaggcagaggttgcgataagctgagattgggccactgcactccagcctgggcgacagagcaagactccctctgaaaaaaaaaaaaaaaaaaaaaaagagtggctacccaagaacgcaacagcagcagcaaacactgatctgatgacaccccagttttgcagaagaggaaggaaacataagaatgtcaactctccattcaacagagaaacagtgccaccactgtctttaaattttcaaacttatcaagaaaagctccagagaggccagtgccagcaatgccggctgtctcccaagtctgaagggttttcctctgggtattaggagttgaggtgtttggttagagaagaaacaggatgcacgggagatcacacacacagattaagaggtgcctctcaaatgcctttcccacgtttctaactctgctttttttaaagcacgatcagacccgccatctgcacttttacctgctgcctgacgaaaaccagatgccaaaggcctcccagcactcacggggccctttacccttaggaaaacaccgtgattcagccaggccagattgatgcaacattgtaacaaagcgtatgcaaagtgcctagctccggactgcttgcagaaaaggcacattttgactcttctgagagtgggaaagatttgaaagatgggatttgcaccttattcttattcaagtctggagatctggaacttcttcctgaagctccacgtttagccagataattgagacgctccacctggtcaccactggacaccagccacccaaacattctcctctgcaaggcacttggcattctggtgcctgtggagagagcagccttctcactagcacagctcatgaacaaggatccccttccctggacagccaagatgtaaacctgcccccagaaacactgagagtcctagaggtagaatgagtcggccagcaagctccagcccattgaatgcagacccctgagcaaatcaagtcaggagaaggtggacaactgtaccctgaagaccacataccacccagacccaacacaaatagctgtcagcactgccacccattacagcttcagatctcgcttctaccagcatttcccagctgagcaacaaccgtcaaagtctggtcctggaaggacagccctccccgtcttggcagccacactttctggccctagcccaaggctgctgtggcatgggaggaatcaatggaggaatacatggctcttccctggttccttcctctcccacttcattgactaacactagtcacatggccccaactgaactgtgagggaggctggaaaatctggagtatgtgcatgcctagtgagttgcctctaccacatcctcttaacccttggcctctcattcccaaagtctagccctattttcaaatgaattcaacgcctcattacttagatctttcctcattacctcaaagccatagtggcaaaaagcaaacagcatcttcctaaaatcttcctcttccatcttcctctcctagatatccatcttacccttctttgccagttaatttattacaatcttcctttgacagcttcactccctccccgcactgctatcaactcaaatgtgagttatttcagtagcttgagcttgtcactggccttttacttttttccccttccaaagaacctggtacccagctacttaatccttatccttcttcccaaggcccactttcattcctttctcccccattcatgagcctgcaatacttttcccgctgcataagtcacgtgtcaccatataaactcacaatttgaggtgctctagaatctgtccatggaattagtcaggacataatctccctgtttttcggcagtgccacatccatacctgtcttcacaggtttgctcatgccaccattcctttccccagaacgcccttctgctcctcccacacaaatcctaaccctccctcaggacccatttaaaatacaatctcctcactcaactctttcctaccaacttgctttcccctctcctttctgccttaccacaaagctaagctctgtctctgaataatgtgctttttgatgataatctgaatggtacaagaagaaatcctatttcatgctcctttgagggagtgtctaatataggttgccttcgactataagtaatagaaaattcccactcaactggcttcaacagtgaggacaaaatgtatggagattggacggttcagtcttcaggggcttggccctcagggtttttcccatctcttcccgtctgctggcctcaacaaacctgctttcctcattgcaacaagatggctgcttcacgtccgagaatctagtgaaagaagctgtcccttctgcatttccttttacaaggaaaaacatctttcccagcatctcccagcagacttctcatacctcagtggccaaaaccatgtctaaactacgggcctccaggatgggctcagctcaatcagcacataccctagagctggaggcagggtcacctttccttgagtggcgtgtgggagaggtgtggcatccaacccaactgggtcctgccagcaggaagagaaaacaagagccactgtaggtaaccaatcacgtctaccacaggcagggaccaataccacatatctgtgtttcccctcacttgccacccccatcctgtgctggcagatgaggatgctcaacaaatagctgtggaactacaaattatcctgtgggtgtgagaaaagagtgtgcattataatagggtggtacaattggacatgtgtgcacggaaaatggaaaaacagccatgaaatccaaacagatgcaaaaacgttcttaacacagaaggtttgggaagctctgatctaagccctagcctgggccctactcccagttccacagatagggagcaggccccaggccagagtgctgggcttctcccagcaggatccagctggggctttctcctcagttcaacccttgcctctgaggaccagtggtctacagtccagcccacaacccttcagacagaagttccaggcacaaaaaggaagctcacaataaggaacgcccatgcctagccataactgagcgcatcacagactcacacaaatctgtggaatgagtgcatgatctcatgagctctggtctggaaaagtaagtctccctacactaggacttaaagggaaggcttctttggctatgccaatatctttcctgccactttcttcttcaggccaaacagctcctatccctgccttccatcttagctttccagcatactcttcccaggttctttgggctactgacaagcactccagacccaaatacacatgctcccacctgaggctgggaaatgtaccaagaactgcatagaaaatatactggacaaaaggcactccagtctcacagatctccagtcccacagtctatatcaccagttttagctgtttgaagttttagaattccttttcaaaaccatagctagcatttctttggctagagaaaactgtgtgaaatgcagcctaccataggatcactgattacaacatgcattcaacattcaatacatattgactgagcaactattaggttgaactatgtgacattattgacattcgactgcttctgacctatcaaaatggcaataaagctcaacttaatatttactctatgccaggcagtaggctaaggaaggatttgggacaccatgacaaacaacacagaagtaacccctatcttaatggaacttaaaatctagttgattaaaccattacttacaaaagtacaatctaacttcaggattgtaattaattataaatgcatttatttgtttactgcctgacttctttgctagcctataaactacacaaagatgagggttatgtctcctccatttcacacactggcaaagcatatagcagaatacatcatatatttgttaaatgtattgattagtgttacaacagacaattgcatgtgctatggaagcgtttggcagagagatctaatctaatcttggaaggtgaggatcctggccatcactaacttggaatttctgatactgatgatataaggttgagttatgtcttcatgaaacaggtctctatacagcatataaacaactaccagcatgcacaggggttccgtagggactatttaaaatacttaagggaacaaacggttttcaagctcagtctagtatttcagaaattccatttacataaacaattggtgcactaattgcaaatcattcttatttctctcctaaagcaggatcccctaaggatctttattaggcattctattagcctagtttgagttacagtatttacttaaaagtaataacagtgaagttcttgaaaaatatttggtaattcagacattttactaattcaaactaatcttcctcattagtctacgttgttagaggtttaaccattgtattaagagaaagtatcaaaggcttcacttagagtaatagtcaccaaatttttttgcaagacaccttggtagcaggaacctgagctaacatcaggaggtaggtagaaatagaaaataaaggaatgacaatttgaagagcaactgcaatccaatttagtccaacagatgacacacatatgaagtcacattcaaattataagcagagcacaaaaatattttagatccttatcttttgattaacctggtatcattcagggaaaaatgtcagggaacaccactgaccagcagtcctctcttatctattttgcagatcttatctatttttctccctgagaaccagccctggacacaaactgcataaacatcaatgagcctagacagggtcttcatgtgtgtttggcctgccattgttctctgtaccagtacggagatttagtaacacactggtcacattcatggggcatcttgaactctcttgacatggtaaatgaacagcaggtcctgttcccatgccaaaagcaaacaaaaacctgtcaccagcaaggaagacacccagtctctccaaaggatgccaaagtccacatccagcctcctttgcagagcctcacaaatctctcggatgcaggcaggatgatcacgggctagggaagattatgctctgaatgtcttaagagattagttacttaaaatcctccacatgacttcagtcatccccgttgcagatcacagagtaaaaagcctacctgattaaagctgaatgcctatacatttgcaaaagggaaaatatgcagaagaaaacgagagtcagatactgatgggcatagcaccagctctaggacatcagaggtgttgaataaatgatgacaaggagacacacatagttctgatatattcaccataaataccacagtcctcaaggctctctcaattacttacttccccccaaatcagagactgaatctggccttatcttcaaatgaggcccagctctccccaaattccaaatatgggaaattacagctcctctgtggtagggggaagagtgggaaggcgaatgtttgtattgcataacgttttaattaaaacaaagatgacgtgcaccagagtctctttctcatctcctgttaggggcgttttccagtactacttccaccctttacccacccaggtcaccatggtctttttcttccctctaggacaattcacctttaaaataagaggattgggcaagaaatctacaaagatttttccaaaatgaactcaggcctagaggcatattagttctctatcttgttgctcccttctagaagtgcacagttcagagggatgcccagccacagaggtgccaaaacgcagagctggaaccaatcacctgctccaacagagacaaggtgaaagcactgggcagggtgctcagaatgtgctcttgcttctttgtaatgaaatatcagaagacagattgtaacattgttcagcaagctattttttgtactgaaacatcagaaggcattatgaaactgttcagcaaatcatctctaaacaatgtcataaagggttacctagtttggggtaagcccggaatgaatatctgcaccatcattcctcccgctaacaaacatgtccatctatgtgaagcataattcccaacacaccaccatctccaaaccaacaccaaaccactgccaaacaaagctgaagaggaaaaccagaaaggtctccgagaagtgctgcttgcagggagaagaatggccctgcacagaggctcctgagggcagcaggtgcctgctttggagccttggcaatttccaccaggcagaatttacaaccgtctgggacctgcagtctcagagggctcacggagaagggggaagctcttggctacccgggaggtcaccagtgactctgagcaaagtgcagatcaatgcctgcttagggttaaccccaggctgggagagggcatctggcaaggaacagacctggaagagcctgcccctctttgagctgctacagcagcttctgggaatttgtaagagccatactgatgagggtcccacaccctcccttgccagggcgccctcagggaggccacactgcaggaggcagagtatgaggtggggaagatggatcggccttatcctcaccaccccccatacgagtctcctctggtatggatggtgtctcctctctggtgggaagtatgtgatttctctatttctatttctcttttgttcgggcttcctagaaattcagagctaggtgtgaaattcccaattcccacagacaagcaacatccccagcagtaataaggacgttccacacacccaggacttgggatatttgtgtattttcaagaataaaagtttgccctttagcctcctcagagccccctcccttctcctcgctctccccttaccactgctattcatcatcttactcctacagataccccctcttcgtggtggcaccgggcactagtaactcatggctgtaaaggagagctgagaacaaaacaggaagaaaagaggttaagtaatggcaagaaaaaagatgtaccttaggaataaaaaagagttcccgaatgtcacagtgtatttaattaatgcttctatttattaaagattaaaaatacatatcaggtgacgacttaaaatgttagtcatgattttaactgtgaattctgtggcaccggagataacagaacaatgagtgcttgtagaaggcactcggttatttgttgaatgaacttcttgggaaagccttcttaggaaagtattagaagtagattctgctaaaacaggggctaccctcagaggtctcaggacaagggatagaaagtcaaacactgatgtttaagaagggatgcctatgacacatgaatcccacagccatctctccaaaagagcaactattttgactgcgcatgcgggaagatggcgggccgggcgacttgagatccgcgggtctccctgctccttttccgtctgcgtcgggagctcccgggcacgtgaggccgtgccgcgtttactggcgggagggacggcctagccgggcgacgcctcggaggaggccgcggaccccttaggtgctgggcccttggaaatcggcgcgtggggggcggtgctcgagctgagcgcgagagggcgggagagctcgtggggtgcgagaggagcaggacgcccggccgggcagcatgagtcagcagcggccggcgaggagattacccagtctcctcctgcacccgacggaggagaccccatcaacgtggagggcctgctgccatcaaaaataaggattaatttagaagataatgtacaatatgtgtccatgagaaatctgctcccgggggtattcttgacttaaacaaggttgcaacgaaactgggagtccgaaagcggagagtgtatgacatcaccgatgtcttagatggaatcgacctcgttgaaaagaaatccaagaaccatattagatggataggatctgatcttagcaattttggagcagttccccaacaaaagaagctacaggaggaactttctgacttatcagcaatggaagatgctttggatgagttaattaaggattgtgctcagcagctgtttgagttaacagatgacaaagaaaatgaaagactagcatatgtgacctatcaagacattcatagcattcaggccttccatgaacagatcgtcattgcagttaaagctccagcagaaaccagattggatgttccagctcccagagaagactctatcacagtgcacataaggagcaccaacggacctatcgatgtctatttgtgagaagtggagcagggtcagaccagtaacaaaaggtctgaaggtgtcaggacctcttcatctgagagcactcatccagaaggccctgaggaagaagaaaatcctcagcaaagtgaagaattgcttgaagtaagcaactgatggcatttgagaatttatgtatcactgagttttttgggaatatcttcgtggagaattacgcatcaaatttgattctcagagcaataaattatccatgaagtgctctcgttctcagtagcggcatcatggccagtagtgtctttgaggagttcaccacttagattactgagtaattgtggtttccacatttgaaaacaactccttttataattattcactgctttttgtcagtgaaatagacatcttgcctcctgaagtagcttcatcacagagtgtcatgaagacagacagtcaggctgaaaaggacagttctttgtggactctacccttcccttcaaggagtatgtcatatgtcacaaaagaaattgccttacactggttcatgtttgcagttactgttgtacattgcatagatgtacacacgaatttaaatgtgatgtctttgtatatatctgtataatgttgagattacttacgaaatatgtctgagtgacacttttcactcttgtacagccaaaataatgtatatatggaaaatgacagacaaattctctaatctctttggtatctataacttattagaatcctctggatgagggttagaagagactttttccaaacttctacatgtagaagtatcataaatgtgctacacatttatgtttgtggatttaattaaagtattttaatatggttttcagtgctaaaattggagtcagatacttcttggttttaagctgtctacctaattgctgtctcccagcagatcggtggcatgcccagtggctttgggggcaaggatagaaatgccatcaggaaatagctgaattcattgtgaaacatgaattcagtcatggtgataattggaaactcctttcaggtttttgcaagtagattttgtaatgtttgtgtatgcagccttgctgttgagtcagtccaaggggttttacttaggacaagttgtaccttgccctctctccagctctgctcccacattttcacatacctagctatttctacctcattgggtaagtcatttaccactctgtgcctcagtttactctgtagtttaccattagactgtgagctccttgagggactttgtcataatcactgttacatcccagtgcctcacactatgcctggcccttaagaagtgctcaataaatgtctgaacaaaaaaaaaaaaaaaaaaaaaagagcaactattttcaaaatcaggtctaaagatgagccatccaagaaactgctcttgctcccagaggttttaaagaaagtcattcccatgaacgtgagaagtaacccaacactttgaaatgataatctttttacagcaataactgttgctgcagggcttgagaaaaaaagttctcttcctttgggttaaagtcttaaatgctgagcccgtagccagcaaccttaaagactactcgggtccagttcattctatctggaggagtcacttgggaattgaaaacacaggaaaactttttttctggtccatgaacaaacaagaacacttaactgaattagacacaaaactaagtatttatggttgtcatcttaacaggtttcaaacaggcttcattttaatttaacataatttcaaaattatagcaaaatagtcaataaaatacgaacgtgcttaatttgatgaatttatgtgttttttgaagaaaatatgcagaataaacaagtcaattattctcactaaatacattaaaatttaagggtaatatttttattatgacttgctctcctgatacagcaaaatttattgttatgtagttatggaaggaggctcactactccccaatgatttcacaaattacagcttcagccagctataaaataaccaaatcagttctgatatagccataaaattaagcctgaaaaaatagtgaagtaaatcatccctttaaaatcaagttgttgaacaatatgttctgcatgattccatttatgtcagaaaaaatatatttgtgtaagtatatacacagaaaagggtctggaagaatatataccaaactataaagaatctatatcaaagtcaataaggggcatagacaaggaggggaactttcacattttactttccacattctttttttttttttttgccggagtctcactctcttgcccaggctggagtgcagtggcgcaatcttggctcactgcaagctccgcctcccgggttcacaccattctcctgcctcagcctcccgagtagctgggactacaggcacccgccaccacgcccagctaatttttttatatttggggtttcactgtgttagccaggatggtctcaatctcctgaccttgtgatctgcccacctcagcctcccaaagtgctgggattacaggcgtgactttctacattcttgtaacagaattatagtcaccgttacctccatcaaaaaattaaaattcaaaaattaggccaggcacggtggctcacgcctgtaatcccagcactttgggagtctggagcagcagatcacctgaggtcaggagttggagagcagcctgactggccaacatggtgaaaccccatctctactaaaaatacaaaaattagccgggcgtggtggagggcacctgtaatcccagctacttgggaggctaaggcaggagaatcacttaaacccgggaggcggaggttgcagtgagccaagattgtgccactgcactccagcctgggtaacagagcgagactccatctcaaaaatgaatgaatgaattaattaattaaagcaaacaaatataagctaccacctgaagtagaaaccagtatctcttcaccttacatttacataatactttaccctaatgcattttatctgctgttctaaatcatgacttacttcaaatcaaatcttaagtgaaaatcaagatttccttttgggggcattatacaaaaaagactgtaaaatttcattctctgaaagtctttttaaaaagggatagattgtatctggctgggatagggtaggtgtgatcggacccggaggaaatgacggctgctcaactctgcatctcctttcctcaccctgctgaaaagtgccacctagcatggtcaatcaaggtcaccaatgcaaagcagtagtgggcaaacaccacccaggttatccaaagcagcacatggggttgggaaactgatgaccttggagatttcaaaatcacctaacaataaccccaccttccctaaccacagggctaagcaacctaatggatcgaacatatgtgtgctttggtcatccgcaacccagaccactagactaattttgctttagaactggactatatcaagtgtgaacgatcatacttgttatcatgtgggaaaaaaggtttaattactccctaattgtctgggaaacaaaagatttcaaaatacggagctcctgggggaaggagagttaataaaatgggtccttgagaagtgaagtgggaagcctgcctcatgccatggcaccagcgatgccacaggtgtacccagtgccctgccgagagcagagacggtgttctcagagttgctatcaaaaaggaggcagcagactgcattctgaagcatcagacaatgggtcacatgcgaaaacagaattaaatacacaaaaatagcaccaacttaaggcaagcctgggcaaactgcactacatcaaagaaagaacacacaactggtatcagatttttttttctgttttaataaagagaaggcctggacacctgaaagttgacgggaagcaggcatcactaatttctccgagttcacagttttgttagaatgtctttgctctgattatggttttatttatttatttttttgagatggagttttttttgttttgttttgtttgcttttgttgccctggctggagtgcagtggtgcaatctcggctcaccgcaaactccgcctcccaggttcaagagattctcctgcctcagcctcccaagtagctaggattacaggcacccactaccacgtctggcttctttgtgtttttagtagagatggggtttcaccatgttggtcaggctggttttgaactcttgacctcaagcgatccacccgcctcagccccccaaagtgctggaattacaggcatgagccaccacgcctggcctgattatgttttgatggatatacagaagctcttgctttggtacagaaacaggccccgctttgcttcgacctctgggccccccaccttcagaaatgtctggtgccattcctggctcctcctctcagtggtcttccagggtatccactcacagctttctgatgtcgcccacctgtctctagcccagatacccagtcctcatggcaagtgactgcagcaatttttacaaatctacacccttagggttcccatcccaggacgttcaggtttctccacccctttagaagtgcccagaatatcccctaccccacaattccaacaggacgtcactctcctcttacttaagaaaaatgcctaaaattccagcccttccaaaaggcctttctagattgaccactcaggagttactctggcctccccttcactcctgctagactgaaaacaaggacagacttgcctggcctctctccccgagtagacacctacccccagtgaacacatcctgtcagtgtcctcccgtctatttgcaaattgattgactgtttcattgctggccttggatgacctctcctagagggcagggacggtggtgttcggcaaagccttggtcgtctggataatgggaaatggggtcttctggtgaatttaattacagggttaggtggaaactttgcttcaactctcattattagaaagtctattgtaaagctttttaaaatacaactgaccactttccagcgagggtagagttaatatgccttaatctttgatttaggatcttgcagtgccccaggctcaccattctcttctgctactataattatagatgcggaagacatacagactgggctgacgactgcttggaagctaatttctagaataaacccttgctaccacatcttgtgatttttgcccttctgaaggtggagttccaaaataaaaacaaaatcccgcttaactgagggttccagttgagggaggtctgctgccatggtctttgttaagtgcctgccaccatggcccacaattagtcagttaataaagggttcttgatgagagaatttggcaacatgtgattttccacaaatataagcttgattttgatgcaaccactcatttctttgaaaaatcagggggcattcacacacaggtgttctagatttccttacagtaaaacctaccctttacaaggaatagctgtgttcactttgaagcagtaaagaagcaggtgtccactcatggcaaatgaggaactccctttttttttttttttttttgagacggggtctcactctttttttgtgtgtgtgagatgggggccacccaggctagagtgcagtagtgcaattacagctcactgtagcctcaaccttctgggctcaaccagttcttcccacctcaacttctgaagcagctgagactacaggtatgtaccaccatgcccaggtaatgcttttgatttttagtaagatgaggtcttgttatattgcccaggctggtctcaaactcctgagctcaagtgatcctcctgcctcagtggcatgagccactatgcccagccagaagctaaaaatattaatcaaggagtcataactaaggatgcactgcacacccgaagccagggaccacaagaggtcagcaactgggactgcttcctccagttcccaggctggggctcagcagcagtggcctgggctctggggacttactttaagccgaaatcccaaactcattatcattcaaaccaattttctgtgtccagcatcatcccacctaaactggtccttaaaaccactgacagtcatttctccaatctgtaaaaggcctgctgaggcctttgcattatcaggacttaactgggagtagaatgccctccccatccaaatcctgaccatttctgaacactcagcccatgtcctcttcctgagtgtcttccccaacaacaaccacctacgctgaactttactttgatctctgcagcaaactgtagatagagatgggatctcactatgttgcctagctggtcttgaactactgagctcaagtgatctccctgcttctgcctcccaaagtgctaggattacagcagtgagccaccacacctggcctatgtatgcctttttttttcttttctttttttttttttttgagacagagtcttgctctgtggcccagtccgcagtgcagtggtgcaatctcggctcatggcaacctccaggttcaaggcattttcctgcctcagccttccaaggagctgggattacaggcacgcaccatcacgcccagctaattggccaggctggtctcaaactcctgacctcaggtgatccacccaccttggcctcccaaagtgctgggattacaggtgtaagccaccacacccggccacgtgtgcattttaaaacgttatgctcagacggggtctataggtttcaccagactgccaaaaggatccatgacacaaaaaaagtactctcagttgcatccttcggaacctttcaacacatacacatatacctcactcatccttttgtgaagagtgtctattaatcactagattaagaggatttggataaaatttataaacgtacaaactttgctaccaaggactgacacatttacttttctagctcatcagtttatgtcctagaaaaattccagagccatattaaccagctgtttcctatttttcattttacgatggtgtttccactttcacctgcaaagtgactaatagtaatacctattacagtaatttaagtaacaccatttagagtaatttcatctttagtactgtatttatactactaagaaagccgccaacgattcaagctgcactcactggtgaaaccctatgctatatacgtaattaatttatttcctaaattcttacctccctccaccccctccattggaaaataaactctaagaatgcaaaagtttttgtgtgtttttcttcaacgcttagagcagtgcctggcacctaacagtcaatatctgctaactttgatgaatgaatggtatatttatattatgcaatattactatgcagccatgaaacacaatgagttagagtggtaccagctaatttaatggaatttccagaagtatgaaattaagaaaacaagaagaaaagtgtcaaaaatatcatcccactttttttttcttccctgaaacggagtcgtgctctgacacccaggctacagtatagtgctgccatcatggctcactgcaacctcaaccttctgggctcagggaatccttccacctcagcctcccatgtagctgggactacaggtgtgtgccacaacgcccagctaatttattttaaattattttttgtagagacagggtctccctatgttgcccaggctggtctcaaactactaggctcaagtgatcctcccacctcagcttcccaaagtgttgggattacaggtgtgagccactgtgcccagcctaatcccactttttaaaaagtatacccccaaatccatacactggtgaggaagtggagaacgtggaatcctcacacacagaatgtaaaatggtacagctctggagaacattttagcagtttctcaaaatgtttaacgtagctactacatgacccagcaattcaactcccagatatacacctgagagaactgaaaggatatgtccacacaaaaatttgcagaggaacttgtacacacttgttcacagtagcattattcataatagcccaaagtggcaaaaacacaaatgttcatcaactgatggacaaataaagcatgaacaactgatggacaaataaagtatatcattcagcatataagaaatgaagtgctaatacatgctacaacaggaatagaccttaataacattttgctaaatgaaaaaagccaaacaaaaggtcacatgttgtatgattccatttacataaaaatacctagactaggcaaatccgtagagacacaaagatcagtgactgcccagagccagagggagtggtgaatgtgaaatggctgctaatgagtacagacttctttttgaggtattgaacatgttatggaatcagatggtggtgatcaatgcataactttgtgaatataccaaaaaccacatgaaaggtacactttaaaagcctgaattttaaggtatgtgaattgtatctccataaacctgtgattttgttaatatacgcttatttgcaaacgaatacatggataatgaggaataatatgaaaggttaatgacaaccttggtgatagggtacaggagactgggagaggaagataagtgttgaggtagaagaagacaaaaaataaaaggctaaaacaataatccagggccagaggccatgagttgggagatggagcaagacgaagtgtacaaagaaatgagcataaatcataaaaatgagggaactagggttgaaaactccagcaagtagtttgtaatgggggagatgaagcaaacctaagtaactgcaatgattcaacggaatttgcagaaaatgcagaagggcgagaaaacaatgaaaaaatggatcagaagatttaaaattggctctaccccaccaaagttttaaaaagcaagcaagaagaaaattcagttgctcctgggcaagaattcttgggcccagtggggtagaaccaaaccatgataaggagacaccagtgttttgtaagcaagagaatatattaaggagagaaaaggggcatttattgggagaaaagttctcactgtgattgttctggactaaagtagccccatcggactgcctcaggaactcatggtggaagaggtgccactggaaaatggctaagtcgggatcttccccaagaacactagaagagacagaggaagaatagaagagctttaaattttagcagatatttctttttcttgtttaattaaaataaatcttattgacctaatatttttgagactgggctcttgcaatgctccccagactgaactcaaactcctaggctcaagagattcttccacttcagcctcctgaaaagctggcactacaggtgcacaccactgggcccagcataatggctatttcttgacaaatcttgacaatgccaccagtatgtttttctttagagacagagtctcgctttgtagcccaggctggagaacagtggtgtgatcctagctcactgcagcctcaaacacctggactcaggagatccccctgcctcagcctctcaagtagctgagactacaggtgcgcaccaccacacttggcgaattttattttattttttttattatactttaagttctagggtacatacacctggctaattataaaatgtttatctgtacagacaggttctcgttatgttgcccaggctggtctcgaactctcggcctcaagcaatcctctcctcctcaccttccaaagccccgaaatatgcccacatccagcctgccaccagtttctttgcatacttctttcctaggcttgaccaagacctttactttcttctgtgtacagctcagcattaaaaaaaaacaaaaaagtttaggctgggcacaatggctcacgcctgtaatcccaacacttagggtggccaaggtgggaggtttgcttgaacccaggagttccacaccagcctaggcaagatggcaagaccacgtctctccaaaacaatttttgtaaaattagccaggtgtgctggcgtgggcctgcagtctcagctagtgagaagactaaggcaagaggaacccttgaacccaggagttcaaggctacggtgagctgtgatcacctctccagcctgggtgatagggtgagacccagtctctgaaaacaattaaaaataaaaaaagttgaataatgagtcttctttttagaggcaatgtatttttcctctttaactttttgttttccttaggctatatgcacaatagacaaagttgaaatttaatcttaatctcgtaaacccttactgtccaaacacatcaaactcaaaaaaaaaaaaaagacaaaaacaaaaaaggtgaaaggtgtacaagagaaaaaagggaagtaatctgtgccaaatgtacattccttccacaatttgggacaaaaatgatgtctacctggtctctgggtgccaaaataagacattagagacactcccctccttcaagaaataaaattggaatcagacactaagatacaattaaacagactttgaaagttggtatgcactactgggaggtgtctcacagctggcagggtcaactgcaactagaagaaaagctcctaagggcagaaactaagtggctcacttcctctgtaacactgccgtgcccagcactgtaccagcaccccagcagagtcaacaactttccgtcaagccacacacttacggtctcatcgtccagtggaggccgcagatgagacatagtgtgccaaatcccaaatgcacagggtgccagacaagtctgcgggaggcaggaggactagggaagccttccaggcaaggtgatgcctgagctgagttgtttttcttttgagtttggaacattaatttaatcggaggaaaacaagggacatgaaaagggcaaggaaataagaaaatgagctgagttttgaaggcaatgatcggatgaagtgagagaagaatattccagcagagggagacaaggagactgcagagatttcaaggggccaagagctgttcggtgcagctcagtgaagcacctaaacagaggtgggggaaggagaacaggggtcaaagcccagtattgaagtgttctggataccaagctaaggagaccttattacgaaggtactggggctgctgaagggtttaaatgggagagtgattgtgaacagattaatagtttggaaagatacaggcagaagtaaacctctggatttaaccaaaaaataaaggacagaaccacaatgaagatgttggaaaagatcaggaaaaacactgttaaaagatattcactctcggggccgggcgctgtggctcacgccttaaatcccggcactttggtaggccgaggcgggctgatcacgaggtcaggagatcgagaccatcctggctaacacggtcaaaccccgtctctactaaaaatacaaaaaaaattagccgggtgtggtggcgggcgcctgtagtccgagctactccagaggctgaggcaggagaatggcgtgaacccggtaggcggagcttgcggtgagccgagatcaggccactggaatccagcctgggcgacagagggagactccgtctcaaaaaaaaaaaaaaaaaaaaagagtctggctctgttgcccagggctggagtgcagtggcgcgatctcggcgcatcgcaatcccttcccagcccccgggttcaagtgattctccagtctcagccgccggagtagctgggactacaggggcgtgccaccatgtctggctaaatttgtatttttactagagacggggtttcactatgttggccaggctggtctccaactcctgatctcgtgatccgtctgccccgacctcccaaagtgctaggattataggcataagccaccacgcccggcctcttttttttctttttcttttctttatctggagactgagttttgcacttgttgcccaggctggagtgcaatggtgcgatctcagctcactgcaatctccacctcagcaggagagcaggaatcttcagtgatccacgggcagatctgccgccattgtgggcacctgttcctcccgcgacctttgtgctcgcctctctccttccagtacctattgcatgaccccccacgtccgcctcccgccattgccagcaagcgcctcgcgcgggtacctggctgcgcttattaatccgttaagctcgctctgtcacgggcgccgtgatgtgctcacgcgcccgctccctcaggtttaaaaggcgcgttgcccggcaacagaagaaactgctggcttagccgttggccgagttggcggctggacgaggacgctcagagcccagctctcgagagttcaagcaaccgacggttccccactgctcccaggagcggttacctgggcactctgtgcccctccttcctgttcgggcccaggccgaggacctgccagtagggctcagttgcctggagcccgttcagcccatcccccagttcactttgcctgtgggatctccccgttgctcctgcccgtggactgagtggcaggccatcctacaagcacccggacacttgacatcagtggtgtcaagacaactctaagaaggttttccgtgatcctgcaagccctgccttccttcctgggatcctgccttcaatttgattgcacaggtaccacagcaagccagtgctgtgtgctccgagttccagggcgtcctccagctcagccactgcactgagaacatggactctctgtggggcccaggagccgggagtcacccctttggggtccacaacacccggctgtccccagacttgtgtccagggaagatagtgttgagggccctcaaggagagcggggcagggatgcctgagcaggacaaggaccctagagtccaagagaatcctggtgatcagagaagggtccccgaggtcaccggggatgcaccgtctgcatttcggcccctgcgggacaatagaggcctctctccctttgtgcccgggcccgggcctctgcagacagacctccatgcccagaggtcagaaatcagatataaccagacatcccagacctcctggacgagctcctgcaccaaccgaaatgccatctccagctcctacagctccacgggaggcttgccggggctaaagcggaggagggggccagcctcatcccactgccagctgaccctcagttcctcaaagacagtgagtgaggacaggcctcaggctgtctcttcaggtcacacccagtgtgaaaaggcagcagatatagcaccagggcagacactcgccctcaggaatgactcctccacatccgaggcctctaggcccagtacacacaagtttcccctgctgccacgcaggcgaggggagcctttgatgctgccacctcccttagagctggggtaccgggtcactgttgaagacctggaccgggagaaggaggcggcattccagcgcatcaacagtgcactgcaggttgaggacaaggccatctcggactgcagaccctcacgaccttcccacactttgtcctcacttgcaacagggacttctggtctgcctgccatttctaaagcacccagtatggatgtacagcaggagacacacaagtcccaagactgcctgggcctactggcccccttagcatctgctgcaggtgtcccctctacagctcccatgtctgggaagaagcacaaaccaccaggccccctgttctcctcctcagatccccttcctgccacctcttcccattcccaggactcagcccaggtcacctcgctgattcctgcccccttcccagctgcaagcatggatgtgggcatgagaagaacaaggtgtggcacttctgctcctgcagctgccgcagcagcccctcccccctccacattgaaccccacgttggggtcactactggagtggatggaggcccttcacatttctgggcctcagccacagctgcagcaggtgcccagaggtcagaaccagagatcccagacctcccggaccagctcgtgccccaaacgaaatgccatctcgagcccctaccgctctacgggaggcctcccggaacgaaagcggagaagggggccagcctcatcccactgccagctgaacctcagttcctgaaacacagtgagtgaggacggacctcaggctgtctcttcgggtcacacccagtgtgaaaagatggcagatacagcaccagggcagacactcgcccccaggggtggctcccccagatcccaggcctctaggccctgtagatgcaagtttcccctgctgccacgcaggcgaggggagcctttgatgctgccacctcccttagagctggggtaccgggtcactgctgaagacctggaccaggagaaggaggcggctttccagcgcatcaagagtgcactgcaggttgaggacaaggccatttagtactgcagaccctcacggccttcccacactttgtcctcacttgcaacagaggcttctggtctgcctgccatttctaaagcacccagtatggatgcacagcaggagagacacaagtcccaagactgcctgggcctagtggccccccagcatctgctgcacaggcctgtagtcccagctactcaggaggctgaggcaggagaagggcataaacccgggaggcagagcttgcagtgagctgagatcgcgccactgcactccagcctgggtgacagagcgagactccgtctcaaaaaaaaagaaaaagaaaaaaaagttattgtgacatttctgtatgaaatcagccttcactacatggataggaccagcacgcttctgcggcacaactctgcaatcatactacatttttttttttgtattttttttattccttttgagacagagtctcactctgtcacccaggctgaagtgcagccgagatctcggctcactgcaacctccacctcctgggttcaagcaattctcctgtctcagcctcccaagtagctgggactacaggcacacgtcaaaaggcctggctaatttttgtatttttagtagagatggagttttgccatattggtcaggctggtctcgaactcctgacctcaggtgatctacctgtcttagcctcccgaagtgctaggattacaggtgtatgtttatttatttatttaagatggaatcttgctctgtatttattaatttatttagttgagatggagtcttgctccatcacccaggctagggtgcagtggtgcaatctcggctcactgcaacctctgacttccagtttcaagcgattctcctgcctcagtgtcccaagtagctgggattacaggtgcctgccaccacagctggctaatttttgtatttttagtagagacagtgtttcaccatcttggccaggctggtctcgggctcctgacctcatgaaccacctgcctcagcctcccaaagtgttgggattacaggcctaaggcaccatgctcggccatatttatttaattatttagagacaaagtcttgctctgtcacccaggctggagtgcagtggcgccatctcagcttactgcagcctccgtctctgaggtttaagcgattctcatgcctcagcctcctgagtaactgggactacaggtactcaccaccatgcagggatatttttttctattgttttatagagacacggtttcaccatattggccaggctggtctcgaactcctgaccttaggtgatctgacagcctcgtcctctcaaagcactgggattacaggcatgagccgccaagcccggcctctcactacatttaagtgacaccatggctcatgcctgtaatcctagcactttgggaggccaaggcaggtggatcacctgatgtcaggagttcgaaacgagcctggccaacatggggaaaccccgtctctagtaaaaatacaaaaattagtcaggtgtggtggtacaagcctgtaggcccagctacttggaagactgaggcaggagaatcactttaagcgggaggcagaggttgcagtgagccaatctcaaaaaagaaagaaaaaaaaaaagaaaaacatatgatgctggggcatctcggcctcaatacctgcatgagcacagtcacgtccaggccagggctgctggtcgaggtccggccccatctcttccagcagaaagggagtaagcttgcagggaggctgggggacaagatcccaggatctcagcctctgctcatggatcagctctgagaccccgagtgagctgggggtgctctgtgcgcattggtttccccagctgtcaagtaaagggattggatgaggaagtcttgtcaaggtggaatgatctcagatttggggcagcagtgaatgatcccgctccctgggcccatgccagtggcctggcctcggctcaacacagccccaacactctggaatggggatgagggggcagtcagctcttgctcctagtaagagagatgcaacagggctctgtggctgagctgggtgccttgcctcacacctgtaatcccaacctttgagaggccaaggcaggaggattgctcgaggccgggaattttgagaatagcctggacaacatagccagaccccatgtctacaaaataataataaaacacacagctatagtccaagctacttggcaggctgaggcaggaaggtcccttgagtccgggaattggaggctgcattgagctataatcgcaccactgcactccagcttgggtgacaaagtgagaccctgtctctaaaagaaaaaaaaattggcctgtgagcatgggtttgattttcaaacaggacctggagggtagggacagacagtgctgtcacccttaggtgctgaacactcagaaacgggccagcggcagcccttccctcacctgcagacaccagattgggcagaacagcacatggcacttgcagctcttgcagtgagggcagaacccagtgtcaacccttctgcctgtgggaggggctgctgaggcctgcggagaggccagggtggaggctcgtccccttgtccagcccttggcgtggtctccaccaggtccccagcccaccagtgcagggcgcccctgagcctgctgctgccatgggccctgtctctacccaggacgtccccacaccctcgcagtgtcagggaaatgatcatggtggcggtgacactccgcaggcagggctgctgagagaagctgagaagggtcacactgcaggcaggggcccgtgtgacaagcccctctcaccccgagagagctgaccaggcagctcacgagcagagccacatcccgggagtccgagaaaggtcctggctgggctcagccacctcattggccacgggcagcctttgtcatgtgagccttgctctcctggggaggctcaggctgacagctgatgtgggcattgccgaaggtaacccgtggcccagtgtatatggccgggtctcctcaagctgcattcattcaagtaggacccagggtgcgtgcccatctccagcccagggcagctcccctgtaagctgggtgagctactgaagccaaggcgggaggcagctgacaacacccacagcccatgcggaggtggtggaaaggctgaactcagcagcaacaccaaatcctggaccaggcaaaaaccacccaagactgaggggctcgtgccagagcggtggccacaggtaagaacccgggcccaggctgtgtggcaggaatcctccatgtcccagggcttagcatagcaaaggaagaccagccgggtcaccctggtggccatctgtccctgtcccacctgcagagtcagaacagcctctccccagtggggatcatctctctctgccaaagcaacagcggtccctgccccaaccagactaccccactcagtggagttacggatgctgctccagcatcctaacactgcccagctggtgcctgcctgtgctcacccacaccccccaggccggccttccctgcagcctgggcttggccaccttggcctgattgagcactgaggcctcctgggcacccagccccatcactgcacctgctgcttccagccccaccccaccggctcaggggttcttcccagcggcgctgatcatgaagtcaacatgcacgcaagtcgtctcaggaaacttcttaatgaaagtgtcggccacggtggtgtgtaggtggctgagctcagattgcagctgctaagacaccagccacttaccaagagaaagccaggctgcttcaaacccagggcccacggcaaaaaagcatcacttccggccggggagtctggaagccacgccttgtgggaggtcacactggcatctaggccttcgcctgcattgcagaaggagagccgggtccccctcctggagaacgctgcgttccccagccccacaccggctttgccaccacacaggctgttgaggcaggaggcgggtaagacgtagctgtagacccaaagcaaccaccagccctgggaccctgcgggagaggagcacttttagaacatggaaaagtgtggtcatcccatcattagacagcacacatcctacataaataaaaagtcgtatggggaaggaggttggggagggaataaaaaattggcacagacattgatagactggtttccagtttcaaggtaacagatgcacatcatgagaccagaggaggcagagacaaggctggatttggcttttctaagcaacatgtgttcctgcgcagggctgaatggtcgctgagacagagatggaagccaggacaagggagcccaccgggcccagataggtacagagagcagaggctcctgttctgtcctcgccacccacgagggtgacactgcttgtaaatggtggctgtgctctcccagcaagaaaaaagcacaactaaatccacactgcacacagacgcagacagaaagccttcaagtggctctgttttctgctccctgccttgccaggtccacaagcagagaggagtgtcaggcacatggccccgctgtcaggctccccagtgagctgcgggctcagcaggagctgcccactgacacacaggggacacccactcctgccaccttgggagcggttgccagacagagccgcactgggtgctggtgtcatccagggaccccacacacttccttaaatgtgatcctgcttccctctgcgcagctgcatcctctcctcctgcaggaccgtctggaaacttggctctcagtttgctctcccttctctcctctgcctgccccaagcccctctttctaaaaaagtgatgccatgttcatggggttatttcttgaaaatacttggcggcctccatgcttctgttttctttgagccaggtggtcaggagggcttacaaacaatgcctgggctcccccgcagctgtcggcagatggggtagcgaatggtcctgtgcctccacctgctccgggagggagtctcccgtctctaggcctagccccttcctaaccctccacgtatcctgttctccagagacttcagaacccactcctgagaacagcggagccaggcgcttagaggaagaccaaatgctgccaggacacggattgtccaggattacattccagcatcttattaggtatctggatctgttggggaaaaaattagaaactatgtataaaacttaaaaatattcaagcatcaaaaggttatttaggatgaaagttttaaaacaagtcatcagcaagctgctaccaccaagtggagacttatacaaaagttgagcgagtccactgagctgagaggacagaaatgaagtcacctgtgctggggcaggggcagggacactgggggcagggagtgtgtgggcagagaagccagagaagtccaggcctgtggaagccaaacaggagagcgtgggccggaagggcggtcaggatcgggggacgaggtcgctctccctggagaacgaaccctaaggtgcatagcctgggattccctccctggaggtcctgtcccccgacatttcacgggccttctgagctgccttccaaggaggactaacacggcaacaaaagaaccatttctgcacaaaaatccttctgggaagaaaaagaagaaagccaagaatggagtcaaaacgctacccagtgctgactaagcctctcaaaccctgttctaggtggactgtggtttctaagtcagggaaatggaagaggccccacccacacagggacagggccatggcccccacaggatgaagcagcagcgtttattcaagatacaacagtgagggaatccggtcacgttcccttctccccagagagggcgcttcttgacaagtgattcagtagaaatcttttagactctataagttaagttcataaaaaccactgctttcaccctgtctcccagggccaggcctggactccgagatgaactggtttggggcgccctcgggtggccacataaaaaacccacagtctgaggccagcctggggctttcagacctgggcgggatctgcccaggccacctgtccttctgctttgggccgctgtctcttggcagatggcctgacacctgggggtggcccaaggatgcctcagaaaatcttgattcccactctacagatggcctgattagccagaggtttccaggccgtctgtccgcctccaggagatggactgggacctttagacatcggtggagaacaggatgctctgtcccttgctgtccagggcagggatggcctccagccgcaagaagtacagcagcacctcgacctgccctcgcggagtggggaagaggagagtggctcagagcggggctcacagctgctggtggggaggtctttggggcccaagctcccaagtccacctcaggtgctagaaacccctgctggtgtcatgaaccccttacagtgggacgggggtggggtggggtcctgacaaggcatgacttgttgggtgaggggtggttatttattttagagatgcacagggccttgctctgtcccccaggctggagtacagtggctccatcatggatcactgcagcctctaactcctgggctcaagcaatcctcctgtgtcagcctcccagatacctaggattacagatgtgtgccccaatgcctgcctaatttttctttgtattttttctggagatggggtttgctacattgcccagactggtctcaaacacctgggttcagttgtcctgcctcggcctcccaaagtgctgggattacaggcatgagccaccacactcgaacacttggggtggttttaagcccccagcaaggtgcaccagcaggaccaggaggtggcctgggcaccccctatcactcccatccatgcaaacctaggcaagtccctgtctctgaatctcagccaccaccacatacaatgcaagtgggaagatgggcaggactgggggtggggcaggcagaggccacctctgtcaggctggggttgcatgggctggaggctgtcttcccatacctgggacatgacctccaaggaccagctgtcagtcatggtgatgggctggctggggttggcagggagcttgctctccttctcggagggccggagcagcgtggggccaaacaccgtgccaaggttgtgcagggacatcttattgactgcctccttctctgccatcctgtagaggaccgaagcagagggtgctgtttcaacgccaccaccaggagagaggcagaggggctgtgccgtgctagagtcctcagggagggagtgacctcgaccctggctgtgctgcaagctgactccagccttggtacttctgggtctcagtggcccaggacaaggggccagctctgggctgatggggaggtcttcatgatgtgcttgggagggaagggggggcggtccaaatgcactgctggccacggccaaagctctgagctctttgttaaggccacagtgcagagggaggagggtggcaaagaggagaggcaggggcgggggtggcagtggtgctagtccttagaagcagtgagttactgcagacaggggtcaggggataggtccgtggtgctgggggtctggtgggagcagaggggcaccccacggcctggagacctggtgtcctgggcagccacaagagagctgggctacctttccaggcggtctagaaggaaaaggaaggtgagcaggttggcctccggcagggacgacaacaggttgagcatgcagctcttctttgcaactgggtctgaaagagctgcaggaggcagtgggtcactcccctgggttacgacaagccggagacctctcccgaggtggtcacatggagcgcccgggacacgagtccttgcgcagtttaggcttgtcatcatcgtcacacccacagcgctggccgccagtgaggaccctgtgaggggcacctgtgtggggtgtgaaccacctgaacgccttttctctgcctcgcaggggtcagcagcacccggcaaacagcagcaggaggagccgctagagcagctgctcatgggcagagctgccctcgggcaactcctgccaccaccccctccccagggagcccaaggcaggggaggctcagcatggaatgaaacaggggagtgagggacacaaggaggtgggaagtgggagggtcccagccccaccaagtacgcagagaacccctcgttgtcctggacaccacaggggcacctgcaggctgggagaccaggtcctctgtgcatgggcccgggaggcagacctgccctaagggtgatgcacaggctacaggtgctgcacgctccagcgcccactctagacatcagcctccaggttgactaagggtcaggtcatgtttgaaaccatgcttggctggaccaggacccatggcaagagcacctgggcaccagtgtttagccctggtctgcaggaaggaggacagcagactttaggaccccacagcacggcagtgctgaccatttcacccacttggcctccttgagaaatatggatggggacccctctggggatgggcaaggccttccaggataggctcagttttggtcccctgctttttgaggttgggttaaaattccgaccatggcagaggaagcacagctcaggttcccacacctcacttttcacagcctctgagggcagcagtgcacgtggaggagacgtctcccatgaggccaaggcctccagtgctcaccgatgccctctgcgaagttggggtagaactcgtcagtgaagaggggctcgggcagctcacggaaatacagcttcagcgtgcctgcgatggcgttcacgtccatctcgctcatcatcaccgacacgtccttgttatctggaaagagcacggaaatgcagcggcctccttgaagatcctgagtgagtcacccaccatccctgccttggctaaagcaccgtccctgccatcctgaccactgtgtgggtccctcctgggctttgagcagctcatctgactcctcccaagagctgtgcatggttctgtgtctgcagagttgataggggtgcgtgggcattcccattcctctcccctgcttggcctgatgtgatggccaggaggaggccagcatggcaggacacagcgcctgcgtggggattgggtggctctgccctgtacatagcaaccacccctgcaccagtgtcatctgatagcaggaaggccgtgggagaatctgattggtttcagtgtttgaaccggtgtcttcctttggacccaattggccattggtgcttacatcctcaccacaggccaggttcattctgggccctcagagggagctgaaactaccacagggccctcccagggatgctgggcattctaggggtcctggtcagggtgggtggtctgtgctgcaaagaagggtctgcaggcacaaaatcctgttgctttgaagatgctgggaaggaccctctggggtctcagtgccctcccctggcatttgaggcaggtccgggtccttcaaagcctgtgagggttggtgagatggaggcggagaggctgcagccccggcctgcgctgaatttcatcagtgccctctgcccaccacatcctcatacagggcagtggacagaccgcactgagtcctgggcttccacctcctgtccaaccccaaggcaggaaggccaaggccccgcagaagcccctggtccactgcaccaagtggcacgagtgggtacgatggtgtaaaaactggcttctatagaagctgtttgtacaactcttgttttctcttttttaaaaataataaaacagtaaatgaagaaaagacacagagaaggatgtgacatgcctgggccgtggagcactctgagatctcatcgcggacaccactgcccacacctccatcccgtcctgcgcaggccgacactcactgacgttgaaggctgccttcagtgcctggatgtctgcggccaccccagacatgcggtagatgcccacctcctccatgcctcggcgctcgatctcctccacgcactggcgcacgatgtagggcaccttggacctctctctcctgcgggaggagggaatgttctcagtgtcctaacagccctgcttgggccataacacaggagacctgctccctatgtgcacacccggaggtggggtgaggacggtgatgaaggtacccaggtctggggctgcacacagagccttctgcatgcctgtcctccctctgcaagctctgtcctcattgcatgtgctttctcaggaacctttcaagcggccagaacccctgcaaatcacacatgacctttgtgggaaggtcaggaggcctgtctaagtcaagtcagcacgggaagggcatctgacagattccaggcctggggtgagcagcctgtgcccccggctgggaggtcagacccggtgttggtcctgccacccacgtgctgtgtgagaggagaatccgtgacccctgccctgggccttaacacacatccgacgaatgaatgaagggttgcctcagcaccggtgctccaagtcctgcgatgctaagtgcttttctcctctgagtcttagcaatggacaattccaatacctccacacaggacactagagtaagaatccttcacagttagaacgcagtgctgtgcggaggccttaacttgagttctgttttgcacctggatttaccagcacatcaaagctgcttcgcaagccccctcatcagcagggctcatgtgggggagctgctgatggagtcctcgctgctcatgcccacagccctcccagagtgctatgcgagtggctgccgtgcagttgggggtggggcgtggtgtttagacacagataggagtccagggtatgactgatggaggccccggcccacgtgaccagcaaggtcagaggcccagccagattccatcctgaggaagcaaatgaattctcagaggaagtggtctgtgtctgcatgaactgctctcaaaccaacaaataggcttctcttggcaactgactcgtgacaaagggttcaagattgtttgaaaaaaaaaaaggggggggggggacagggaggcagtaggtcctggaaaagtaaattctttattttacaataagaaagtgattacatattttatttttttttacaatggtggaaaattagaagtgattgtgaaaatgatgtctacccgccttgctgatgagtaggatgtgatttggctctttaggaaactgaatttgcagaacttaagaatattgatttataaagggcatggccattgacccagtccatcttatgcaaatctggatgccataaataatatttaaaaatgaaagtattggggtggaggttgcagtgagcggagatcgccccactacactccagcctggtcaacagagtgagactctgtctcaaaacaaaaaaaaaaaaaaaaaaagaagaagtcattcccaacattgctcatcaaattatgaccataaatttccaggatcagactaacggctaaagagactgatgcatcaacaccaggcagagaataaagcagattttttttgttttgttttggagagcctctaggaacttgaaaaatacatatgccacactcttaagacccggtggttcttaatcagggatgttcattaaaatgctggaaaactctaaagatttccaggtcccatccaaggagattttgcttctgattgactggctagtggcctggccattggtattttgaaaaatccctccaagtgattcttttacatcccagctagaaaaccctaaattaaaggtgaaaaaccagacaccaagtggcatttaaataaatgtcaactttaactccacaaagcatctggttgcatgtggacagaaagagaaggaaagagggccctatatctggataacttggaaatgtgctccccctagcaagatatctaccaaaattaaaaccatatttgaggatgctggcactgtgagcaatatataaatgatgcatgtaacatcatttaatatgatcttatttttaaaaatgagtagagtggtgttttctagctgttagtgtttccaaatatcaatgtagaaattagccttctgcagctgcagaggcaattcagtttgcagcttgcttgcatgtggcctagagccacccagcctgatatgtactaattttttatgtttaacttgccagagtagaaactcagtttctgggcgaggcatagtggctcatgcctgtaatcccagaactttgggaggccaaggcaagcagatcacaaggtcgggagttcaagaccagcctggctgacatagtgaaaccctatctttgctaaaaatacaaaaattagcccggcatggtggcaggcacctgtagtcccagctacttgggaggctgaggcaggagaatcacttgaacctgggaggcagaggttgtggtgaactgagatcatgcccctgcactccagcctgggcaacagagtgagactccatctcaaaaaaaaaaaaaaagaaactcagtttctggttacatctgatctttattttttatatatcatctaagctataaagttatattccctatttgtgatcttaaaagaaggactccaggaaagtgttcaaatattcatatatctaaactggaacatatgtttatatttttaaaagtagcctgagaggttggcaactaaagtcatatgttgaatgatcatttctcaagagtttcattttatggtctttctcttgttctgtaaaatgtgggcatggatagatataaagtgcctggtgtccatgcttttgtgaaatcccttcctcttccatgtgaatgggacctgtgactttcttctaacccagagaacacagcaaaaatgatgtgatttatctgagtccattgatgacattgattacgacttcccttcaccacattatttaggactgcgtcgtaggagactgggacacatatccactttgctggcttgatgaagtaaactgctaagttgaggaagcccacatggcaaggaactgtgggcagccttcagccaacaggcagcaaaaagctgagctcctcggagctacagcctcaaggaagttacttctgctaacaacctgaaaaagcttggaagctagtttctctctagtggaatttttagggaagagcatggcccaggcaagataaataatgtaagtggaaaaacctgtcaacaataaaggttttaaaggaaaaaacaaaaaacatgtaatttagaaagtaactgccaggaaaaaaaaaaaaagagactgggccagtggcttactacacctgtaatcccagcacttggggaggctgaggcgggtgaatcacaaggtcaggagatcgagaccatcctggctaacacggtgaaaccccgtctctactaaaaatacaaaaaaaaaaaaaaaattagccgggcgtggtggtgggcgcctgtggtcccagctactggggaggttgagacaggagaatggcgtgaaccccgggacgtggagcttgcagtgagccgagatcatgccactgcactccagcctgggcaacagagcgagactccatctcaaaataaataaataaataaaatataaggtctcaggaacgtaaagattgacatttactcccaaactattaatatatgtccacccacctttcttgtagcaaaatcttaacttgacgtttgtttcaatagttattaaatttaattataatgtcctagcccaaaatacagtagaggtaaacatccaaggtactggcttgaggccactggccctgtatctataaaggagagggagaccatcaggggagggagggtaagaaagggaggaagagggcaaacaagttatcaaaaaacaacagtaggcagggcactatggctcatgcttgtaatcctagcattttgggaagccaaggtgggcaaattgcttgcactcaggagttcaagaccagcctggacaacatggcaaaaccccatctctacaaaaaatcggccaggcctggtggtgtacgcttgtaattccagctacttgggaggctgaggtaggaggatcacttgagcctggaaggcagaggttgcagtgagccgacatcatgccactgcacttcagcctgagtgacagagtaagaccctgtctcaaaaacaaacacatcagttattcatatttcagagtaaggacaaaacatttttaagtagctggcaaaggacatcactatatttcagagtaaaacaaataggaaatgcttatcatttgacatatttttaaacattgtatctgaaaagtgaacaaagaagtgaatgtgcttatgattaaattgactttgttactttgtaaacttgtagctttagacctgtctcttagcatcaccaagccttgatcttttcatctataaaatgggcatggtaatgccagccttgctatgtttataggtcacttaggaatgaggtatgtatggtgttgaccatggtttctggcaagtggcatatattcattataccatagctcttttcagaaagctaagtcaccacgtacatgttaatgcaacctgctgaaaataggcatggaaaaactagaaaatctagaaaaattagaaaatcactgaagaggattttctttaaaaaaatacatactttaaactcgggaggctgaggagggagaatcgtttgaacctgggaggcggaggttgcagtgagccaagattgtgccactgcactctagcctgggctacagggcaagactccattaaaaaaaaaaaaaaaaccagcaaaaaacaaacaaaacataatgcatgttctctcttataaatgggagctaaacatggggactcattgacttaaagatggcaacaactgggaactgctggatggggagggaggggaggggtgaaaggccaactgttggggagtatgctcatatccacgtgacaaacctgcacatgtgcccgctgaatctaaaataaaagttgaaagtagatttaaaaaaccccaagagggctgggtttggcttgtgtgtccatagcttgttaacctccgctttagatattaactaatagaaacctagtgcttatcttcccaggccacctattttgttcctctccaaggtgatggatagatgaaggcctaatccagccgcctggaagtttgctgacgcttgtcctgtcacagattaatgaagcattgttttctgatgaagctttcatgccgctgtgctgatgtgtcttctcttctctctaggcaggaaactgcatatcttctggtttacatgaagatggagtgctaatggaaatgcccaaaaccttcagagattgacacgctgtcattttccatttccattcctggatctacggagtcttctaagagattttgcaatgaggagaagcattgttttcaaactatataactgagccttatttataattagggatattatcaaaatatgtaaccatgaggcccctcaggtcctgatcagtcagaatggatgctttcaccagcagacccggccatgtggctgctcggtcctgggtgctcgctgctgtgcgagacattagccctttagttatgagcctgtgggaacttcaggggttcccagtggggagagcagtggcagtgggaggcatctgggggccaaaggtcagtggcagggggtacttcagtattatacaactgctgtgaccagacttgtatactggccgaatatcagtgctgtttgtaatttttcactttgagaaccaacattaattccatatgaatcaagtgttttgtaactgctattcatttattcagcaaatatttattgatcatctcttctccataagatagtgtgataaacacagtcatgaataaagttattttccacaaaaggactttgcagttttaacggggggcagtagggattgtgctatagaaattcaaaggcaagggaagtcacttctgttgtggggccctgggaggagcctacaggctggaaagggttaaggtggaggtctccgataggggcagcgtacacagtggactggctgcaaaaggccgtgctcagcattcagacagcatcacacactccgcttttctctaccagggaggcaggtggggaaggatagcgatgggaaggcaggcggagctcagaatgtggaaggggatccagtaaggcttggaagtttgcacctgatctggtgggtggtgaggagcccttgaaggggcaaggaggtgagaagcactcagctgtgttcttacactgatctgccactggggttagagacaaacgtggtgggaatggaaagccacgcacagtcactagcgcctctggggggagaatggatgtggctggtgagagaacaggggggcccagggagagtccggcaccaacctggcggggggagcccagtgggtgtgagcacccccactttagagatgaagtgatggagacattcagatgtttaaccccttgttcaagattccatacttgataaatggcagatcaaactcccaacataaaatgtgggtcatttctttattattttatttgtattggttaacaatgatcagccatgcaagaataaatgattattgtaaaatctgcaaacaatgtagatatgtagagagtcccttccttggagcttgaccttgtcagacaggtatagatgagtgttccagggcagccgtaaaaactgccagagactgggctgcttataacagaaacgcatggtctcccagaagcccacattcaaggtgtccaaaggcctggctcctggaggctctggaggagagcctgttccctgtctctcagcttctgccggttgccagcaagtgttgccgttcattcactccagccactgcctccatctgcacacagcaaaacagcgtatcctgaagtgctcaaccttatagccattattttaaaatatccggaacacacaggaccgtgggagtggctgttggagaaattttcatgaaggaagaaagattacaactaagttttaaaatgctagttttgtttgttttgtcttggagaggaggtaaaagtgggagtaaaaatagggagtttggtgtaaggtgggaaaagcaaaggaaccccgcatggatgggctgaagggtgtgatgggagaacagtgagaagtacgtttggggaagcaattggaaatagtagctaagcttaatcacaatctatcaaaagggacttgttgaagaattaatgtgtgactaggaacagggaggttatgggcttgtcagctcgacagcgggcactcagttccactaacgaatgatgcccgtgtggacagacagaatgatggacaggcagatgaatgcgtgggctttatgtgaaacaggtcctcttggttgttgacaagatactgttttaaagttccattttgccatacttcgaacagcttgtcattagctcaatttagccacatgtaaaatcactaaggcggacttccagagttcccacatgaaaatcaaatgtaaaccagcagtgacctgcttcaacaccatcatcggaagtcagaagttgaactcttttttgatgtttaaagcctgcataatattcgctgtattattattcagcatattactatttccttcgtgatggaaatttggtttatcccaattttctattctatcaaaacaccgctacatagaaaatccccatgcacatatttctcctaattgtggaaatattttacataaaagactctagacatgggatgaaattcccaggttattggaattttaaaatagataggtacttccaaattgacctcttacaaattatatgaattcgtaagcttccaactgttatggagttacccattttgagaaatctgtgctaaaaggacccaaacaatgctgatgacaatgatcaggataataagtacgctgggaagacaacaaaatgatttagatcttagacaagtcattctaggtgtctccactgtttcagttcttgcgttcgttcattcttgtgctttttcgttttaccaaataaaatagctccttgatgtcatatgaatccacgctatgcttaatgagtattggttagtaaaatgcctataactagtaatcttcatctatgcaattaaatattaattcataaaacacttcaaatgtaaacaataattagtaaatgaaaagtacataatacctcaattagaaaaaaatcactccattaaaaagacattatttgtgtgataaaagagattgccatttttgtatttttctacaaggttaaagaaaactaagtcaacttatacaagtgaattttaaaagactttagggcaggcgtggtggctcacacctgtaatcccagcactttaagaggccgaggagggcagatcacctgaggtcaggagttcgaaaccagcctgaccaacatggtgaaatctcatttctactaaaaatacaaaaaaattagcccagtgtggtggcatgtgcctataatctcagctacttgggaggctgagacaggagaatagtttgaacctgggaggcggaggttgcaatgaaccaggatcgcaccattgcactccagcttgggcaacaagagtgaaactccatctcaaaaataaataaataaataaataaataaaataaataaaagcctttaacccagaatgctgagtaaattggccaaaaatgctaacctatgcatttcaatactataggagtcgcatgggtagaaataaccagatgaaatacttctggtatttcaccttcccaacccacacgagccagtgtttttctgtgaataacaaaaacagcagaatttacttgcctctccataagaggttaccacttctgtgtgttcccccgaaacaggtggtggctgggtgagaaggtggacagcactagggcaggagatgggggctccagtatcgtgggtgagcttcctaaacctctgcaactttcagcccctaaatgggatgagccatcagaatttttagcacaatgcccagaacaaagtaaggatttgacaaatgacgcctctctccacattgttctgtcatcagccaccgcatcctgtacctccaagcccactgggctccggctgtttccatcacatggagaatgactcagagcctggcctccagccaccctcctggcctttcttcttctcactctgccactggctcctcatggaccaccagcctgggtgtcctcagacataccacacacttcactgtgggagtcacgcagccctcaatgctccttctccagggagccacggggctttcctcctcaggaggactctgcaagcagctggatgaagggccctcccgtctctcatccttccttaatttttgtcacagttctccttccttccactcagtgcagtgcacactgattgatcctccatcttccccaaaagacaggaacagcatgagcagtggagagtagattccaatgatagaaaaaatagtcagtgatttctcatttccattgatcatcaatgaagaaaatgtatcctgaaggtcatgtacctcctatgggactgctgcatcctcagcctcctgaatttcagcccagcaccttcctccccagcacagcaacaggtcagcccttaccagcatccctctcttattgcctttgtgcagagccagcaccagggccaggggaggccttgggattgtccctccccaacaatctgtgaaacaatcctttatgtcaccaacaaagcacagccttctgcactggtggtcagtccctctcaacacctctgtcactgtaaagctggcaggcaaccctccaaggttggccttcccaagcactgcacctctaggtgacagagcacgtccttaccttgaagcctgggcgcccagtctatcctgtccaatgagcgagctgtggagaaggggggattccgggttaaggggagactagcagggctcctgcttttatgttgccctgttgggaaggctattaaagaaacataaagtgctaagcagtgaggatagaacatgttttcattatttcaaccaatacattccacagatggaataataagaaatgctacaaccaagctaactgaatccaacagcatatcaaaaagataatccaccatgattcaagtgggtttcatactagggatgcagggatggtttaacatacgcaagtcaataaatgtgatacatcacatcaataaaactaaaaacaaaaatcacatgataatctgaatagatgcagaaaaagcctttgacaaaatccagcatttctttatgattaaaaccgttcgtcacaatcagcatagaacggacataccttaaggtaataaaagctatctatgacaaacccacagccaacattttcctgaatgggggagagttgaaagcattccccctgaggaagggaacaagacaaagatgcccacgttcaccgcttctcaacacagtgctgttcactacagcattggttataagagcaagactggaaacagaacaaatggatacccatagcggggtgcttaagtaattttgggaatagtcatggggtgcagtactttatagctctgaaacaatacaatggatttacatttgaaatgtggaatgataactaaggtgcattgcccagtgatatatgcagaggtgcagaggactttgtgtaaacacgatcacacatcagcctgcattccaggtgcatgcttctatttgcacatagattgcagggatgatatgcaaacaaaaatgttgacttggtgtttggaagttcagagtggaagggaaacttccttgctaaccttttatgatatttagagtttctaaatgtgaatacgtaatacatttagaaatcttagttaataagaaaagcctctgttcctggcctcttgctggcacatgtcaggtggaaatggggctgtcatgctaatgtgtgcaaactgagaaaaatccaagaatgggagtctgcttttttcatcatacaaataattgttaatagaaacagtatgataattgctcattgatataccatgcatattctattagataataataaatttctgaaatttgaactatacttacacatggaaattgaaatatatggatgaaacattgtggcttatataggcaattgttttattggcattttacaaactgatcatcattcctcatggcacgggtccatgtgatattaagtagcttgttatgcttgggaaaggcagtgatgaccacaagaatgacttcaactactaaagtacaatggagatttcaacaatgttttgtttaatatttaaatatttcattgtgctcccaggctttttctcaccctaatagctctcatccatatcatgtgggtcccattaatacagataactccgaatgcaccactcttccattatatccagtcaattgctggttaccttgggcctaccaactgggggagggcaggggctgctggccacctcctcatctacagtaagagtcaatgagcagttaaatggatactgaaaaccatttatcctgctggagtgagaaataaatggtttctttcaatagcgtacgtagtaaaatgcatcttttccaaactatttatatgactcaaggcccatctcaatttcagatgtggttagcctcaattcctgattctcaccaaggtgtgtaatgtcatccacggcccagtgcagaggaacacaggtgctgccgtcagactgccagggtccgatcccgcctcctcactcaccccgggagatccctttaagccaggagtcaacagtgaggatggaaacatgagtgctttttaaagtcctgaaagttcagaggcaaactgtcaatttctcctccacccctgggcacacaccaggagaattctgtctccaggttggaggaagtgcctgtgagagagttgtgtctctcagattctgttcaccacaggtgacactcgatgcaaccccaaacctcttctgcacaatcccaaggggtgctgactaatccaacccaaaggctgtgatgtttggcagaggcagaaaagaaaaggccaggtgttctgggaaagaccacctttaaataacacagcaccctcatagcccagagagacagttctaactattatgccaataaacccggaaaagaccaaatccaatatgacacatatttcctgtttcgttttgatttcatgccccctcccttaacctcccaagcagcatggataacccgaaggcccctgggaactctctccaattggatcttacgtggaaagcagttacctacctacaaatccccatcatcagatatgctctccacaatcaaatctttagaaacacaaacaccaggataagtcattagagagaggcccacccactcctcccaccctagctgaagccatggtgcttcgcacaggatcccctggtgtttcctctgggctcacagatatccctacagcctctctggacatggttttatacttgcaaaatcatttgctctcaccagaccccaaatcctccttcgcaaaaggagcccagaatcaggtttctgtaccctagagatggcgctttttcctcaggaagtgagttatttcagggtacgtatcattctccagtgtcaatggctcctgcaattatagaaaagaaaacattaggagggtgaaatgatgccatacacgtcacacagatctgatagtctctcgacaacttgagagagaaaatatgaaggggtatagtgattgagtcaaaggtcgaagtcccccaaaactggcacggaagacacctgtggaaaagacaagaccttttcccacagaatttatctttaaagtgtatctagattggcagtttcacaactcttaatccatgggggaaaactgctgtggagggaaacacctctgcattgcagtggatcgtggatgctgccatctaccacaccccagtgtgcctggcatgggttggtgagaggctgccaatcaatagcaccacaccaagggaattgcagatgtcataaatagtccacattggcagatgttcatgtctacatttgattaaactgcagatgacatcgataatgcacactggcagatgttcatgtctacatctgattggaaagaagccaggaaagtaacatttctcttcaagacaaagaaaagtgtcttacattggcagcatcttcttttttacagatgtcttgtacagtgtcctcattagcaatgtcatatacagcgtccttattagcgaattcgtatacagcatcctcattagcgatgccatatacagcgtcctcattagcgatgttgtatacagcgtcctcattaatgatgtcgtatagagcgtcctcattagcgatgtcatatacaatgtcctcattagcgatgtcatatacagcaacctcattagctatgtcttgtaaagcatcctcattagcgatgtcatatacaacgtcctcattagcgatgtcgtatacagcgtcctcgttagcgatgtcttgtacggtgtccttataagcaatgtcgtctacagcgtcctcgttagcatgccttgtggatgccattagcgatgtcatatacagcatcctcattggtgatgtcttatatggtgtcctcattagcgatgttgtgtacagcgtcctcgttagcaatgccttgtacagtgtcctcgttagcgatgccatatacagtgtcctcattagtgatggcttgtacactgtcctcattagtgatgtcgtgtacagcatcctcgttagcgtgccttgtacggtgtcattagcgatgtcgtatacagcgtcataattagcgatgtcttatacggtgtcatcattagtgatgttgtgtacagcgtcatcgttagcgatgccttgtatggtgtcctcattagcgatgtcgtatacagcgtgctcactagcgatgtctttttttatatatatatactttaagttttagggtacatgtgcacattgtgcaggttagttacatatgtatacatgtgccacgctggtgcgctgcacccactaactcatcatctagcattaggtatatctcccgatgctatccctccccccccaccccacaacagtccccagagtgtgatattccccttcctgtgtccatgtgatctcattgttcaattcccatctatgagtgagaatatgcggtgtttggttttttgttcttgcgatagttactagcgatgtcttatacgctgtcctcattagcaatgtcgtgtacagcgtccacgttagcgtgccttgtcggtgccattagcaatgtcgtataaagcgccctcattggtgatgtcttgtacagtgccctcattagcgatgttgtgtacagtgtacttgttagcgacggcttgtagggtgtcctcgttagcgatgtcgtatacagctcgttggcgatgccgtgggcggcgtcctctttggcgatgccctgggcggcgtcctcgttggcgatgccctgggcggcgtcctcgttggcgatgccctgggcggcatcctccttggcgatgccctggacggcgtcctcgctggcgatgccgtgggcggcgtcctcgctggcgattccgtgggcggcgtcctcgttggcgatgccctgggcggcgtcctcgttggcgatgccctgggcggcgtcctctttggcgatgccctgggcggcgccctcgttggcgatgccctgggcggcgtcctccttggcgatgccctgggcggcgtcctccttggcgatgccctgggcggcgtcctcgttggcgatgccctgggcggcgtcctccttggcgatgccctggacggcgtcctcgctggcgatgccgtgggcggcgtcctcgctggcgattccgtgggcggagtcctcgttggcgatgccgtgggcggcgtcctccttggcgatgccctgggcggcgccctccttggcgatgccctgggcggcgtcctccttggcgatgccctgggcggcgtcctccctggcgatgccctgggcggcgtcctcgctggcgatgccctgggcggcgtcctcgctggcgatgccgtgggcggcgtcctcgctggcgattccgtgggcggcgtcctcgctggcgatgccgtgggcggcgtcctcgttggcgatgcccttgtcggcggcctcgttagcgatgtcgtgtacagtatcctcgttagcgatgtcgtgtgtggcgtcctcgttagtgatgtcgtgtacggtgtcctcatggggagctagaaaaacacagagttaaggtcagtgccctggtggtggagactgtgaatcacccaggggcttgcttggtgtgatgcatggaggtggctgatcacagcatgggtcaagctgatgctgggacatcctcccaggtggacctgcactagtgaagctaagggatgtggctcagaacactttctgcagtgggaatcagtttccaggttcaggtatgcattatctggtgaagtggggaaatataaaaaataaaaattgacaaattcatgaaaagcctcccatgagtgcaagtgtgagttttttatccactttacgttcagtatgcattcacacatacaaaatatttttacaagaaatcagaaattttaatttttgtcagttatgtgaaatctaacttagctgccaacataaagattctatctcatttacttggtctcgagaaaatctagcacatagtaagtagaccaaaatgtttattaaatgaaaacacagagcagagataggggggctgctaggcagactgggttgcacctgattacctggatgataataaactgcacaaaacctcagtcaaattaatattgaaactgccttttgcttgggctcgtttcccttgcggaagaaggatgaccaagaagatgaacaggaaagaaatgagaaacagaggcctttgcttagtagctaaaggccaccttctgtaacatgaaatagtctacaagtggccttgaactctgccgtgatttagtgacagagttccctcatgtcttctacccaggttgaagtccagcaaaattgcgactgtcctctttacaacttgcgagaccacactgcttctgcatttgcctgttgtatgtatgagatttacacttgttttagagcaacattttgtttcagttgggctggtggccatacccggcactagccggtcaatagtgagatggctcctcatggaggaggcttggcttgaggctgagggtctttaacccacatatacaagagagttgccactaagggatggaagccaggctaataaccaagtgccacacagagttcctatctgtccctcctcaccatttttggctggcaggatttgagcattttagggcttgggaagatagtattactaaatctactaaaatacatcacccatccttatagactttggccagttgctgagcaaattaacttcacaactgaagtgggccacactggcctttgtggtcccccactcctcttagaatttgtgagcgtggggcctactggagggtgggaggtgggaggagggggtggatcaggaaaaataactgatattaggctcaatatatgggtgatgcaataatctgtacaaaaaactctcatcacacatttatatatgtagcaaacctgcacatcctgcacatgtacccctgaactgaaaagttaaataacaaaagggatctgtgagctgagccaaacacctggggatctttgtgcttttgacacactgatgactatgccggtccgtggggagatgagcctataactgccctgggttgtgtgaccacggaggccactttatgatgatgggcagtgtctggggccttttgggctcgttgctttagggcttatacatgaatgctggactccctgtgtggtggtgaacaccccatgactaagtgcatgtcagcgtcagcactggtccacactcctgggttcgtgttttcactgtttcattcaggaactcgggagctggggccactcccttggcccttcaggttctccacctgagcagtggggataataaggcagacccggggatggctctggtgagggtggaggagtcactgtacagagagagtagagcgggggtggattttattgttagaagtggacactggtgattgggttgtataagtgggaaatctctcctgagaaaacacacagcctcacctgtacagaaacacacacattcacaccacacgatgcagcctcacacaagacaccaccaatcctcaagcacccaactcagcaccacccaaaagggagcacagctgcttcctcaaaatttggccataatttttccctggggaattcaggttttaaaaaaacacttcccctatacttattcctatcacaatcccaggatcagggtggctcttcacattgaaaccaggcaaggatgccacacctttcttggcatccagattgttttcttggcaagtgattccagaatacttactagattcaagcctcagaggggccacctgcaccacctgcaatacagaaacaaagctttttgaggggtatgtcatgttgtggattgtttgcacaaggctctgtttctctcaatgaatactgaaaacttgatcagaaagtgtagtcaacttcaaggcctccaaaacaagggtgggatacacactggaaaagacatcagcttctggatggtggatctctcaggtccacgtaggttggcaagtgcaaaatactgaatccaaggagaagacatcgcttccagggacaaggaccccaaggatacagtctacaacctgaagccggcatagctaaatgccattttggattacatatcagttgctaagagtcacttcttcctccccctcagaaaactgcatttaatacctgtcatggacattgtcattttttcacatgtaaagtcagttgaaaaagaaagacaccaagaaaggaacatttctatttcagagaaagcaaggcaaccttaccctcgcgttgactggcctctctccatctcctctgtccttgtgaactagagactcctcagaggctaggaggacacagagcaacagttagtcatagatgcttttgttcatgagttattcagggagctctgcttaatgtggacaacaggacagtgtgtgtggatgtgtttcattaaaagcacagcttgagctcctgctagaaaatcttccctcgtggaaagacaggcaagaacgaggagctaaggagcaagaaatagagtccctggcattttgctgatggcaacttaagaaaatgggaatgagtcagtctacaaatggtactgaagcacatgctatagtttgatgagagtcccactgctcacactgtgaggtttgaaacccagctaaatggttttctaaacctgtaaaaacaatattagcttgcaggatttatgtcccaagactacttttacctctgaggatccacagtggctgtcactgcagttatgtgttttagcattttgcacttgaataaaagcaaagtttaatagatagattggattcaattctaggcaaaacagtctatggtatttattcactaatcctttgttataactgctgatgggggaattagaagtactgaaattatatcctttaaaattaattaaagcataattattaatcacacaatattttttcatccaggcctccttttctttgtcatgcatgcatattaattgaggatggagaatatctacgcttgttcaggccagccaacatacgacagtttacttcaagagaggagacacgggttgaatgctggtgtgttttaactctgcagcgcaaacagttgcaacaagtgtggtgaactaatcaccagatggccctttgctgccttatttgtcattgtgccttacatgtagcttgcaggatttgattacgcttatgttttgtggtgatcatactttcaactattcctaaaatactgcttcagtcttatctgtttggggtcaactgctgaggatttcatacaaattaacgaagtttgtgaatctaaagttctacacaaaggtggaaatatttgcaaatcatttctcttgtaagagactaaaatttagaatatattttaaatatatttaagatatattcaaaaatctacaacaacaaactaactaaataaaaatcagacaactctttaaaaatgggcaaaagacttcaacatatatttccctaaagaagatacagccacagatagtagcacaggaaaagctgctcaggatcattagtcattagggaaatgcaaatgaaaaacacaagcagccaccaatatacacctactaggatgatttaaaggaaaataagtgtgaagaaggacgtaaagaaattgttaccctgatactttgatggtagaaatggataaagttgcagccactgtgaaaaacagtctgcagtggctcagaaggttaaatatagaacccctgttggacccaggaactctactcttaggcaccccaaagaatagagaacagaaatcaaacagatgtttgtatactaatgtttgtagcatcacttttcacaggagccaaaaggtggaaataatccaaccatcagtgaacaaatgaatgtaataaaagcaaggtggtctgcatgcaatgctacatcatccatctgtaaaaaacgaacatcattttgatagatgatacaacatgggtggacattgagaacattatgcttagtgaaataagccagacacaaaaggaatatattgtataattgtaattacatgaagtgcctagaatagtcaaattcatacaagagaaagtcggataggaatcaccatgggctggaaatagggggaaggtgctatactgcttattgtggacaaggtttcgtaagaaatcatcaaaattgtgggtgtagatagtggtgttggttatgcaaccctgtgaatatattgaatgccatggagtgcacactttggttaaaaggttcaaatgataaatattgtgttatatatatttccccatgatagaaaacacgcacagccaagcccagatgccagtcttgttagctgccttcctttaccttcaagagtgggctgaagcttgtccaatctttcaaggttgctgaagactgtatgatggaagtcatctgcattgggaaagaaattaatggagagaggagaaaacttgagaatccacactactcaccctgcagggccaagaactctgtctcccatgctttgctgtcctgtctcagtattccctgtgaccacctcctttttcaactgaagactttgtacctgaaggggttcccaggtttttcacctcggcccttgtcaggactgatcctctcaactactgaccatttcacctccattcatgtccatgccacatcaggctgtgttgtctagatggaatgaatccaccccaaatgtccctttctggaggaagccaccattatgctgtacctccaagcataatggtacgtccacacacaccagggcacctcgctcatgcaaggtgcgtgtcctctaacaaagtttcacgctctaaacccagataacttttcaaacccaagttctgttgattcccctactttgagtgctccatagatgctcatttgtctactaaacactgccccaggcaattaaatattccaaagtgaccagcagaatttttatgttaattctgacattgcgttgttagtacaagtgtttttcccccttcaaatttatgtctttgttactgataaatgtaactgataatgcgtttttcagctatgttgccaagcatatttatataaaaatatactcagattgttttcagaatttgacaaagatgatagcaacaatgataatcttatttgttttataccaatctttatgtgttattttcatcatttcttacatattggggcctaccatatattgtacagtgaaattagtgctatgcatcatggtagaaatataaattggcaaaagtaatttagaaaatagttcccttctttcttaaaaaaattaggctgggtgtggtggctcatgcctataatcccagcactttgggaggcagagatgggtggatcacctgaggctgggagtttgagactagcctgaccaacacagcaaaatcctgtctctactgaaaatacaaaaattatccaggcatggtggcgtgtgccagttgtcccagctactcgggaggttgaggcacgagaattgcttaaacctgggaggtggaggttccagtgagccgagattgtgccactgcactccagcctgggtctcagaaaaaaaaaaatttttttgaccgaaatgtcattatgcattacatgactgtatatgaatgctcaaagctacattactcatcaaagaaaataacaaaacaattaaatgtccattaactgataaatgaataaacactatctgtatgagtaaacacagcagactatgaaggaaaacacatgaccagcacgtgctaacacgtcaattaacttcaaacatagtatgctaaatgaaggaagtcagattccaaatatatatatatgtccatttctattaagcaaatgggaaatttatggagatggaatgtcacagcagtattgcttagggctggagatgggagtggggattaactgccagtgcgcaagagagaacttgggtgagggaaacatatttaaattagatggtggtgatgggtgcacacagtatcaatttaataaagcatcaaattgtagaccttttcagtgggcaaactttatggtgggttcacacccaatataggtgttaaaaataaattaatgttacggaaattcttgtcgggtttttaacaagccaagagatatgctgtgaaagcagaattaattcaaatggttgtcacaggtcacttaaagttagatagttgtcctacaaatatagggtgaatgttattcatgaatttcctgaatctattgcaataatcacattttttccattaaactcttgaggtagctaattttatttattgcattttcaatgttaatctactatttcatattttgagattaactcacattagtcagaatttacagtattttaaaatatcacagaatttaatttaccttaactggttttggtttcaagactatactagccatttcatttaattgtacatgtagggtattctaatttatggaaaactattacatcttccttgatttttttttttttttagaaattacttctagggatctatatggtagagtccatggagaattgttttaattcttcattcatgtcttcagtgggtataggattggtcatattggtcatagttttctgcttggatttcaataagaaacttgtggaagaacctgaagggtgggatctttgagggagcctaagacagagcaagacaagctaagaaggagggcagtgccacagcagaactgccgttgatgccccctcgcctagattgcggaagagacatccagctgtagacactgaggtgcaggaaaacaatggagcaccatcagagaaagcagtgcccaggaacaaggaggcactgatggtggcaaggggcaaagacagctgccacgaggctgttcacatgagggtctcaggctgcatagacacccacaccagctgaggggtcctggttttcataaagtgtgtggctcagccaggccaccaacaagcagttcacaaacagtagtaatacgacactttccaaagaccttacttgagtaacacggtgatcctcacaaatttccaatcaggatggtcgcacagttcctcctgcgttaggactcagagcctgcccgtggtcacagtgggtaggtgcagactctgaagatgcactttggtcagagaccctgctgaactctgtctaatgaggacctctgtcctgtctgctgaccaccggtcagaggtgcaggctgcagtggggagtaagaatgccaccttctcaatgttgggaaaactccctgccagaactgagaatggccctttctaagcagaaggcaagctcagactaaagaaggaggccgaacacatcaggttggcagattgccaaagattcactcagggagagcccacatcctgggccgtcttgggtggtggcaagatgaggtagacgactgcttttgcaacacatacctgacaacaaaaaatcaacaactgtaaaagagccacaaaatccccaaatatttgcaaattagcaatgcacttttaagtaactgttgggttaaagaagtctcaatagaaaattaaaaatacttttaactacattaaaagaaaatgtgacttggcaagatttctggatgtagcaaaagcagtccttagagggaaatctatagcattggatgcaatatactaaaaatcacaagacctaaaatcagtaatatcatgtttcaattagggaactatagaaaatagaggaatgcaatggaaagcaagtaaaagtaataaacaacatcacagaaatcaataaaattaaaacactgaaatcatcagaaaatcaataaaaccaaaagctggttctttgatatgctcattacaatgaatgaattgatatgcaggctaaccaagaaaaagaagataacacaaatgaccaatttcagaaataaaagaggagccatctctactgaactgttaggcattaaaaggaatatcatgaacagttctatgagcgcagtttgataacctcagtgaaatgtatcaattccttgaaaggcaatcttcccaaggtcatgctaggatcctaatttgaataaacttatgtctattaaataagttgaattcacattaagagcattccgaaaaagaaagcaccaggcccagatggtttctctcatgaaatctaccgaattcttcaacaggtgaataaaaagacaaaaattcatttaatgcaatattatttggtgatttaatgtgccattttttgccattaaggcataaaaaagacatgaaagcagctaaagcgtacatcaatttagtgcaataaattcatctgaaaaaactacataatatatgattccaactatatgacattctggaaaaggcaaagctgaagcgatagtaaaaatattaatagttgccaaggtttctggagaaagaggacagagattaatgagaagagaggatttttagggaagtgaacattttctttatgagaccataagggtgaacataatgttttaaatatttcaaaattcatatatatgtataacagaaagaatgaacattatgcaaatgtagacttcagataataatgtgtcaatattttctcattattctagcaaatgtaccacaataatgtaagatgttactaataggtgaaattaggaagtgagggtgaggagacagaataatatgggaacttcctgtattatatactcaatttttatgtatttatttatttatttatttatttatttatttattttgagatggagtttcactcttgtcacccaggctggagtgcaatggcatgatcttggctcactgcaacctctgcctcctgggttcaagcgattctcctgcctcagcctcctgagtagctgggattacaggcgcctgccaccacacctggctaatttttttggatttttagtagagatggggtttcaccatgttggccaggctggtctccaactcctgacctcagatgatctgcctgccttggcctcctaaagtgctgggattataagtgtgagccaccatgcccggccatatgctcagtttttatgtcaatttaaaactctctaaagaaatatattaattgaaaaataataatatagcaccactctttcagggagatctatgcttatgtttaacaaccaggtaagttctagacattagcttgaaacattgtctatcattaaacatgaaccaaaattgacttttaagtagatatttacttttgtggtggtagcaatatttactgaccaggcaaattagaatcctgacacattaaaaaatatggcttagtctcttcatagtttcctcttacatatgggacactgaatactccccgcaactgcaattcttgaatcaacttaattaatgaacttccacagtaccttcttgtgggtacctcttcttctttacccgggagccatgaggtctcctacactggttggtgtgcacagcatatcttcttgtattctctatcagagaagacgctggttaatgcatttacaatagatagggctgttgacatcttgctgacagaagaccagagggaaaatagtgataatctgttctaagtttaaacttatgatccttttctttacaggcttccaagcagagcccactgaatcaaagttgggtttcaggaagatcacggagttcagtgagcactcaacacctctatcagacagactgcgtgggcagtgccttcctggagaggggaacacagccggatgactgtgagtgcagggctggtgcagagtgggggcccggattcaaattccactaagccatgtggacctggcaagctcatgtcctccctctgccctcagttctctgcactgtcataatgtaattttagcaatactttttaggccctatttaggccctacttcttagtatcacagtacagggctaaaaaatcactaaatacaggaaaaccttagagaggactggtacttcagtaatgttctctaagtgtttactacatgccaggaggaataagctggacacttagcagtggcggaatatggagggggaacttggatggctccggggcagtggagcatgctttcctgttcggcttttccgtgggcatgacgccttatggtttatggagaacatcagccctgcagggggtgcagaggaggggctgtggctgagattttacacttgagggtgctgacattcagagatgataagtgacgagcagaacctcaaccccgctgagtgaaggacctgagatgggaaatgtatttggttccctagagagagagattcctgaaaaactgccacctcttcatcatgccctgtgccagagacccaagagacccctcactgtctttctccagtcctcctagcccaaggtgtgtgggtggacaaaggtggtgctctggaggaaatgcctgagataaggacaggtccttaatgataaagaattctccttcctctttcagatccttgacctcccagtatgacagcttaaaggctgtcatctctgtggcctgcctccccttgcccttcaccctgccagctgcctctcagtgactgtctcctccagtgactacactgagggaccagggactgcttgcctcccgaggctgctcagaccttccgacaccgcacaatgattgtcaaaagatgggtctgcaaagagtaacttcccttccactgattaaacctgaatatgcaagctactgtgaattaactggaaaagtggccgtgtgggctggtgctttggtgatttaatgaattaagtctgcaagccccactgcctccttgactattgatcagagctgcctgcaataaggtctggctaagaatgggcagtggctgcaccagctctgggtaaaatttgacctaaaatgaccagtctcattcactaacctcaccatagtcttatgggttcaatggacctgtccaatcctttgctctgttctctccatcaccttcctgtgtaattttcctccaccatgcacataatagaaacatggcacaggggagctaatcacctcttttatcccccacttcaggctcacacataagtttatagtaaaagccttttcaaatgactgctttaactgctgctacagcatgtgtcatcagttgaatggaatctgtcacgtgactttaagcaaccctttgctgagagacaagattcaatactagggacagtatcctagtgtactacatcattgattttatgttatgaagatcatcatttattgaaaatgtataaataacgaagcccagccttactcttcaacgctgtgtgtgtaaatccactgagtgtgctgacccccacgcttgtacccacctgctaacacagaaagggtccactcagaaggcaggcacagctccagcactgaggctgtccacaccagcttcacaagagggttgccacaaggacgacggatacccggataacaaccaaatggtaatttgagtacttaatggtcatgatccctaaagtgtgtagctcagagggcttgtggtgataactccatcaagactctaaagcatctccccaattcttactggacttgatccatgtcttgaggagacccagctatgacacgcaggcaccacgttgtcctacttagtgcctcccttagtgtttcagaacctgtgatttgatcagaaacatgggctttctatgttggtttcacactaaggactatgtgacacctgcaggaagatgtctacatagctacctggattatgagatcatgaggctgtcttatgtgagggatggcgtttgggatctctgcaggcgtgggtaattccaggcatagagggtgctggaactcccttgcatggtgaatagtgatctcttcactggctgataaatagaggttgtagttcaggccttcaacattagcaccgtatgagtaaacattttgactcttcactatgcagcaagtgaaccagggcacatttatttatgtggcttagtttctccatctggcatgtgggctcaataaacaagctcacaacatatgggcatgatgatgatgaggtgtgaactaatgtaagtaaagtatgtggtctgatttgttaaattaagaaaaatggcactgacagttgtgctgggtaaacacaacatttttttcctgggggaaacacacatagacacacattcacaagcaaatcatgcagacttgcacacagaccacctcaccccacccccgccctaatacacacatacccacacacaacctaatgtgaacacattcccagaaactatacatagataaaaagagtatgtcacctggaaaaccagtttcttttactataccccacatcctcattcccaccagatgtcttggatcatggaggctctccagacaaaagccagcagttaagctccagatttcctatagaatccttttctaacaaccagtgagtgattccagaatacgtaccattgaatgtgctccctgacgtcacctgtaattagagaaggaaaacactctgagaatcaggctatgctatggatggctcacacaggtcttttgttcacttggaaactctgggtaaccaagattggaaataaggttcaagtcaaaagccccaactctagagtagagttcccttaggaaagcacaggagcttttgttgaagaatgtttctgtctaggtaatttttgagtagcaattgcagaattcttatctaaagtggaaagcttgttcctgaagaaaacatctcttaacacgcagtgtactatctgacactgccaattttgcacgtcctctggaatcaggtgtcagctggtaaaatacacctcctccatccccaaggaaatattatctaacatctataatgtagtggataattttcccatagctgatatcaactgaaaaataaaggatccaagaaaacaacatttacatcttaggcaaagacaggctactttaccttggtagtagagtagggctgccttttcacacgcctttgggaaggcttcttcgagtcacctaggggatgtggagggacacagcattgctgtcagttcattggcagtgctactcatgaatgactcagggactggaacttaggggcgtgcctggttaacaagcatggaatgagcttctcctggaccatcttcttcacggaccaaggaaggcaaagaaagagcagcaaggaaatgagagtagagcccttggctttccaggtaatggcaaatgaaagcaatgtgaaataatcaaactccaaatgaacaaatgctaaaatacatgctaggattcaaccacagcatcctgtcacttcttcagaccctttaaaagcccagcaggactgccactaccttcttgacatctaccaagtccctttcaacctccacagacccacatacactgctactgcatttatcatggagggtatagggttctgccttgtttatgtgtgaattttttaaaaactagatttaatactatacaccagcattaattatatttatttcttttcttggttatgaaaataatcagtcaggcatagtggctcacacctgtaatcccagcagtttggaaggtggaggtgggcagatcatttgaggtcaggagttcgagaccagcctgaccaacatggtaaaaccccatctcaactaaaaaaaaaaaataaaaaacccagctactcaggaggctgaggcaggagaatcccttgaacctggaggcagagattgcagtgagctgagattgcaccactgcactccagcctgggtgacagagacttcatctcaaaaaataaaaaaataaaaaatccggccaggtgtggtggctcacgcctgtaatcccagcactttgggaggccgaggcgggtggatcatgaggtcagaagattgagaccatcctggctaacagagtgaaaccccgtctctactaaaaacacaaaaactttgccaggcgtggtggcacgtgcctgtagtcccagctactcgggaggctgaagcaggagaatcacttgaacccaggatggggaggttggagtgagctgagatcatgccactgcactccagcctgggcaacagcgcaagactctgtctcaaaaaaaaaaaaaaaacctcccctaaaaataatcaattattaaagattagaaaatactgaaatgcttatattttaaaataaccactctaaccgtacattttccgttcagtcttcctttgccctgtgtttgcagtcatcgtgtgaggggctggccatgttcagcccaggcaacccacagccagagagggcagagcggggagatgggccctggtgagcactgaggctcttcaaaccagctgccaagggagttgcaagctgggtgacacatgaggctcattatttagtggtattttatgttcttacttgtccccagtttgtgtagctcacagactttttttttttttttaacatttctataggggtcatttgaagttcataacgccatcaaatatcagtacagggtcttcccattatttaccggctttgggatatgtgctgaggagtggccgcgcactgaaggaatgtgaccggttgtcccaagtgttgtcctccaactcaaaatccgcaaccagttcaaaagcatttgggcttttatgtgcctttcacataaagactatgacacagctaagctattcatgtactaatacctgccctgagctgtgtgaccacagacaccaccctataatgtgcccagtgtgtaggaactctacaggctcagatcattccacacatacatgcagatgttggaactcccttgcacagtgactcatgatcccaaggctgagtgctgagggcaggtcagtagttcagagcctcagcattggggctgtatgcttgggttcccatcttggctcttttgctgaggggctcataagcttgggcacattcatctctgtctttttctgcccagcgaaaggtgatagtaaatcaatcatgccatttgtctgtggtgatggccgaatgatttgatgtaggtaaagtgtacagtataagtgctcatgaggcttaattatcagtgaaatgtcttgctttagatttcacagcttaataaggctcagaggcttattcacgcccaggattctgacctcccaagtcattgttctatgacatacacctgcttggcctaaaaccgaccactttatcataatgcagacccagttttgaaagaagcagataaagttgtcaaaagtactgtgtctgcctcagcgcacactcagtgcgctccacacaaagggcatcaccatctgccacaatggcccagtggcctggctggcacagacagtggcagagcaaagggcaacagatccctaatccaatcaccatggtcgatagggcatcatagacattccagggtgaaggcacaatccacattgtgaggtccaactgctgccatgtagacaggtgtgtttttacatgtacaggaagatcattgaagataagtgttttatatccatggttaacagatgagatgaccatgaaatgaacaccagtgtactgggtggagcagcttatctattcagtcttctgcactaaaacctgtgaaacaatatcatcttgccttatttactaacaaatacaagtgcctctaaacttagacagtttccaagtcatggaactgatgagcacttagctcctgcagagagctctggatgatgggtcgggagaacaaagacacaatacatcaaaacagcattaacaagtaaacaggttttcaaagctctctacatgcaaatttacacaattatccttttaatttttatcttcatatatatgtacataatctacttgcttctgagtataaataaaactgtatgttcttagttaatagtctctaccaattcattctatttatctttctgagttgaaatactgcatctcattggataacaaaaaaaaatttgactaagattacactggaaaggtgagtaggttgggtaaatgactgtgattgacaattccatgattttggagaagtcccaaagcataaaaataaatgtgtgttttatttcacacgtagacaatacacatttttattactttaaaaaaataatatgtgaatggaaatgacttactacaaatttattaacgtaaatacacatttcacaaaaaaagaagagaggaagggaaaaacatgttaaaaacaaagagaggtacattttattgtgtgaaaagcctccaacccatccatactactgtggctttgttccaaagttttggaaagtaatgatttcataggttcttaataaggttaaaaactgcattaaaatagactttgccacattctcccttagggaataacttaatctgtagggtgggggatggaacgttgaaggatgcagatgtaaaaggaaattatatatatatatatatatatataatatatatacgtatatattatgaagatatatgtatatatattatatataattatatatataatatatatataatttgggaatttgggaataaattgtatcccaactcacactgggactacaccagctgccaccatgcctggctaatttttcgtatttttagtagagacagggtttcactgaattggccaggatggtcttgatctcctcaccttgtgatcctcttgccttggcctcccaaagtgctgggattacaggcctgagccaagatacatattttttaaaggaagaaaaatttcaaaggtactctgtttggtacaataatcaaatatataaattgaggaataaaacataaccacgaaacatatttataactgcatatggaaaatacagaggataattttttaaataacatattttgaaaaccttaactaggaatttgaaaagatcgcatttgacaggccagtatgaacacaacttgaacgcagcaagacaggttccccataaaaaaatcaaacacagggaaaatgaaaccacaaagtttcaatctgctctgacctttgaaaaactcagcacagacagtggcacttaggaccaacagcaggagatccctaatcccatcaccatggcgatagggcataaacattccagggtgaagtcacaatccacattgggaggtccaactgctgccaggcagacaggtgtgcctttacatgtacaggaaggtcattgaaggctcagtgttttgtttcaaaaactgaatcccaagaccaaacattgttatgctgtgcttcttaaaataagttatgagatgggaaagagggcaccccaaatatatatatataattatatataatataatatatataatatacataattatgtataatataatatatataatatacataatctccttttacatcctgcatccttatattatatataatatattatatataataatatataataatatataattattatatatataatatatacaattatatatgattatataattgtatataattatatatataatataataatatataatatctattattatattatatataatataatattataatatatatcatatattataatattatatgtaatataatataatatcataatatataatatatactataatattatatataatataatatattgcataatatataatatatacaatatattatgtataatatataatatataatattatatataatatgtcatactataatatatattacaatataatatatataatattacatatataatataaaatattacataatatataataataatataatataatatgtaatattatataatatgtaataatataatatataatatattatgatatatataatataatatattatatcttatgatatattatatataatataatatatgataatatataatatattatgatacattatatataatataatatatgatataagatattatatatgatatatgatgtaatatatataatgtataatatataatatatataatatgtaatatatattatatattatatattatatgtaatatatattatatattatatattatatgtaatatgtattatatattatatgtaatatatattatatattatatgtaatatatattatatattatatgtaatatatattatatattatatgtaatatatattatatatgatatataatatgacattatatatgatatgacatataatatatattatatattacatgtatactacatatattatatatggtatataatatatactatatataatgtatataatagatataatatataatatataatacattttatataatatataatatataatatatataatatataatatatattatatataatataaaaaatatatgttatataaaatatatataatatatattatatatatataatttttttgagacagagactttttctgttgcacaggctggaatgcaatggcgccatcttggttcactgcaacctctgcctcacgggttcaactgattgtcctgcctcagcctcccaggtagctgggactacaccacactgggactacaccagctgccaccatgcctggctaattttttgtatttttagtagagacggggtttcagtatattggccaggatggtcttcatctcctccccttgtgatcctcttgccttggcctcccatagtgctgggattacaggcctgagccaagatacatatttgttaaaggaagaaaaatttcaaagttactctgcttgttacaataatcaaatctgtaaattgaggaataaaacataaccatgaaacatatttataactgcatatggaaaatacagagaataattttttaataacatattttgaaaacattaactaggaatttgaaaagatcgcatttgacaggccagtatgaacataccttgaatgcagcaagacaggttccccataagaaaaatcaaaatcagggaaaatgaaaccacaaaggttcaatctgctctgacctttgaaaaactcagcacacacagtggcacttaggaccaacggcaggagatccctaatcccatcaccatggcgatagggcataaacattccagggtgaaggcacaatgcacattgggaggtccaactgctgccatgcagacaggtgtgcttttacatgtgcaggaggatcattgaagtcacagtgttttgtttcaaaaactgaatcccaagcccacacattattatgctgtgcttcttaaaataatttatgagatgggaaatatggcacccccaaatatatatatatataattatatataatataatatatataatagatataatttccttttacatcctgcatccttatatatattacattatataaaatataataatatataattatatataatataatataataatataaaatatatattactatattatatataatatataatatatattatatattaaacaatacaataacatataatatatgttatatataatactatatataatgtataacatatataatattacctatgatatataataatatatattatgtataatatatcatattataatatatataatatagtatatataatatgtattatataatatctaatattatataatatataatatatcatatataatatattatgatatattatatataatataatacaatataatatattatatattatgatacattatatataatataatacaataaaatatattatatattatgatacattatatataatataatacaataaaatatattatatattatgatatataatatgtaataaaatataatataattatatataatataatatataacatataatatttatgatattatatatatataatttttttgagacagagactttctgttgcacaggccagagtgcaattgcgccatcttggctcactgcaacctctgcctcattggttcaagcgattgtcctgcctcggcctcccaggtagctgggactacaccacacggggactacaccaggtgccaccatgcctggctaattttttgtatttttagtaaagacagggtttcactgtatttgccaggatggtcttcatctcctcaccttgtgatcctcttgccttggcctcccaaagtgctgggattacaggcctgagccaagatacatatttgttaaaggtagaaaaatttcaaatgtactctgcttggtacaataatcaaatatataaattgaggaataaaacataaccatgaaacatatttataactgcatatggaaaatatagaggataattttttaaataacatatttcaaaagcattaactagcaatttgaaaagatcgcatttgacaggccagtatgaacataccttgaatgcagcaagacaggttccccataagaaaaatcaaaatcagggaaaatgaaaccacaaaggttcaatctgctctgacctttcaaaaactcagcacagacagtggcatttaggaccaacggcaggagatccctaatcccatcaccatggcgatagggcataaacattccagggtgaaggcacaatccacactgtgaggtccaactgctgccatgaagacaggtgtgcttttacatgtacaggaaggtcattgaaggttcagggttttatttcaaaaactggatcccaagcccacacattattatgctgtgcttctcaaaataagttatgagatgggaaatagggcacccccaaatatatatatatatatttataattatatataatataatatataatatatataacacatatataatttccttttacatcctgaatccttatattatatataacatattatatagaagatatataatatattattttgtacataatataatatatataattatatctaaatatataattatatataattatatctaaatatataattatatataattatatctaaatatataattatatataattatatctaaatatataattatatataattatatctaaatatataattatatataattatatctaaatatataattatatataattatatctaaatatataattatatataattatatctaatatataatatattatgctatattatacataatataatataatgatatatagtataatataatatatatcatatatatcatatattatatatcattatattatatttaatagatatcatatattatatatagtatatatcatatattatatataatatgtaacatataatatataatatatatcattcattatactatatattatatataatatatatcatatattatatacataatatatgatatatattatatataatacatggtatatattatatataatatatggtatatattatatataatacatggtatatattatatgtaatacatggtatatattatatgtaatatagtatatattatgtaatatattatatactatatgatgtatatattatatattatagaatgtatattatataatatgttatagaatgtatatattatataatatataatgtatatattatataatgtatatattatataatgtatatattatataatgtataatgtatatattatataatatattatatgttgtataatgtatatattatataatatattatatgttatataatgtataatgtatatattatataatatattatatgttatataatgtataatgtatatattatataatatattatatgttatataatgtataatgtatatattatataatatattatatattacatatccaatatataatatattatatatatcatatatcatacattatatattatatatgatatataacctataatatataatatatattatatatgtcatatagtatatattatatgtcatattatatatattatatattgttcatataacatatattatatatgatgtatattatatattatatataatatattatgtatataatatattatatattatatataatgtatataatatgacgtataatatatataatgtatataatttgacatataatatatataatgtatataatttgacatataatatatattatgtatattatgtaatatatcattatattatatatattatatattatatatacataatttttttttagacagagtcctgttctgttgcacaggctggaatgcaatggcgccatcttggctcactgcaacctctgcctcacgggttcaagcgattgtcgtgcctcatcctccctggtcgctgggactacaccacactgggactacaccagctgccaccatgcctggctaatttttcgtatttttagtagagacagggtttcactgtattggccaggatggtcttgatctcctccccttttgatcctcttgccttggcctcccaaagtgctgggattacaggcctgagccaagatacatattttttaaaggaagaaaaatttcaaaggtactctgcttggtacaataatcaaatatataaattgaggaataaaacataaccatgaaacatatttataactgcctatggaaaatacagaggataattttttaaataacatattttgaaagcattaactagtaatttgaaaagatcgcatttggcaggccagtatgaacataccttgaatgcagcaagacaggttccccataagaaaattcaaaatcagggaatatgaaaccacaaaggttcaatctgctctgacctttcaaaaactcagcacagacagtggcacttaggaccaacggcaggagatccctaatcccatcaccatggcgatagggcataaacattccagggtgaagacacaatccacattgggaggtcgaactgctgccatgcagacacgtgtgcttttccatgtacaggaatgtcattgaaggctcagtgttttgtttcaaaaactgaatcccaagctcacacattattatgctgtgattcttgaaataagttatgagatgggaaatagggcacccccaaatatagccaatagtgagagtttcaaattgaagagaggcacaactgatacgttgagaataaacagagattccattctgctttttcttttttaacttttatgttagattcagggtgtacatgtgcaggttttttcctgggtatattgtgtggtgctgaggttttgggtgtgaatgatcccaacacccaggtactgaacatggtactcagcagtttttcaaccttttccttcctccctccccctcctagcagtcctagtgtctattgtcaccatcttcatgtccatgggtactcagaatttagctcctacttataggaacatgaggcgtttgttttcttttactgcattagttcacttcgtggattccagctctagacattttccctcaaagaacataatttcattcgtttttgtggctgcatagtattccatggtctatatgtaccacatttttatccagtccactgttgatgggcacctaggttgatcccatgtctttgctaatgtgaatagtgttgcaataaacatataagcgcatacgtctttttggtggaatgatttgttttcttttggatacatattcagtaatgagactgctgggttgaatgttagttctgttttatgttctttgagaaatctccaaattgctttccacagtggctgaactaacttacatccccaccaaaggtgtataagcattcccttttctccttatccttgccagtatctgctatttttttttttttactttttaaaaatagccattctgactagtgagagataatatctcattgtggttttgatttgcatttctctcgtgattagtgatgatgagcatttttttcatgtttgttggctgcatgtgtgtctccttctgagaagtgtctatgtcttttccccctttttaaatggggttgtgttttgcttgttgaattatgttccttatagattctaaatattagacctttgttggatgcatagtttgtgaataatttcccccattctgtaggttgtttactctgctgatggtttcctttgctgtgtggcagctctttagtttaattaggtcccatttgtcaacttttgcttttgttgcaatttcttttgaagacttagtcatgaattatttcccatagcccatatccagaatggtacttttgaagtttttcttctaggattattgtagtttgaggtcttaaatttaaatctttaatccaacctgagttaatttttgtatatggtgaaaaggtgaccagttttttgttttttgtttttgttttttgtttgtttgtttgttttttgagaggtagtcttcctctgtcaccaggctgtagcagagtggcgccatctcagctcacagcaacctccacctgccgggttcaagcgcttctcctgcctcagcttcctgagtcgctgggattacaggcacgtgccaccacacccagctaatttttgtatttttagtagagacagggtttcaccatgttggccgggctggacttgatcttctgaccttgtgatcctcccaccttggcctcccaaagtgctgggatcacagtcgtgagccactgtgcctggccaataaggtgcattattaacatcaataaagctcaggaaacagctttcaccatatttttgtttaatttacagtttttcccagagtctttggaatagattcctccctccatgagccagagaacttacaatgttcactacagtgtctttaaatgtagcagtagcagctgtgggttgagaacacaagtcttcgactcttccttttagagccagccattcacggtgctctgtgttcttattcggcattgggtaggggcatctgggtgctgggcatagcgccagtgccccatggaggagggaggcaggaagcccctttcttccttctctaaaaccttttttctttatgtagatccaagtttttagcctatatcattttcttctctctggataacttcttttaacattttgacagatctactgacagcaaaattgcatttctctgagaaagtctttatttttcttcactttggaaagataattttgcaggatacagaattttaggttggtggaattttcttgcttgcttgcatgggttctgaagaaaagtttgatgcaatttttattcttatccttacatgtgttaggccctgctaaagcccaaggtggttagactcttgtgaaatagtttccctggggcaggcttttgctaagggaacggaacacccagggtgtatttcaaagtagttacttttccccttccctgtgggaagcaggagggaatttttctctgatgtgcataagagcgtctggcagagctcttggaggttcatgaaagtgtagggccccctaagaccgggctcccttaattcttaattctcaagtttatgtacacgtggcctccagaaatttgttgtttacatgtaagtcttcccaccgtggttctggctccagtggcagcctccgatcctgttaggctgggactcactgcctctccaatttgggggataatggtttggcgtgttaacctcaagtctctgatggatctaagaaaagttgttaattttcagtttgttcaaggtgttttttgttgttgttgtgaggacaggagtgacagcttccaagctggaaaacagaagtcacatttgggttttgtttcaagatatttttccaatgacagagaatgatgccacacacatttccatagatgtcttttgatgcagacgtgcatgtgtttctgttatcctaagagtgaaatacctgagtcctgaatgtgctcctttctagaacctttattcaatgccaaacacagtatcccctccagcagtgatgagagttcttgttgctccagattctctccaacacttggtgttctgtcttttacattttagccgttttggaggatatgttatcctgttgtgatgttaatttgcatttacatgaatattaagaaagctgaacacattcaagtatttgcttttataaattacatgtttaagtgttttacccattgttctttctcttagtgattttttttttttcccaaggcagaagaatttttcttagtacagaacaaaatgaaaagtctcccatgtctacttctttctacacagacacggcaaccatccgatttctcaatcttttccccacctttcccccctttctattccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcggctggccgggctgggggctgacccccccacctccctcccggacagggcggctggccgggcggggggctgacccccacctccctcccggacggggcggctggctgggcagaggggctcctcacttcccagtaggggcggccgggaagaggggctcctcacttctcagacggggcagctgccgggcggcggggctcgtcacttctcagacggggcggttgccaggcagagggtctcctcacttctcagacgggacaaccgggcagaggcgctcctcacatcccagacggggcggcggggcagaggcgctccccacatctcagacgatgggcggccgggcagagatgctcctcacttcctagatgtgatggcggccgggaagaggcgctcctcacttcctagatgggatggcggccgggcagagacactcctcactttccagactgggcagccaggcagaggggctcctcacatcccagacgataggcggccaggaagagacgctcctcacttcccagacggggtggcggccgggcagaggctgcaatctcggcattttgggaggccaaagcaggcggctgggaggtggaggttgtagcgagctgagatcacgccactgcactccagcctgggcaccattgagcacctctcttagtgatttttaagagctctttacatattgttgatgtgagccctctgtcagttctatgtgttcatagatctgttcccactctgcaacttgccttgtcactttcttagtctcttaataaacagaaattcttaatttgaatacagtctaatttatcaatttattcccttaaaactatggctctttgtgaactgtttaagagatctgtccccattcatggtcataaaaattggctgggcatggtggctcacacctgtaatcccagcactttgggaggtcaaggtgggcagatcacctgagatcaggagttcgagaccagctggccaacatggtgaaaccctgactctactaaaaatacaaacattagccaggtgtggtggcgggtgcctgtaatcccagctacttgggaggctgaggcaggagaatcacttgagcccaggaggtcaaggccgcaatgagcagtcattgtaccactgcactccagcctgggtgacagagcaggatgctctttcaaaaataaacataaaagtaaatctaatgagctctaggatttctaatttgaagatagaagcgataaacaaaataagaaaccaaaatacattctgttttgattaaagcagaggtcagccataactctgaacctaaaaaggaggtcacctgaagcagctgtgagtaagcagggtaagataggaagcagagaaccgatgctcattgccagatcttaggaaaaaaataataaattaggatgacatacttttgcaaaattaaagaaatcccctgaggtgctaatacaaaatttcatttgtgataggactaataaagaaattcagctagtagtgggatctgtcgtggactgagtttgattccaagaacagaagaggcaggaccagtgagaaatagcacagacatatttgcaaaagcagccctcccacgttaggaagaagggatacttttgcacagtgaacagcactacaactgctcatgtctttcatgtactatcacacatggaatgactgagataatcctgtgttccacacatagtcctcctcccatcccccaccacttaggcaagagctgtgcccaggaaatgtcacccgtaactggtctgcacagaccctgtcttctaaaagggtgctgtgcctccaccagaccccatgagcaatacatttgtcaagcacacgcgagacatgccaaggccaaggcctgactgatttgacagtaaagacacaatgagcccctctcattcagagcttattactcacagagtgaaaataagagaagtctgaggtggcagctccctgccatcctggtgccacacactaaaaaggacagcaccgaaacaaaaggggtcagagggcatgcattgcaggacacccaatgcagaggagccccttgagactgcagctgggtggtgtcctcatctgcagctctgttgtgagggccaggggcagggcagtgaggaaccctcaccagggccagtgaggcaggcagtgaggaacagtcttgggagacagaggaagtgaccagtggcctgggtgcagcctgatgttctgggaggagcaggcttaggtcaggtgctgtgtgcacctctgtgtggcctatggggatcctgcaatggctcagggtctcacggcagagctgtttctctgcccacacaatggactcacaacctgacacacgaaaattcacagagaaacacagaaaggcacacgtgacactcaaagacagacccacacaaaagccatgcagcaaagccttttgccacacatgcacatgcacacacacacacacaggctcccatcctttcaaaccacagacttggtgtttgcccagacacacctgtgtcagagaaaggggatctgcagctccccaacatacaccagtcactccacactaacccaaggtgtcaccagccagcctggaggacttgggaagctaagtggaggtggacagtggccacagagcaaaggccttcagtggataccacctgatgtaaagagccatggggtccaccatgtgcacgcacacaaggggcacacatgtctgcgcaccagctcccccattcctacacacatatcacccatccctagggctctgggggatgagacccctccctgaagacccacaggagtccccatgcctgagtgacccactgctcacgtccatgcaaaagaaaagaactttttatctgaggaatgcgagacccctttaattatctggcccagagagtcactggactgaaacagcagtcacatgtcactcccacttgagctaacgacctcttgaagccaattgctctgtgggttccagactgacaccaagtagacataaaaagccagacgctggacaccataactcttcccctgtagtccaacaccttatagccagtcactaaggttctctctggaaagcagtcagaattcctgctgacttcatatcagcccactccttgtccccttcagtctttaaaaacttgcttgtaataaggctgaatgaagtactcccagggcaacttggtgtgtcctgggcagctctctcagccttggtccagacaaactctctatatgaactgtggttcagtttgtttctttaggtcgacatccacattaggggagcagtgctgctgggctggggaagctggttcaggtcagatgttgcaccaagggttggagaaggggccttcctgcatcagcacccggacaaggcagaggagcaggtgtccaaacccaggcctggtctgctgctgctgtggctcacagcccccaccccacctggcagacctggcagaccccggagctggcgacagtgttgcccagctggccacagacatatcatcacgtggggctgccctatatgctcccagtctccacacagacacccttcatggactgggggactgagggcagggacactggtgaaacaggcaggcatcttcacccagctactcatcccactcaccacctccgggggaggtgacagtgaccaagcccagccccagctggctcctggtcactcactacagactcagctcccacaatctcgaatcccacctccagctcctgccattccgagggacctggaggccagggtgcccggcgcatgaccagctctgggttgtggaccgccctccacggcagtggcctgagcgcttgttgtcattattcactttattcactcctggtttctgtctggaagggatcacaaagacatggcttgcaggggagccaatcctgccagggactgaggaaacagatcctggagaaaaccagagactttgctggcacttcagggggaccccagttggctcaatgcccccctctcccccatagccaactgctaaccaatgttctctctggaaaccagtcataattcctaacctggtcaaagcagggtcatctcacacagcccagccacccattctttagcaccgcaggcagctaaagaatgcctggtgaaatgcaagtctgatcgtgtctgcgtccccaagcccttccgtgccccctgctgctctttggacaagcccccagcagcctctgtaatgcacagcacccgcccttgtctcctgtgctggcttccgcagcctggccacactggtcctctcgcccatccacctgacctgactctggcagggcctttgcaggagccattcctccacccgaacccctcctattaaaacgtgttcctagccggttcagccccagcctgtagggaccagccccacatggtcggtgggtctctccccgtgtgccgcaacgagagagtgtagaaataaagacacaagacaaagagataaaagacagctgggcccgggggaccactaccaccaaagcgcggagaccggtagtggccccgaatgtctggctgcgctgttatttattggatacaaagcaaaaggggcagggtaaagagtgtgagtcatctccaatgataggcaaggtcacgtgggtcacgtgtccactggacagggggcccttccctgcctggcagccgaggcagagagggagaggagacagagagaaagatagcttatgccattatttctgcatatcagagacttttagtactttcactaattgactactgctagctagaaggcagagccaggtgtacaggatgactaggcataataaaggcagactaggagcgggaccactgaagcacagcatcacagggagatggttaggcctccggataactgcaggcaagcctgactcatgtcaggccctccacaagaggtggaggagcggagtcttctctaaactcccccggggaaaaggagcctccctttcccggtctgctaagtagcaggtgttgttccttgacacttttcactaccgctagaccacggcccacctggcaacgggcatcttcccagacgctggcgtcaccgctagaccaaggagcccttctggtggccctgtctgggcataacagaaggctcgcactcttgtcttctggtcacccctcactgtgtccccttagctcctatctctgtatggcctggtttttcctaggttatgattatagagtgaggattattataatactggaataaagagtaattgctaccaactaatgattattgatattcatatataatcatatctaagatctatatctggtataactattcttgttttatattttattatactggaacagctcgtgtcctcggtctcttgcctcagcgcctgggtggcttgccgcccacaccagccaccagaagctccccagccccggcccagcagctggtctggggagcggggagagggcagtctgggctcgcggttccggctgggggctgggcaccccggggcgaccacggcaggcccagatggggactccggttccaactctcctggcccagaggctctagggtggtcttgtctgtctcactccgggggcagagaggacgcagacagaccccaacaccactgctcggccgcgatggtgccttagacccaggtcctgtgggctctggcccgagacccctccctctgggaaggccggtgaccgggacagtccacctcgcaggcgcgccggcgcggagcccggacctcagcccgcaatgactcagcaagggccggtgggattctacatggtcctgcgatatccaggcgacggagtctcgcctctaaagtggcccggggagcaggaaggtatgagcctcagctgagcgaaaccctccttgcagccaccacggagggacggggcgcgtctccttctgaatgacgcaaggggcggggcgcgtggtggggcggggaaggcgcgaggcgcgccgcgatcggggactgtcctaagacgggcggggcgcgctgcgctagggactgtcataaaaggggcgggacgcgccgcggtcgggatgacgtgagctgggggcgctcgtcgctgcagccggcggctagcgggcgtccgcgccatggagcgctacgcgggcgccttggaggaggtggcggacggtgcccggcagcaggagcgacactaccagctgctgtcggcgttacagagcctggtgaaggagttgcccaggtacgcgggcggggcgggcggcggcctgccgaggccgcatcgtgtcccgccggggctcaccgcgctcctctaccccgcagctcattccagcagcgcttgtcctacaccacgctgagcgacctggccctggcgcttctcgacggcaccgtgttcgaaatcgtgcaggggctactggagatccagcacctcaccgaaaagagcctgtacaaccagcgcctgcgcctacagaacgagcatcgaggtgcgcgggggcagcgggaggaggtgccgcctcctcggggtcggcgcctcccggcagctcttggtatctgtgcagctcggctccttccttgggagtgttcggaagaggtccctaagattaacaaaatcaagggcgcagagactgagacagcgcctttttggtgaccaatgtgtccaacgagttttgttttcagttgcgcagcacccaccttcttagcagaaactccctgttcgggcttccctgtgccccacccccttccaggcctgatggccctaggcctccgtgcttggttggccggcaggctgactctggtggtagatctgactgcgttgccctccggtaattggagttctgttgacaggtgagcagcgcccttgggtagttggaggtctgttgacagctgtgcgcgcccttcagggtcagttccctctcaggcctgcagggcctcattctagttgcacatcaaattcctaagcactgtctcctgtggcgccctcccaaaccagaagagcttcccacttgagccgcatgcttcctgggcttcggagccctttcctgcaaattatatagggcaggtccccctgcaccatcagatttccacctttgctgttttatttttcccaaacttcttattttaaaagttcaaacatttggaaaaactgaaaagacagtgtagtgcatacgcttgtgctctccaccgaaagttcagtagttaacattttgctctagttcttgacatcccaaaatacatacatgtgacagcatagaattcaccaagagtcttcagcattcctggagaccaggattttcaacccagccatgctgacatttgtggctgggtaagtctttatggtgagatgctgtcttgcgcattgcaggatggcaggggtaccctccctagtcgtgaaaaccaagaatgcctccagacaacctgggtggtggggtcaaccttggccttggattgggagcaagtgctctagaacaagagcggtctcctacacagctgcagagggtagccccctgagaaattaactgttccaggtgtctcctgactttcagtgcatggccacatcatggtacctaacttgtggcaaattgttgctttataagtaaggatccagtccaagttcatgtactacaattggttactttggtctctttgcttctggaacagtccccaacatttattgtggcattgactttttatagagtctaattctataattagaatgccctgctctggatctatcagaggaaatgcttcctcgtgcatttaacctgcttctccactctctgggtttactgtacactggactcctggtaggagcctgattagaggcaggtttaatgtggcaaaaattcctcctagcggggcaaggcccccttccccagaaggcaggcagtgtccatctgctccaggattggtgtgtttctatcaagaatggatgttggattttggcagtttcctttttggcagctcttgagatgatcacgtggtgaatcattttctattactacagtgaattacagtcacttgaattccatcctactgggtcgtgctgtagtatcctttttatgtatgctggatttgatttgctaaaatcttgttaagaatttttttgtctatgttcatgataaactgtggtctatagttttcatgtaatacctggtttgggtatcagggtttttgccagccttataggatgagtttcgaagtgttctctcctcttcagttttccagaagagtttgtgtagaattggcattacttcttcccctaaatgtctgggtgactgtctttttaaaaattttattgagctgtaagatgcatgcagtttactaatcccaagtgcatggctcattattccttaatgctcagactgtgccatgtgtggccagttgggggcgctccaggcacctttagatgccgccccatcattctgtgagcactttcttgctttctggttcaggtatgtgttcaggctcatcttttcttgttttctccgtgtctcagtcctggaatcggccatttttccacagagttgtagttctttctagcaggatggggagtttcagtaactgcctgggcccaatgctgtttgtgcttcagaaggtttgggccaggtcctggttccaccagcagcaggcatgcctgcgttgactttctgcttctcctgctgatttggcaggggtgactggctgctcctgcctcctttgtgttcccggtcgtgtctaaggccaggccccttctgcccaggcagccggcgtggctctcttcttgccttttggttgcatatctagtggaatctcgtagtggacctggcacttgtagcaatgtttgatcagtagagtgaagatgatgacatttccctgcttccctgtgttatggagctgtcttgaggggggcttttggtaaataccatcgtcgaggtgtgtacagaatgccaagaaacaggagattggggaaggctgtaggcacagctggagccaggctacctgcaggggagcctcaggggccgtggagttccctggagacttgccaccagagaagagctgcaacatcagggctcttcccaggaacagagtgttggatttcacgttttgttgtggccagggacccctccttcctggggaactgtagccatttggcacttaatgcactggcgccagctgcggggtgctccatgttccattttgccatgatggtttatgtcccatgatcgcttcctctgtacactcccttcagactagagtttgcacatctgtgtttgtgcacagtttagcagggaccgtggagctttgcttggtggccgagggtgagcccctcaaagccacacagactccctggcccagagcctcacaggcttatgacaccccaggttcatcccaaacttgggcctcccaggtcagctcacccttctccctctggtgctgtgtaggggctgggagctgcaaatgggggagggggctgcccaccctgaagggcagcaccaagggtggaggggccaaccacacacctggtaggcagaggccccacgctcagggtcagcgacccggctcctcctgctcctttcccatgcctttgcctgaggtggtctccaacacttgagtagatgtcctatggcctgtggccacgggggccctgaagccctcagactgcagcctccctcccgcctgccccctccagctgccctgggtctggggctgcagctttggccccacctggccagtcttccccacccccactctctttcagtgccccgcaccttctggaatcccctggagacttgccgtgacagtggggtgggaggatggaggaggctggcgtcctccccagtgcagacacccctttggcctggctgctctgctgggttggtaaggcaggtgcccatgggtgagggctgctgccgagtcccaccgcctgctgacgggctctcatccctcccagtgctcaggcaggcgctgcggcagaagcaccaggaagcccagcaggcctgccggccccataacctgcctgtgcttcaggcggctcagcagcgagaactagaggtactggggacgcaggcagggtggccggcccagctctcctgtgggcaccacctggctctgctgactgggctgagctgaaggggtgtggggggctcaggtgtgggtggctaccctgggcctgagtgggacactggaggcctagtgagtcccaccaggtggctcctcgctgagggtgccaggtgtgctgggactgggtggagggtgagaacccaccagtgctcccctggagtccattagtgcccctcgtgggttggggtctccgcagagcaggtggcctcggggggtacaaaggcaatggtggggtgatggggccagccaggaaggggcccatccttctccccgggagcacagggacaaccagagaccggcatgtaaccaacaagtcatggggcagggtgtgcctgcggagatgtgtgtgtggtcccaaggcagtcccaagtcaaagcattcgtggaagccccttggggcccccttcaggggttcacttggccgaggagaggcctgggtgtggtgaggatgcattggtggtgtcagagctggtgctgttggggacagcagcaggagcatgtgtttgagctgccctcacctcccccgccgcccccggccccacggcaggcggtggagcaccggatccgtgaggagcagcgggcgatggaccagaagatcgtcctggagctggaccggaaggtggctgaccagcagagcacactggagaaggcgggggtggctggcttctacgtgaccaccaacccacaggtcagtgcctgggcctgctctgtcctagcccgagtgcccctgggccccattccatctgggatttcactgctggtccctggggagccaggctcagggtatagggggtgaagtggaaggattgaggctctggaaaggatttctgtgccattcccagcatggaggccaggcccattccctacaggggggtgagccagccagccatgggcactgcccaccctccccaggcctgctgtgccccacagggccctcttctgctcccctcccgcatgccattccaagtggccctgctgggtgcagaggctcagattccgagtggccctgctgggggcagaggctcagattccgagtggccctgctgggggcagaagctcagattccaccctgtcgtagcaggccatgaccaggcttcacaggatggtcgccccgtgggctcactgcctggcacctttgggccgggatgaaaggggcctgggggtcactctggccttcatggggcccctctgtatcccaggagctgatgctgcagatgaacctgctggaactcatccggaagctgcagcagaggggctgctgggcagggaaggcagccctggggctaggaggtccctggcagttgcctgctgcccagtgtgaccagaaaggcagccctgtcccaccatagccacaggcagcagaagtctgggcagagttcatcttcttgacctttggccactgccttcccagctgcccgcagggggttccccctgctgaggagagaccaggtggaccccagctgcctgtcacccttcatctgggacttgctgtcaaaccctaggatagtctcataaaggggaggctgggccagcctgctgctgtctgcttcagggccaggcagagagtgaggctgggggttctcacaccttactccaccgggcacatcccaacctgcactggggcccactcgagcgcttgttctggtctcagccgctcccttggcagctgcagcccccatgcagaagaggctcccaggcccaagctctgtgtgacccagagaaataaagatgcctcagtgtggcccgcatgtggcttgtgtgatagctgcaggttctgccataaccggggccctggtagggcccccacctctgttgcagcagaggcctctacctgggggccccttcctgggctgtgtgcccagcccaccacccctccccctgcctggagactgggaccctccagcctttcctgccccagccctggtcccaggatgctgtcactgccatctgtacaggggcccccatccaagccccagggcatgaggaccacatccagcctgctttgtggggctgggggctggagagcatgggagaaggcccgaagtgcaagtatgcgcctgccgcagcctggtcagtgtcctgtgggaaccactaggaggagcctgatgcaggtcactggggtagaggactcagggtggcaggaatggcctgaggaggagccctgcggggaggcgtgccaggcccacctggggagcttggcctctgcatctgcatgagtcccctccgtgctggcctgggcccatgggccctgctgggtccttgtggagtcagggttgggggtgtccagcaccctgggtggccaggtctgcgcagggcctggcccccaggaacagatgatgctggaagccagagtctgggatgagacttctctgaccctgtctgagccactccctctttgttgcccagagctgaccctgtgtgagggcaaagggctctcagctgcaggaacagtggtttattgaccaggcaggcctccccagcccggccactgctccccaaggggctcgggctgtgtgggctggccttggcagaaggtggacaatcctctaggtccaaggacatgggggtcacagaggtgggggccttgggcccacacattcgaggagagttcccaaaagtttccagtggctgtcccaggcaggtatcaggttcggcccacacctgagtgcccatactctgggcagggctgggaggcacctgacctcacctccagcagctctgcaagtgtggggtgaaaaaaggtgaatctgtgtgaggatggggttggctgcagctgtggtgatggcctgggcgggggcggggggtgctggaggctaagggtgtgctggcgggtgctaggcagggcgatggaagaggttgccagttcggagccgcctcaagagctccagccacagcagctgccgctcccgatgggtgcccttcatgaggctgctgttctccagggcacggcgggacaagtagggcagcacctccatcacggggccatagggcacgtacttgtacacggggtagccggcctggcctgcatgggggcagatacaccatgaggcccaggcccagcaccgtaccccatcgcaccagggagggccccactcacccagcgggaagctgatctggtcacacatgcctagcagctgtccaaagtacacccggtggtcagcaggatgcaggcccagctcctccatcctgtgcaggtgaagccaggaactgagggccagttccaggacactgtccccagtgcagggatacagggctcctgtcccagctctgagcctgtcctgccatcccaggtgccccatctgcactctccagacttcatcccctgcaaggtggggctggggtatgggctctgcctggccctgccccagtgaggcctcttcccagcaggactctgctgggctgccctactcgtctccctggggaggcctcagcccttggccaacaaggcctcccacctgctttccctcccctctcctctctcacctctcctctagctcccttcttggaggtgcagcccttcctcgggccctgacccacccagcagcctgccccacagggcagagaagctcctcagctctcctgccatcccttcctcaagcccctccagggttctgtggtatgactggtctccggcccctgccctcgccctctgtgggctgctgccctgccccatccccacagctgctgtgtcccacacagctgccaccagcccccgagtcctcggaaggcggctgctctgaatcgagatgtgttgcaaatgtcaaatacacacgggatttaggagactttgtagaaaaataatgcacgatgccgcgttgcttttctaaaagcaactggaatacaatttgaagtaatattttgaatattttgggttaattaaaattattcttgaaattcattttatctttttcctttaacgtagctactaaattttaaattacagatgtggcttgcattatatatctattagcactgctcagatactggggtggggcctccactctgtcctgtcttcacaccaccccgtatagcgtcttacaaagattctcagggtctgaaatatccacgcagtggcagttctcaagtttcatctccagcttactatatccaggtatcccgacttcgctggtctgcaaagcactggggtccccaccctggggtgagttccgcctgctgctcacgcatcacccgggaccacccagtctaaagcaggcacccatctctgccacatcgccctggcttccatcttgtgtcttcctcaaccccaggacatgaacccgagagccgggtgccactgctggctgccccctcccctgctggtgtgcacagcctctgccatgtgactgcggctcctcccagcacaggacagtggctcactccacctggcatctgggcttggcctcgtgaggcactttggccagcagggaggtaccaaaggtgacacaagcagaggcttgccctctccaggccttctggaagcctgagcccaccacgtgctcaagcctgggctggcctgtgggacgctggacccgggatgcagtctcctttactgccccagccatgaatgagctcattaggccccaccggccccagatcacagacgcaggagggacacaggcacagccagcagcagaagcatcagctgagccagcccacccctggcctacagaacatgccactgttccagcctctaagtttggggctggtttgttccttggccaaagccaactccgattgtttgagggtgggtggtgtggcagtctgggcccagcacaggacagagcagctgccatagtctagaaccacttacccatgggaggggaccccagctccccagagctccccaaccacccacagcaggggcagagctgaagcctgcaggggtccagcctctcaggcagggatgtgagcgtggtactgggggagcctggcacagggcccttggggccaagaggagagagcccggctgccactcaggggagggggaagctgtgtccactggggaagccactgccacagcaagatagtagggacagacaggtgccgggcggaagctggagagaggaagccctgctgagggcaggctgtcctttcggagttggatggtgatgtgtctagtcaggctgtgagtccaccagcattgagagtccacccagaggctgggagtcctgattacaagctgagaggaacccccaccagctcccgagtgctgggcagtgctggccaccaggcctgtgcgtgtggagaaagtgagtctgtcccatcaccgacacatctatgacaattagcagaggatcagggcacaaaaatgggtgtgctgcaatttcaggccatgaaaaagtagcagcatcgtaaacaaaggctgaatgtggacatcactgaatgatttcagagccgtgagtcagctcccgagcagcaccaggatgtgtcctgttggctgcagccctggccccaagcctggccctgtggcttcacagcttcttggggagccccctcgtgccacaagccctggatctggggcaccctgccctgctgagagtggagctcctgctcagctcctaggaaggcgagagccagcgaggccactgcccaggcccccgagggttctagggggtcccatccctgggaaggcggaatctgggaggggagggggacctaggaccccattgtgtgcatagcttggactaaggcatgagataagaccagggtgacagtacaggagtatccaagaactgacttcacctaacttctgcatttgacttgttagaattctaccgaagttgtgctccatgggacaaatgtttaaagagaaaacaaaccgttacattccagatgtagttaaaatgttaagggcgtattaatgaggtggcactgtggaggcctcctgagggactggcctccaacactgcatttgtacctttcaggagccatccgaataccctgatgaaatttagttttttaattgtgaagtttaataagtcagatgttaatttttaaaagtctgggtacagtggctgatgcttgtaatcccagcactttgggaggccaagaagggaggatcacttgaggccaggagtttgagaccagtctggccaacacggtgaaaccctgtctctgctaaaaatacaaaacattagccaggcgtggtggcacatgcctgtaatcccagctacttgggaggctgaggcatgaagaattgcttgaacttgggaagcggaggttgcagtgagccgagaccacgccactgcactccagcataggtgacagagcgagattctatctcaaaaaaagaaaaaagttaattttaaaaaccaacgtaactgcaaaaagccattgtgctctcacagtccgatgtccagaacgccagcgggcctgggcctgcccactgaagccaccctccagctcatttcaccagcctttccccacaaatgcccgaccacccagcaggtcgctctgcccaccctgagctctgcgctgctgccacctctccccagccggaggagacaacggctcaggttggggtttcggtgcagggtggggcacacctacctgcgcagtgcaaagcgcactgtgtcctcattgtgggaggccaccatcaccttggccttggcgttgtgcttcagctcctccaacacgtagtccaggcacctgtggagagtgccatgtgagcccagttccaggcctgtggctgcctgcacctctcattaccagctgcacagagaggaggccgagggcagacccagatccatccattgagctggctctttccaagggtatccacaggatcaggaggaacaggagcagcatctgcccctcccagcacctcatgaaaaagaaagaccagcaaccaagcaaaagcgatgtctgggaccagacaattcacgcagaaccagctgtgggggcagagtccctgcatcaaacgtgctgtgactctggggaccagcccaaacatgcccatgagcctcatgacagacacagctttgcttctggggagggatcgtacagtgcacccctggccctgcaaggaaataaaagggaagcaggtccctgtagggcacagtgggggtgggcatcccggtgcaccaggaagcccgagcagtacggccctcctgcagcgaggtcactcagcaggcttgaccacacgcacgttctctctgacccagcaattccatttccagcaacctaggacagctgcatcctcagacacaaaacccctgacggcccgtgtgtaccacagagggtgacggtatgtccagcgagtccattacaataaccagactaaaaaccaataagatcaaagatgctggacacatagccccgggcactccatgctggctgttgacagcaccactctgcaagcccacacaagaggacccagatggaacgcgaaatgaaaaacacatcgggcagaggacacgctacaacgcaaaaaacaatggcggagatgtgtgcgctgtggcacgacatgcacagcggctgcaggaggggagctggagccaaccaggagacacttggggtctctctgaatttgcagcatgcacacacgcctctaagaggaaaagcccatggttggccagcctgtgctacatgaaaagatcaccaagaaactagagcagtaaaagcaggtgcagaacagctgatgggcgatcccactgtgtgaactgaaaagcaaacaggctgagcctgcagggtggggaggaccgggtgttcatgcacatctctggatctaagtgtctgcaggagcaagctcagggaactgtggccaattttgctttgttcaataggcttttctatatttataaaagaataaccttaatgcttttgaaaaagtaacacatgacataaaagctgaggaaataccagttctgacctggggacacatgtggctgacaagttcagtctccaagcctctccctcaggcctggtttcttggcgccctgccctgagaagacagaggggtgggagagctgcgcacctgtggtacatggcgttggtggcctcgtacgtggggttgatggggtcctcatagccgatctctgccgcacgggctcgctcctgggccaggtatgcgccccgcaccagcttggccccaaaacaccagccctcacggcgagccagctccacgtccagggtcacattgtcataggcatcctgtggggccagggccaaaagtcacagggagcctgggcaagcccaagtgacagcaggatggggccttcctgggcccaggtgcagtcaccagggctgggcagcagctgcctggggaggtgcagctcagggcacctggagcaggtgtgggtgaggatgggcctccaacctctgtccccaaggagcaatggcagtggggacgtctgcaacttcctgtgtggcctgtggacggccctgtgggtgcagcccaggcgccagcagccatcatgtgctccagactcccaggccgaccgggaggggtgcatactgcatgctcctgcctggacccctccccatgccaccctgtgtcctctgggcatccggctcacccctgagagctctggacctgctaacatccctgagcagtttggggcccaaaggctagggtgggctccctgaatacatgtgacatcctgggtgagtctttccggggagggcccaaagctttcaggaggttcttaggggcgctgaactgaaaacacgctggaggaaatggtcatgtgacaccttccaagtttggggtgtcgggtacatctagtggaccctcataaagattgttgtcttcctcctgctccttagacactcttggctggttctgagaaccaggggagaggttgcgggcagcgggtctttcttgctactctgaggcagtcaccctggcctcagcctcctctgcaggcctggctgtggccaccacctaaggggctctttcctggaccctggggcccgctgggtgagctgtgctgcagaagaccccaacaaccccttgggggcacggcccactccctcctccatcccatgagctccctggtgggtgctgagtgtaaaaccagccaaatgccagggagctcagatgagaggagcccctcctgtggggtctccaagccccagggcaggcagggaggggctgagcgggggcttgccttgaggtagcactggtatgtgttgaagatgagcggcttctccacattgaacttccgctgcatctccagcgtcaggcggctgatggccggctggaagtaggtctgctcggcatccaccatcagccgcacgcccatctctgtggctttctgagaggcgcagggggtgggagagtgggagcaactgttgctcaagtgaggcaggtgccctcttctccacgagtcccaggtaccctctgcccgagcgggacagctcaccttggccaggacatccatccgctgtagcatcctggtcatctgtagctcctcctcctcagtgaaccgggacagcaggggctccagctgtcctgtctgggggtgcaacacgcggtcaggccacagcaagggcgggaaagtgccaccctgaggcccaggctaaacctctctcagtattcccagcccacaggaaccctctcacccgtctgtgcagggctgggagggagggccacctggacaagcagcacagtgcccctgaacctccaacgcagccagtgcactgccctatgcggggcctaggggtaccacgagggagctcagtgcccatgtcagtgggccccaggctcagtccaggcctgcactccgaagtgtgtactccccagttcccacagaggccccaccgttgtgggagagccccctgcaactcccatgtgacattgaacaagtgaacactgatcacccaatcgtcaaacagaagggctccacccggagcaggcagagggcccaggaggaagacccctggctacaggcagacagggcagttgtgcagcacgtgctgacacgtagccagggaccagggcaaccaccaggatgaggccttcaagttgctggtgctcagaggccgtggggacccatcccgcagggcctcccgctcacccctttgctggccccagcagccttgcctcactgggcacaaacagtaccactctatcccttgctacaccatgctaaagtctccaacagctggtggccttggtgcacagccacactgtacgcactgcgccccgaggctctgggtcgggggctctaagtttgaggctgggcccttagtggactggggctagatgtgtcatggaaagctgcctctgcaggatgttttctgaaggtgcttctgttctttctttgaatcccagtttaagctgtggtttcaagcagtctgccaggtcctgggcccccctcccacaggcagatgagtctcattcctctccccgctgtatacaggctggcctggtgacatgcttctaacaaacagaacttgccagaaaagacaccgtgtgacttctgaggcgaggcaggaaaaggtcacccagcttctgcctggctctcacgtctcaggtgacactggcccttagagcccagctgccatgttgggaaaaagcccaagccacagccagcaccaactcccagacatgtgaatgggtgcctcccccaggtcccagcgccaccactctgtgagtacagctacccaggagaccccaggggaggactgcccagctgagccctgtcaaccccagaaccatgaggcagaagcagagtggctgctgccgtttcaggcctctgaagtttggggtgacctgatgcacaagacagatgacttggggaaggcccccagaccccctctccttgtggtgtcttaaggctccgcgtgggtctctgtcccgccaagcactctgtggacactagtgggcttgtcttcttccccctggaccacagggggtctgtggggccatagtgtgcagtgattttggtcatgttaagttcccagggtaggcaacaagagacacacgtggcaggctgaattcccttcttagcgcagcgccctgctgagctgggcctcactgaggagcggaggtgttacctgtgcgttggggactaccaagtgcttggacagcttggtcctgctgtcgatgaggctgctccagtccagcaggtccatggtgctgagggaggaggcgcatcagcagagggggcacccccacctgtgggtgctagggtcgggtgggggatcgaggcccaaacctgtccgttcaccacccaccacaaaacccacctcggtgttcagttttaaaagacagaggaaatataaatattgttttctgtttaaaaatttaaaaccagtggcatgcgggggctcaaacttataatcccagcactttgggggctgcggcgggcaggtcacttgagcccaggggtttgaaaccagcctgggcaacatggtgagacctggtctctataaaaaataaattaattaaataaatttaaaaccaaaacacaaacagtcctgcatctaggcggctctgaaaacactgagtaccctaggctgttttgggcttgtggaggggccgagcacaggcagccaggcaggaggcggacacagctccgggcggccagggaggacacagtgggcaaggctggcagtgtgtgaggggatggctcactactgcaccaccccagtcacctccccacttcaactggaggctcctggtgatctgggtcccagcccctggctccaaggatggggcatggggctctgatccttcacctgccggcgtggactccagggagggctgagagtgccacctttgctctggacccagataattctataaagagccctctatggggtctgtgctggccctgtgtctcccctgcccagcccagccccagcctcagggactcctgaagccatcaagtcctgctgtgtgaaaagcagttccttcagcactgtcatcccagggcccaccctctcaggcagggcagccaggactgggagacgtcactggggcttggctggaaccatggctgatgctcgtgtcctctcagcctgggggctgctctcacccagacactcccagggtctctgccgtgaaccagtcctcaatctcagccctggatgcgatgcccaactttgcgacactttccttgagaagtgagaaggcctggatcagccccattcactcatattttatccttccccccacccattggcctctggtgctgtttctggctttattacatcgttagtaagaacaggatccatgtctggtttgtttctactgcatagacaggtctattcccaccccgctgctgatgcacgcccacgccctgcagggctgggtctccagccctcctgccagcatctcccctctctgttcagagtccctctgacctcctcctccccaccaggccaaccccagcagctgcagagtgagccacatgccctgggtgagttcccaaaaccacctccgaccactgcccaccatgccccgtgtgaccccacggtgcccaccccctcacaagccacaggagtggggaaggggaaggctgccccacctgcagcaccgccacctccagcttggtgtccatggcagccaggcccgcctgcccttgctccacagccatttggtgaaagaagcacctccacttggccagcacctctgagaactgcagctgcaaacgcaggcctgaatgccatctgcacacgcccctgcccaccccagtcccccacacagcccctgtggccagctcaggcctctaaggcatgggcacctgtgtttttggtggatgcccacagctgccctgagatctcgcacagcaccagactctgcaggtggaaggttctagcacttaccagaaactggggtctccccagtgctgtgagcttaatggctatgaagccgtcatcgctgactctacctgtcagaagccacaggaaaagccatgacagccctgagaggtgcatggaggcagcgcagggtgcgacagggagggccagggcctggccagcccacagcaggctcctgaccccaccccaccccgcccatgaagtccttgcacatggcgctctagaggccctgtggagatgggagggggctccgtggcggggtttctgtttccatgcaggtgtgggacagcagtgggcacaggagctgcctgtcccctgccaagcagcccccacaggctccctgcctcggtttccttccctgtgccaccagcaccacaggctgctcacacgtgggtcacaggacccagaaacaccgagcgtggctaagacagagacaccccagcgaggtccccttgctcaggcctctgccccagagaccgagtctctcaggaacctctgacgcaagcgcaggctcctgcccccgtgcagccagcccgcagtcccaccctgtcctccaggccagccctcctgcagcattcttgcccctgacacttctttccaagcaacaaccagaaatgttcctttaaagtgaaagcagatcttaccatctcatcttgtttcacgccaccccaatgcagggccttccccttccacctgccctgggagaacaggcaatggacgaggagaagacgcccctcaccctgatggcccagcattcagctggccactctgaccctcagcccccatcaggaggcggcttccaagcactgctcagaagtgccaggtgcagcggcatgcacctataatcccagcactttgggaggccaaagtgtaaggttcgcttgaggccaggagtttgagaccagcctgggcaacatggtgaaacaccatctctacaaaaaatatgaaaattagctgggtgtggtagtgtgtgcctgtaatcccagcactttgggaggccaaggtggagggatcacttgagcccaggagttccaggccaaccagggcaacatagtgagacctcattttttttttttttttttgagatggagtctcactctgtcgcccaggctggagtgcagtggcgcaatcttggctcactgcaacctccgcctcctggattcaagtgattctcctgtctcagcctcccaagtagctgggattacaagcgcctgctgccacgcccggctaattttttgtattttagtggagacggagtttcaccatgttgcccaggctggtcttgaactgagctcaggcaatccacccgccttggcctcccaaattgctgggattagaggcgtgagcactccagcctgggtgacagagcaagatccagtctcatttgaagcaaacaaacaaaaacataaacaggcctgggacccgctgcccctgacggagggctgctggggccagcatggggctgtgcaggtcggatgtttctaacactgaaggacattgggccttgctgacctctggcttctctatccctggaaacacctgctgcccccaccgctggcccccagaggctgtgtcagggaaggacagaagatgcggcaccagctccctgaatggaacctccaccctgggctaagtgtggctcggcagctgacatggaccaacttcctgcagctcccgatcctggccctgagccagggagaagggtggggggcatgaggcgggatcagggaacagggagctggggcaggagaggagatgccttctgggaggcagtggggcccctcaggaaggggctgaacagtgagggacccaagtgtggtcagaacccagccctctggctcctgccccagcttagtgttcacccaccggcacctccatgagcccaggggtccgctcaggctgggacatggcaggggtatagccagcaaagagggggccccacctgaggcttcgatgcagcgcaagaatgtctccatgtggctgtcgcacttggcctcattggcgtagaagtaggtgcgggcactgatgacaccattcctgcggtccccgaaggcccagtgggcctggtattgcttgtcccgcttattcgtgcctggaatagcgaatgcacggcctgagcacagctccaaacacccacccccagcacccacacaccaatagcccagggcccctgccctcaggagggctccaagcatagtggccttgccagcctggccctggcactgcactgccccatggttcccatccccaagcccaccctcctgtctacaccgcggctcttccacctggagtgctgcatccccctggctaagcctcctcatgaggccaggacggcagtctccttaacaaaggcctaggtccaccaggaggccatgaaaaaggagcagggcgtctccccagacacttgcgagtatgtcagagcccagagcgacagggcaggtgccctggacatagggaggagcccgggctccgacgtcaccccaaggcccacttgtgccccagcctagactctcctgagccaccaaggggtgtgcggagtcgggagggagtctgttcctgcgcggcagcctctcactcaccactgccatccctctccgcagctgaggtgcaggacctgtgggaaggagggggagagcaaaggtcagggtcacgccacctgagcctcaggtgacaggcacgttcccactgaggctgcacggagggccccaccacaaccccggtggagggtagattccaaggtgcagccccagccccacccctagcctggggtggaacacttgggcctgggaggggcagcagtttatggggctgctgtgtcccaagggctcaggaagcccggggctccttgtgggtggagaaatcagaacgatattcctgagctctcagaacagcccagggcttgcagcaggttctcaaataaaggtagttacctggttccaagacagagccagtcagggctgagaggaacggaggcgggaaggcaccagcacacagaggtccccaaatccccagcgaggcccccttactcaggcctccaccccagagccagggtctcccaggcagctctgatgcaagcacaggctcctgcccccgcacagccagccctgcagtcccgccctgtcctccaggccggccctcctgtagcattcttgccccgacacttcttttccaagcaacaaccagaaatgttcctttaaagtgaaagcagatcttaccatctcatcttgtttcacgccaccccacccagggttcccatcatttcctagtaatgcccaaagtcctgggcccctggcttgggcacctcaagaccagtgaggccaggatgcaggctgtcccccgctaggctggccacactctgctcagccaagcccctgtccttcctgcagaagcctctccatccccgcctggccagcacccccattccccctggcccctcccttctctagggtacctggctcccctcccccaccagccctgcacccctgccagagcctcctcttcttcctcctcctccccacagccacaatctgcttctggcacttggtttcagtgctgtgtcatccaggctagcaagagttgctgcggccgttaagtctgctgtgacaaagcgaccatggtctccctggcccccggagcagctctgagggtcacctgactttatattcaaacctgatcaagtcagtgaccacggagagagctcagctgcatgaccaacagcacccagagccttcctgaagctccccagaggcgctcggaccctcaggggcagctctgcccacactcacaggaaaggagagggtccccctcagatgccgggaaggggaaaggcagagcagtggtcagtgagccgcatcccagaggcctccatgtcaaggggcctcagctgcccactttccacctggctgctcaaggagcaagccctgggccaggagcccccgccaggaggccttccctcccacccactcctgggcagccccacatgggccagggactccacatgtgctgccagggcccctgaggctgcagcccagtgatgggagctggcaggcagatatgctctggccaccttatgctgacagagatgtgacagaagagggtggaatgtcaccatgtgactagggaacaggcaggcagcacgtgaacccctgcctgagacagggagctcctgggcccctggcttgggcacctcaagaccagtcatgagatcagccctaagaccttcacgccaaggcttaggtacagccaggaaaagccatccccaagggggactcactgtctatgttaaggccggggtggcagccagggccctgcccagggcagaaaccctcatggcaagtaacagcagacagtggggacagggcctcaggggcctccatgaccctgaagagaaggtcccatcctgaaaccacacagcccacagtttggataacacgggacttaaccacacaggtgtctgcctgtgaggcagctcaccttcatgaaacaggatcattatctgacaggtccccaggcagatgagttcccgctcagcattcccacagctgctgtgttcatcctctgaggtgggcctggcaggagaggctggggaagccagggctgctccctctcctgctctgacacactcagaggcagaacaccataggctaccgctgctcctctccgtgaacttccagagcacagaccaggctgacacagccaagcagtggccaagatgaccacacagcacgtgcagtggccagaggggcagccaggtctcagagtggatggctacgcagcaaggacagggccacactctccaacaggcatcatggataagtcacaaggagacacaaatggtggttcccaggcaggtcaggggtcctatttccactggagaagaggaagaaagcaccctgggagcagctgattcagaactgcgggtgccacacaggaaatctggctttcgccacctgggacgttgccacgtcctggctcaaggcaccacagggaagaggggggcacatggcactggcagctgtggggtgttagaggaggaagggtgaaccagtggatgtggggccctgatcagggtggggaccacatcccaatgcctccttaaagccaggacctgcctcgtgctcccccagtcccacccctcatcatgcccagggcatagtctgttgaagggcacatgatcgcacacatgggcacgacctgggacaacagaggagggaagagcgacaaggggacatagggcagaggaggacaagcacgtgtccccagggggtcttcagagacagcaggaagaccctgaccaccccctcagcctccacctcagctctgggtggctgtccctggggacgtgatgcctattgaaacaagcagagcatgggggtccacaccccgcccttgtccaactctctcctggagggaagcctggcaagccgcttcctacctgtacccccctccccagctccccaaccctctgcctccccagcccctcgctcaggacactcactgcacacatatcctgcctccagccagccctgggcctgcacagccagaccaatgcccccatccaccccctaggtgttccctcacagcccaatcatcaggaagatgccttggccccttccccatccccaagccctcagcctgcttcggggatccctgggactcctctcctggggttgggtggggccctggcctctgggaagcatggtccaccccccccccgggtgggcattgccctcctgcacctccaggctcccacctcctctttctttctcgggagcactgctgggactcactttgccatgcactcagacgcctccatcctccctgggcctctcacggccagcaccacttgccatggccttaatttggggcggtggcctcagtgtctctccccagagtagagcccatggcccttgtgacaggagggtaggttaggaaggcagatctctaagcagttccctgcactagggtctgcgtgactggtcactcctggccaagcaggccatgctgcagtgtggacatcagaccagtgcttgcagacccagccctacccccatggctcaggcccctctgaaagcacaaagcagctgagctcggtaggtgtcctcagcatgcacccctgtgaggacaggagggaaccctgttcacttcccagagctggagcaggacccctgcagacagcagccaccagcagcaagacaggtgaatcccttgcagggcaaaggactcaagctcctaaggacacaggtgcccagccccctggcagagtgcaggccagtccacctccagacactcagcctgcagggcagggaggaagccaggcaggaccaccctgggaaaggagtcttttcataccagaggcgcctgagaggaaaatcccattgtgaaaccaagtccccacccagactccttctgagaacacacaggccattggttattcaacaggcagctcagcaaaggctgcagccaagagctcaggcagctgcaaggcccacggggcctgctaggaacacagtggggtgctggggctgtagtaccccaccttcaaaacagccaatcgcaaggcaggggctgggctcccctggccaatcctctccaggcagctggcagccgacatgctgaggcaagcctcagacattccgttcccagggctggaggcctcatgtgactgcctttccctccccttcccaggccagccaccaggggaggggcaggaacaaccaccaaggcctgaccaggtccacagagggactgtcccaagccttatgtgggtcaggcccggctgctgtcagggtgcaggggacccaaatacataggaagacatagggagatcccatctttacaaaaaaaaattaaaacttagccaggtatggtggtgcgtgcctgtggtcccagctacttagggggctcagatgggaggatcacttgagcccagaaggttggctgcagtgaacaatggcaccactgcactctagcctgggcaacagagcaagaccctactttaaaaaaactggttgaaagaaatcaaaacaagaataatattttgtgacacaagaaaattatatgaaattctaattactatggccctactgaggcagagtgaagccgttgtggcagggagggtgtggcccgactgagagtctgtgctacctggctgtttacacaaacttgctgacctgatggaggaggctctgctacagcctctcttttgcagggattcctgacccgcaggcaggtcccactgcccgacccttgcctggcctcagcctgccctgcagttgtggaacctcccaggcctggcccctgccccattgtcagtggagaagggaattgaagccaggagcagtgtagcaggccggcctggagtcagctcctggaggccactaagctgatacaaggccccttccctgggcagtgagtgtagagggcagttggtaccaccctgacccgccctcctgggcagggcatcaggacagaacaacaagaccacgtttccctccacttcctggagcagtccctggctcatgtgagatccaggcgagaccaaccattctttgcagagtgcttggttcatatgctggtgcctgtgctcctccaggcggtggactagatagggccaagggccattctgtactctgcttcctcaggcctcacgcacaccaggcctcccatgaaagcccagagctgtccaccgcatgaaacaaaaatgcaagaactccaggcagagcccaggagggtcatcggtagttgggctgaccaagctctcctagccttggcctctgcccagctgaggctgaagcccagcagctggatacatcccacctgctcccactgggtgctccagggtcatgatcagaaagcccgcagacaccgggcaggccttactccatctccttgtgctctgcctcctcggggctcaggtcctcctccactccatagtccaggatggcgctgacaccgaaggccctgtagtgccgaagcaggggctggatggactcctggtcctccccggctacaaaatgcccatagaaggtcatcttcatgagcttgttgaatagcctctgtcctagaagtttcctggaaacatacagcagctgaaaggcaaagggaagccgctgtcctgggctgcctgaactctcctttcccagcaaggcaccgctgctcatccccgaccacacttcaccccagccatggggcctcgatatggtctcttggcgactgggctttcagggtcagtttcatggtgaagaccagctaaagccgcttgcttctccaccctgtccatcactccagttcccatccagggcagagagaccacaggaggtgctgcctgcttggcctgaggacactgttcccacctggactctgccccttcagggccccacccatgagtcactccagcagcacacagtgggtgcctgaccactgcttggtggataaaaaggagaatggccagcctccctggggatgacagccggcattttgagaccatcctctgtatccacaccttggtagttctgctgcggaagaggaggatctaacttgactttctagtacttgagtgcccagatttttcaatgttttgttccctcttatcccaagtcccttaaacagtgtgactggcatgaggccagcccccgaatggatgctaaataacaaacgtgtgaaactcaggctgagtctgcgcccagctggagggaggcatgccctggcaacaaggacaatgagctagatgacagtccacaggggcctgtgagatgactcccaccccaggacccatgcgctctgcagggtcatctggggctgaccagccactctgacagatgctgcccgggaactgtctgtctcctccaatcatatttcaccacgtcgctcattcagatgtcccaagctgccatgcaccaagcaccttttatagactggaaacaaccaaaggaaaccgaccaggatctcacatcctggtggtaaaggaaccccaaaggggaaggagggactctgcctatgactcaggacagggggatggggcagtgcctgcagggtagggcaggggtgtttactaacccagatccaggagtggggcttgccaaggcgaggagatggcatggacaactgtgggagctccagcacgggggacagccagggcagaaaggacagggacaacgagaggctacttggagaggagggccgagtgtgatgctcagaagcacacctccgcgttgtgtctgctgcccctgccgactcagccccaacacaggaagagcctggggtttctcaaacccaatggatactagaactccttttatgtggggagcatctcttgagaccgtagtttcaggaacaacttctagtctaagcaaaaccattagcgagtcaaacacttacacccaagccagccctgagcacccacacgcctgcccacaggcagacatagccccacagccttaccctgaacattggtgccccatggagacgcctcctgaccatcacccctgggcacgccatggggcagccccaaggaccagggtttcccaggcactcacccctgccttcctgcagcctccaagcagaatctgactttaaggcattttgttcttttatcaagaggattagaaactggaaaatgaacaggctgacatgttctccgtctcccactgagcctgagccaggcctcattcctgctggcagcacccagggatagttgggagaacaggatgggtctgaaacatatcaaagatcacccaagtggcaggcggggcagaactggggacctgaacaccatcactgggcttatccacatccgctctgagagaaccatcagaaaacaacaggagggagggtgggcaactgtcgactgccgcacggggccacgcagtctccctctacctaactgctcgcctccgcacggccagcactaaatgaaggggcgggagcccaggctgcactgactccagggatgcttattcacaaagatggggggctgggggactgggcccgggctgagggtggaagctccctgcacagggctgcagaagcacacaggcagggctggcaagttttttatttatttatttttagaggcagggtctcactcctgggctcaagcgacactcctatctcggcctccagagtagttgggactacaggcatgcaccaccacactcagctaacttttattttttcttttttttgaggcagagttttgctcttgttgcccaggctggagtgcagtagcacaatctcggctcactgcaacctccacctcccaggttcaagcgattctcccgcctcagcctcccaagtagcagagattacaggcgcacaccaccatgcccagctaatttttatatttttagtagagatggggtttctccatgttggccaggctggtctcaaactcctgacttcaggtgatccacccgcctcggccacccaaagtgctgggatgacaggcatgagccaccgcacctggccccagctaacttttaaaaatattttgtagagacagggtttcacgatgttgctcaggctggtcttgaactcctagccttaaatgatcctcctgccttgacctccttaagtgctagaattacaggcatgagccaccatgcctaggcatgagcctagggcttgtaattttaaagctgactccacagcaaagcaaccactttaacaccatcctggtgtcactgatgtccccgcatggcactacctgagaccagggcagccccacatcttcttcaggtgaggagatccttcgaggatttagaaacctgcaccagtaacacatacacttgtaccccctgtgaaagactcaaccaaatgtgtgcagagtaacactggtagagccggttctctcccctccccccactcagggaaccactgtcaccacgggtcctgtcccttctgtgagggcgcacacccaacctcagtgctgttgtcatggaaatcctgggactttcctaaaccctcctcaataagtctggctttcaggcaagggcgggccccactgctgtccccatccaaggcagcagctcaaagatcagctactacaacctgacacgcctgtggcagatgtggcctcactgcccgggtgcctcacagacctgtgctggctcagcagaaggaatctccccacagcccagagggtgagggaaggaactcccctctggcccgctcacaggaccaggttctagtgagcagctcacaagcccaggacctggcctctgccttcttccagtgctgaggctgccgacacccatgggaccactagcaagacaacagtacagaccccactgagggacttcccagggcacaggtgggaccctaggggagcctgggagaggtcacctctggatgccctgcctcttccaggtactcacagcaccatccctgagccctggcacttgcctcaagaaggcacccaagggacagcggagccaacagtttcctcccacagtcacggaacagcacctggcattccccgcagcagactgggcaccaaaccccacacccagctctgctggcttctctgtgcaacaacttgtcttgaatctagacaagaaaccttagggctgtgcctacagaaacctgacctggtgccttcctagccccctccccatcccagccatgcttagggctgtgcctacagaaacctgacctggtgccttcctagtccccactccatcccggccacaaggtgggcatggcttctgcacgactggccccagctgccacctagcatgcccgtccttgccctgggcagggacctgtggctggccactccctcccctggcatttctgccctgctgcctcctcctcctattgcagcaccaccagcactggctcctcttttgggatgccccttagatgtgggcactccccaaagcctccacatcgccgtccctcaccttgccagttcctctacctgggatgtcccttctcgccctcctgtctccttggccggggctctctatgaccaaaacttgaccttaagacatccttgtgtgcacacacagcaatgccctcccagagccctccatctgtccagttcagctccttcttcctccaccatcctccgcactcccgccaccacgggtcctaggctgaccttggcgctccccatgggattcgggccaacagcatctgactctgagttcgtggatccctgccctcacctcgcacccgccgaggcctcacctaagctcaactgtggctcggtgcttctcatctgacaccgtcccccgccttcccccgcctcctgttgaggccaggggtgcagcccccgacctctgtacagtctcacctgagaaatcaacaccaccagataccctggcgccaaaaagcggaaccttgcaaactcttcccagggtcacctggagataaccgtcatctctagtacccctaggctgatgcggctaaaacagtgttctgcttgttgccccccaccaccgccaccaaaagccctgacactttttaaagctaccatgggtgagttcaaagctgggcgtttgaggggcttcccatttttccccaacagtgttctcagagtggccgtgtctgggaagctgctgggtcccggggtttgaattccggggttccaggctatgagccctacaccaggattctcttgtctcaacatgaagaatactccattttaaattccaagtgataactctgtattcccacaagtggtatatatcgtaaatatgaaaacgaccattgtttttagttggtagacatcgacaaataggaaaatttgcgaggtccgagagggactgcaggaaacgcctcccttcctggcttcccttgctccaggagatgcttgggaggcacccgtttcaggccaggaagctccgtaaaggctcccgggaccggcagaagcccccgcgcccccgcctgcaccccgcgcacctgctcgtggcgcgccagcagcgcgggccaggcgcacaagcgcagcaccagcaggctccgcgccagctcccaggttcgccggctgcggtacgcctcctgcgcgttgccgaagtccacggcgggcaccggcggccgcactgccgtggccgacccacctcctggcacggccgctgggcccgctgcgggctgctcgcgggaggccggcgccgtggacagcgggacgaagcggggaatgcaggggcgcagcgcgggcagggcgcgcctcagagccatggcgggacggcggtacccgcccgggccgcttaagtgtgcgctgttggtcccgccccgccccgccccgccccgccccgccccgctcggtcccagaggcctcaccctatattcctgacaaatgccagacaagggcttagacttcacaagcaccctggcacttcagctgcatggtggggaccctctgccggcagggctgaggccaaggcccactggcttctcaaagcctctgctcctgctctccgtgaagacagcaacagagtgagaccctgtctcaaaacaaaaattatgtattttcagatagcttgaaggagaatattgagtgttcgtaatgcaaagaaataataaatgtttgagatgataggtatgctaattacccttatctgatcactatacacgtacagaaacatcactacgtaccccacaaatatgtacaattattatgtgtcaactaaaaaataaaaatagccgggtgtggtggctcacgcctgtaatctcagcactttgggaggccgaggcaggaggatcttttgagcccaggagtgccagagcagtctgggcaacatagtaagacctcgtctctacaaaaaatagaaaattaaccaggcatagtgttgcatgtctgtaatcccagctactcaggaggctgaggtgaggggattgcttgagcccaggaggttgaagctgcagtgagctgattgtgccactgaactccagcctgggcaatggagggagaccctgtctcaaaaataaaagtgaattttttttttttgagatggagtcttgctctgtctcccaggctggagtgcagtggcatgatctcagctcactgcaacctctgcctcccgggttcacgccattctcccacctcagcctccagagtagctgggactacaggcgcctgccaagcctggctaattttttatgtttttagtagagacggggtttcaccgtgttagccaggatggtcttgatctcctgaccttgtgatccgcccgcctccgcctcccagagtgctgggattacaggcgtgagccaccacgcccggtgaatttttttttttaaagaaagattccggacacaaacggccacaagttgtatggttcgttttatatgaagagttcagaatagacaaatcgatagagacagaagtcacacgaagacaagcccatagtggagcctggtgagtatggcactggcagtggtgcctggaggtggaggacgggaggagtgggaggggctgccaaggcccacggagtttctttggggtccggaaatactctggggctagagagtggtgatgtttgctcaaccttgtgtatagactaaaaaaccattcaatatctcaataaagctgttatatttttttaaaaaagcaaagttctagcatttgcttcaaggaagcctgtggccctgcacagaggcaaaggtgggcaggggctgccaggggcagggctgcagagagggcagggggagaagcgaggggtgcagggatcacagagatcaccactcacgtccagaccatagcagagcaggcctagcgctgggtgcccaggcccacgggagagcccacctgtgagggcacctgtgggaacaaggctggcctgaaagtcactggctccatgtgacaatcaatgaaacaaccgagtttcacaggagctctgtaaatcctaggaagcaggtcttaggctcagctggggacccttggcaggtggctaccctgagccagctgatggctttttttttttttttttttaagagacagggtctctctctgttgcccaagctggagtgcagccatgtgatcacagctcactgtggccttgaactcctggtgtctcatgtgtccctgtgaagggaccaccaaccagctttgtatgagcaacaaggctgtttatttcacctgggtgcaggcaggctgagtccaaaaaaggagtcagcaaagggtggtgggattatcattagttcttacaggttttgggataggcagtggagttaagagcaatgttctgggggcaggggtggatctcacaaagtaccttctcaagggtggggagaattaccaagaaccttcttaagggtgggggagattatgaagtacattgatcagttagggtggggcagaaacaaatcacaatggtggaatgtcatcagttaaggctattttcacttcttctgtggatcttcagttgcttcagcccatctggatgtatccgtgcaggtcacaagggatatgatggcttagcttgggctcagaggcctgacacctgggctcaagtgatccccctgcctcaacctcccaagtagctgggactacaggctggactgcacctagctaatttttaaaaaatatttttttgtggagacagggtctggctgtgttacccagtgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaagcagatgcttgaaggcagcctgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacacccgtaaagggtctgtgctgaggagaattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaaatgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacatctggtgcccaacatggaggcttttctctagggtgaaggtacgctcgagcgtggtcattgaggacaagtcgacgagagatcccgagtacgtctacagtcagccttacggtaagcttgtgcgctcggaagaagctagggtgataatggggcaaactaaaagtaaaattaaaagtaaatatgcctcttatctcagctttattaaaattcttttaaaaagagggggagttaaagtatctacaaaaaatctaatcaagctatttcaaataatagaacaattttgcccatggtttccagaacaaggaactttagatctaaaagattggaaaagaattggtaaggaactaaaacaagcaggtaggaagggtaatatcattccacttacagtatggaatgattgggccattattaaagcagctttagaaccatttcaaacagaagaagatagcgtttcagtttctgatgcccctggaagctgtttaatagattgtaatgaaaagacaaggaaaaaatcccagaaagaaacggaaagtttacattgcgaatatgtagcagagccggtaatggctcagtcaacgcaaaatgttgactataatcaattacaggaggtgatatatcctgaaacgttaaaattagaaggaaaaggtccagaattagtggggccatcagagtctaaaccacgagggacaagtcctcttccagcaggtcaggtgcccgtaacattacaacctcaaaagcaggttaaagaaaataagacccaaccgccagtagcctatcaatactggcctccggctgaacttcagtatcggccacccccagaaagtcagtatggatatccaggaatgcccccagcaccacagggcagggcgccataccctcagccgcccactaggagacttaatcctacggcaccacctagtagacagggtagtgaattacatgaaattattgataaatcaagaaaggaaggagatactgaggcatggcaattcccagtaacgttagaaccgatgccacctggagaaggagcccaagagggagagcctcccacagttgaggccagatacaagtctttttcgataaaaatgctaaaagatatgaaagagggagtaaaacagtatggacccaactccccttatatgaggacattattagattccattgcttatggacatagactcattccttatgattgggagattctggcaaaatcgtctctctcaccctctcaatttttacaatttaagacttggtggattgatggggtacaagaacaggtccgaagaaatagggctgccaatcctccagttaacatagatgcagatcaactattaggaataggtcaaaattggagtactattagtcaacaagcattaatgcaaaatgaggccattgagcaagttagagctatctgccttagagcctgggaaaaaatccaagacccaggaagtgcctgcccctcatttaatacagtaagacaaggttcaaaagagccctatcctgattttgtggcaaggctccaagatgttgctcaaaagtcaattgccgatgaaaaagcccgtaaggtcatagtggagttgatggcatatgaaaacgccaatcctgagtgtcaatcagccattaagccattaaaaggaaaggttcctgcaggatcagatgtaatctcagaatatgtaaaagcctgtgatggaatcggaggagctatgcataaagctatgcttatggctcaagcaataacaggagttgttttaggaggacaagttagaacatttggaggaaaatgttataattgtggtcaaattggtcacttaaaaaagaattgcccagtcttaaacaaacagaatataactattcaagcaactacaacaggtagagagccacctgacttatgtccaagatgtaaaaaaggaaaacattgggctagtcaatgtcgttctaaatttgataaaaatgggcaaccattgtcgggaaacgagcaaaggggccagcctcaggccccacaacaaactggggcattcccaattcagccatttgttcctcagggttttcagggacaacaacccccactgtcccaagtgtttcagggaataagccagttaccacaatacaacaattgtcccctgccacaagcagcagtgcagcagtagatttatgtactatacaagcagtctctctgcttccaggggagcccccacaaaaaatccccacaggggtatatggccccctgcctgaggggactgtaggactaatcttaggaagatcaagtctaaatctaaaaggagttcaaattcatactagtgtggttgattcagactataaaggcgaaattcagttggttattagctcttcaattccttggagtgccagtccaggagacaggagtgctcaattattactcctgccatatattaagggtggaaatagtgaactaaaaaaaataggagggcttggaagcactgatccaacaggaaaggctgcatattgggcaagtcaggtctcagagaacagacctgtgtgtaaggccattattcaaggaaaacagtttgaagggttggtagacactggagcagatgtctctatcattgctttaaatcagtggccaaaaaattggcctaaacaaaaggctgttacaggacttgtcggcataggcacagcctcagaagtgtatcaaagtacggagattttacattgcttagggccagataatcaagaaagtactgttcagccaatgattacttcaattcctcttaatctgtggggttgagatttattacaacaatggggtgcggaaatcaccatgcccgctccattatatagccccacgagtcaaaaaatcatgaccaagatgggatatataccaggaaagggactagggaaaaatgaagatggcattaaaattccatttgaggctaaaataaatcaaaaaagagaaggaatagggtatcctttttaggggcggccactatagagcctcctaaacccataccattaacttggaaaacagaaaaaccggtgtgggtaaatcagtggccgctaccaaaacaaaaactggaggctttacatttattagtaaatgaacagttagaaaagggtcatattgagccttcgttctcaccttggaattctcctgtgtttgtaattcagaagaaatcaggcaaatggcgtatgttaactgacttaagggccgtaaacgccttaattcaacccatggggcctctccaacccgggttgccctctccggccataatcccaaaagattagcctttaattataattgatctaaaggattgcttttttaccatccctctggcagagcaggattgtgaaaaatttgcctttactataccagccataaataataaagaaccagccaccaggtttcagtggaaagtgttacctcagggaatgcttaatagtccaactatttgtcagacttttgtaggtcgagctcttcaaccagttagagaaaagttttcagactgttatattattcattatattgatgatattttatgtgctgcagaaacgaaagataaattaattgactgttatacatttctgcaagcagaggttgccaatgctggactggcaatagcatctgataagatccaaacctctactccttttcattatttagggatgcagatagaaaatagaaaaattaagccacaaaaatagaaataagaaaagatacattaaaaacactaaatgattttcaaaaattactaggagatattaattggattcggccaactctaggcattcctacttatgccatgtcaaatttgttctctatcttaagaggagactcagacttaaatagtaaaagaatattaaccccagaggcaacaaaagaaattaaattagtggaagaaaaaattcagtcagcgcaaataaatagaatagatcccttagccccactccagcttttgatttttgccactgcacattctccaacaggcatcattattcaaaatactgatcttgtggagtggtcattccttcctcacagtacagttaagacttttacattgtacttggatcaaatggctacattaatcggtcagacaagattacgaataataaaattatgtggaaatgaccaagacaaaatagttgtccctttaaccaaggaacaagttagacaagcctttatcaattctggtgcatggcagattggtcttgctaattttgtgggaattattgataatcattacccaaaaacaaagatcttccagttcttaaaattgactacttggattctacctaaaataaccagacgtgaacctttagaaaatgctctaacagtatttactgatggttccagcaatggaaaagcagcttacacagggccgaaagaacgagtaatcaaaactccatatcaatcggctcaaagagcagagttggttgcagtcattacagtgttacaagattttgaccaacctatcaatattatatcagattctgcctatgtagtacaggctacaagggatgttgagacggctctaattaaatatagcatggatgatcagttaaaccagctattcaatttattacaacaaactgtaagaaaaagaaatttcccattttatattactcatattcgagcacacactaatttaccagggcctttgactaaagcaaatgaacaagctgacttactggtatcatctgcactcataaaagcacaagaacttcatgctttgactcatgtaaatgcagcaggattaaaaaacaaatttgatgtcacatggaaacaggcaaaagatattgtacaacattgcacccagtgtcaagtcttacacctgcccactcaagaggcaggagttaatcccagaggtctgtgtcctaatgcattatggcaaatggatgtcacgcatgtaccttcatttggaagattatcatatgttcatgtaacagttgatacttattcacatttcatatgggcaacttgccaaacaggagaaagtacttcccatgttaaaaaacatttattgtcttgttttgctgtaatgggagttccagaaaaaatcaaaactgacaatggaccaggatattgtagtaaagctttccaaaaattcttaagtcagtggaaaatttcacatacaacaggaattccttataattcccaaggacaggccatagttgaaagaactaatagaacactcaaaactcaattagttaaacaaaaagaagggggagacagtaaggagtgtaccactcctcagatgcaacttaatctagcactctatactttaaattttttaaacatttatagaaatcagactactacttctgcagaacaacatcttactggtaaaaagaacagcccacatgaaggaaaactaatttggtggaaagataataaaaataagacatgggaaatagggaaggtgataacgtgggggagaggttttgcttgtgtttcaccaggagaaaatcagcttcctgtttggatacccactagacatttgaagttctacaatgaacccatcggagatgcaaagaaaagggcctccgcggagatggtaacaccagtcacatggatggataatcctatagaagtatatgttaatgatagcgaatgggtacctggccccacagatgatcgctgccctgccaaacctgaggaagaagggatgatgataaatatttccattgggtatcgttatcctcctatttgcttagggacagcaccaggatgtttaatgcctgcagtccaaaattggttggtagaagtacctattgtcagtcccatcagtagattcacttatcacatggtaagcgggatgtcactcaggccacgggtaaattatttacaagactttccttatcaaagatcattaaaatttagacctaaagggaaaccttgccccaaggaaattcccaaagaatcaaaaaatacagaagttttagtttgggaagaatgtgtggccaatagtgcggtgatattacaaaacaatgaattcggaactattatagattgggcacctcgaggtcaattctaccacaattgctcaggacaaactcagtcatgtccaagtgcacaagtgagtccagctgttgatagcgacttaacagaaagtttagacaaacataagcataaaaaattgcagtctttctacccttgggaatggggagaaaaaggaatctctaccccaagaccaaaaataataagtcctgtttctggtcctgaacatccagaattatggaggcttactgtggcctcacaccacattagaatttggtctggaaatcaaactttagaaacaagagatcgtaagccattttatactgtcgacctaaattccagtctaacacttcctttacaaagttgcgtaaagcccccttatatgctagttgtaggaaatatagttattaaaccagactcccagactataacctgtgaaaactgtagattgcttacttgcattgattcaacttttaattggcaacaccgtattctgctggtgagagcaagagagggcgtgtggatccttgtgtccatggaccgaccgtgggaggcctcaccatccgtccatattttgactgaagtattaaaaggtgttttaaatagatccaaaagattcatttttactttaattgcagtgattatgggattaattgcagtcacagctacgggtgctgtagcaggagttgcattgcactcttctgttcagtcagtaaactttgttaatgattggcaaaaaaattctacaagattgtggaattcacaatctagtattgatcaaaaattggcaaatcaaattaatgatcttagacaaactgtcatttggatgggagacagactcatgagcttagaacatcgtttccagttacaatgtgactggaatacgtcagatttttgtattacaccccaaatttataatgagtctgagcatcactgggacatggttagacgccatctacagggaagagaagataatctcactttagacatttccaaattaaaagaacaaattttcgaagcatcaaaagcccatttaaatttggtgccaggaactgaggcaattgcaggagttgctgatggcctcgcaaatcttaaccctgtcacttgggttaagaccattggaagtactacgattataaatctcatattaatccttgtgtgcctgttttgtctgttgttagtctgcaggtgtacccaacagctccgaagagacagcgaccatcgagaacgggccatgatgacgatggcggttttgtcgaaaagaaaagggggaaatgtggggaaaagcaagagagatcagattgttactgtgtctgtgtagaaagaagtagacataggagactccattttgttatgtgctaagaaaaattcttctgccttgagattctgttaatctataaccttacccccaaccccgtgctctctgaaacgtgtgctgtgtcaactcagagttaaatggattaagggcggtgcaggatgtgctttgttaaacagatgcttgaaggcagcatgctccttaagagtcatcaccactccctaatctcaagtacccagggacacaaaaactgcggaaggccgcagggacctctgcctaggaaagccaggtattgtccaaggtttctccccatgtgatagtctgaaatatggcctcgtgggaagggaaagacctgaccgtcccccagcccgacaccaagggtctgtgctgaggaggattagtaaaagaggaaggaatgcctcttgcagttgagacaagaggaaggcatctgtctcctgcctgtccctgggcaatggaatgtctcggtataaaacccgattgtatgctccatctactgagatagggaaaaaccgccttagggctggaggtgggacctgcgggcagcaatactgctttgtaaagcattgagatgtttatgtgtatgcatatctaaaagcacagcacttaatcctttacattgtctatgatgcaaagacctttgttcacgtgtttgtctgctgaccctctccccacaattgtcttgtgaccctgacacatccccctcttcgagaaacacccacaagtgatgaataaatactaagggaactcagaggctggcgggatcctccatatgctgaacgctggttccccggttccccttatttctttctctatactttgtctctgtgtctttttcttttccaaatctctcgtcccaccttacgagaaacacccacaggtgtgtaggggcaacccacccctacaacccaggttgatctgaaactcctgggctcaagcaatcctcctaccttggcctctcagagtgctgggattcaggcatgagccactgcgcccagtcatggattattttgaaagaatgatgccctgccagggccagaggatccaggtgggagttggcggtgggggggtcctcagggagatcggctggatgggagttgagtgccggggacagaggggtggggtctgttctccagctcaggagacaggcagagctgagagggccagacttgggcatgtggtggtgacccagctgctgggcgcccccgaggttgggccggtcaccagggcctgccactcccaaggaggaagcagacaagaaacagaccttcgagggtagagaggccgctgtgctgcctgtccgggcccctgcggacatgcagtcagccccgctcaggactccttccattctcccacttgcactcattcccagcgagataattgtttctcctcagccatgagcatgacattggagctctggcaaagtcaggtttttttgttgtcttttttgccatgtgcctcttacctgtactcctgaaatatttgtttctgtgctggaaccatggctccctgcattcattctgatttgttgcatttttgctgcttgccctgtagctacttttaccaatacatttgctctgtctgcaggcaaaggaattcattcacatttgtttaatttggagcttgtctttcctttatcagcctgcaccaaacctgggctgctgggtatataaatttccctcatcggtacgttatcccattatccacttcatgctgccgttcacagatcctacttgagttctgttcagctatgtcattttattcattttttgcaaagctagtaaaatgtgattgcatttcctgaagttaagattgtctgctggatcccagaacacgccactgtttatgtgaatgcaatcacacttcaccactttatataatcattttcaatgcgtgtatgagaaaaggtagttagatccccccacccctgctagattgtttcctgctgagaccagcttagtcggggagaccctaacacggtggcgctagaataattaaagacacacacacacagaaatacagaggtgtggagtgggaaatcaggggtctcacagccttcagagctgagagcctcaaacagagatttacccacatatttattgacagcaagccagtgataaacattgtttctttcttttttttttttgagacagagtctcgctctattgcccaggctggtgtgcagtgggacaatctccacttactgcaagctctgcctcccgggttcacctgcctcagcctcccaagtggctgggactacaggcgcccgccaccacacccggctaattttttgtatttttagtagagacggggtttcaccatgttagccaggatggtctagatctcctgaccttgtgatccgcccgcctcggcctcccaaagtgctgggattacaggcgtgagccactgcacctggcgtgtttttatccattttaatgggttactagctgctaatctgtctgcagctccttcaagcactccagttcctggcattaaggtcagatgttcctgggatgctttaaatatttgttcttttaattttgcacatccaaagacaaatttgtagagggcccttctagatgcttttttattctttcccaaattttgatcttattaagaactgttaatagtttccacaaatccttatgtgaagctcctagagcgggccatatcatttgagattgaggtgccactatactgccatggttccagataatgggaacttttgccatacttcttatcatttctaccacctgaccatttgttcagaccagctgaacatagggtggccgtggcatgcagactgagaggtgcaattcaagctaaacatccccttaggggaccaatcaataatgattccataggaatcgctgcgcagcacctctgcctgttctgcaatgcaatcttcctaaacaagtacgttcattatttctggccaggttctattttgtttacaaataggtttttgaaggcagtatgcctcaattataggagcagatttattatggtaaatactgagatcagaaagcatgtgtaaatacgtcatagagtgattactttcaggcattattaccagtcaagattgataaatatgccctgtaagtataattgttctctgtgtcagaccttgttgaaggaatactcacggcagtggtgataaccgatatcatagctaccagtaaattactcattgtgactggttgtccctctttcctcaggttttcttctgccatctgtgacagcttcttgatctgtccccaggtgggtggctgtgttcaatgggtgttgcttgtgacagttggctggtgtgagatgtgtttcagccccaggtctcagccagtggtcgcccagtggcacagtcagagccgggcctgcctggttccctgggctggcactctgagtccaaggtggcacggttgggcagcgacccctccctgagcccccaacctctgacctcctaggcactggcctgagccgtggcttctgaaaaggaaaacctgggaattccttcaatgtccaccttaggtgatgatgggctcagggcaccatggggtgtgcccaagatgatgagcccctccctgcatgtcagtaacagggacacacatctctgatgcgcggggagggaagagtctgagtgtgtgaagctgtctgtccatgcaggccacatgtggatggggggcaaggacatggaatggaggaagacaggactcaatgtttttgcatcgaccgctcttgtataagagcggtctttacaaagtaataatgccttgagttaaccccacagtttatcttgtaatgtggaacagtcagggccaattgaagatgagcatccccctgaggctgactcatagccgggccgctggagccaggcccttcggggtatttgagatttctttagccaggcctggggggcactggcagggagtgcctccagagctgttcacggcctttgtctcccctctgggaagggcactgagtggagtcaggtgaggggcccgtgctcgcccaccagggttgttccaaacacaggcagcagggctccctggcaagctcccgggtgccctgtgagcagctctgacgtcggtggacagtgttcccagtgagtctgccgtcagtccttgtgcccagcattgattttccttccgcggtcaagctaggctgtgttgttggtactcgctgtacctccaggtgctgagcaagctgaccttggcctccctggccccacggctgcatgaggctaatctccccctacacaccccacccctctgcccccgccaacaccagggcacagaggggctggcccatggctttcttgaaacggtgcatttcacttctgattataaaactaaggcgtgctttggtagacagcgtggtggatatggggaaggataaaaggacatcaacctgttctgacatcccagcacccagggcagggacccagaggggagatttgggtgtatttctctccgttgtcttctctgcaggcatgacacaggtgtgcacacactcatccagcccactgacgtgtgcacaagcatgaacacatgtgggacacttgccctgcgctgcagtgtgtgtgagtcatgtgcacgtccactgccctctgtggaaggcgtgttcacacctgtgcacatacctgaggccgctctatcactgcaggcccctgtgcatttcctgggaggtatgttcccatttcattaagaattctcggccgggcgctgtggttcacacctgtaatcccagcactttgggaggccgaggcgggtggatcacgaggtcaggagatcaagaccatcctggccaacatggtgaaaccccgtctctactaaacatacaaaaattagccgggcgtggtggtgggtgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaagaaaaagaaaaagaaaaagaaaaagaattctcagtgatggatctactccaggccctgcctcaccatcactagccacagagctactcacagccagtgctctcctcacaggggtctgaatggcaaggagtgagccgcaggatgacccaggacaagtggcagcaacagggtgagttcccaggatgctggacaggctgtgtgcagctcccggttctcagcgggtacagagatcccagggaaagccgtgagatgactcctgcacttgtcctgccagcaacctgcaggggtgggtgggatcaagagtgacagaaaccgcaggcaccaggcatccccccaaaagagcaagggggctctgggtgatgtcctggaggggcaggagcaaggagggaggccaggggcaccgagggcatctcatcacatgggctctgtcccagccacagtgctgtctctcccagagccctgtgtagcctcctgcccataggtgaagacccagcctcagctccctgcacgcagcaggcccacccatccatccatctgttcacaccaggaagcccagaggcaggtggatggcctctgtcctggcagtgcaacattgctggaagcatcctccaagagtcacccatccccacagacactgatggaggacagcaatgatgcttcctgacagcaaccaccattcactgagcattcagcaggggtgggtgtcagggtcagcctccaccacgtcactgtgggaacagcccccaggacccgctaactcattttatacatcaggaggaaagccagggagcacggtacactctccagctaccgtggggccagcacactgtccagccaccttgggccagtgaaacggaaaaagttcccttgttgccctagcagtgtgtgtgagaaggggagtggctcgcttcttcagtgctccactgcccaaacctctaggggagcttacagacgggcaggctgtggagctccgaccccacagcagtgtctaggggtgaaggtttacagctgaagccccagtgggcgtgtgtcacgggggcttttttagtttgtcgtctgtagggtggcttgtgttagtcagagggctttctggatcctggggttcttgcctttgtgtaccagaagagtcagatcacacgtggacttggagaatgagtgcaaggttttattgaggggaggtggctcccagcagataggggaagctagaagggggtggagtgggaaggttttcccctggagtggggccgctgtgcacccgggctgtcctccaactgccccagccaaactccgcgtggttctgccagtcagtggcctgccagcatgccggtgcctatcagtgcgttcatctcgacatccagccgcccgtgtgtgtctccgctgatgtgctcctctccacgtccagctgcctgtgtctgcctgctaaggtctcaggggattttataagcacaggatgggggcgtggcaggccagggtggtcgtgagaaatgcaacatttgggtaggaagtgcctgttctcacctaggtccgtggggttggagccctagtctgggaccatgccctcctctacccagcacttcctttccctgcttccgtatcatttaaatggaccacacttttcccttcccagcacttgccttccctatcaacagcacattctctagccaccatggggtcagcacactctccagctacgtcgggccagcagcggctgggctccaactcaggtctgcaccagaccctcattcttaaacccctgcgtctcggcctgcccatgttccagcttccccaagtcttgactcccaatgtcccagcctccttgaggtctcagtctccctgttccaggcctcagcctcccctgagtccctgcctagcccagttcctacctcccacttcccctccccaggtctctgctaccatggcccacccagctgcacccccaccccacacttctcctgggacccaggaggccactcatgggctaagcctggtggcatcttcatgtaaaccttgccctgagcacacgcccgtggctgtggctgctgactttcactgtgcatattaaatgccattaagatggttgcgattggttttcagtgtccagaggactgcagcacacggagaaacagccgccctgcagggcctctccccgagctctggcgggtgagcccttgtgggaggggctggggagctgggacccatttagggtgtggttgggggagaaggcaggaggcaggtgggacctcccccggaacctctcctgagacaccctaagggctgggaatgggagctacttggtgggggaacccagcaggggtttcctgtccccgggctctggccatgacgaggaccctcctgctgttgcctctcccaaggccactcggcccctgctcactgtgcaaccttacagagcagctcagcctctctgagcccctctgtcatctttagccactgcccaccagagtccccttggagctgctggccaaggcaaggctgggcaggggcttgacataggctctcacgccttcagatgccctcaaatgggattcaaccccgtcttggctcctgagacctcccagcctggggtctgagggtctgtccagatctgcaggtagatggctgggcctgcagggacagaggcggccggcggagggcagcagagggccgcagaactgagcggccggcactcaccaggccgggatgtggccaccctgcatgcaagcagccctgcctctgccctgggtcttgtcccaccccccaggacacccaggccctggcttggctgcggcagggaggccaggcctcacccctctccctcctgacacctgcccagccactggcttgggccgccgccctccaggcctctcctgccacccaccccagcaccaggccccctgatgcccctgcttccctcccaagggtccctcctagacaccatcctggcccagccaagatgccagcacaggatctccccaaaacactctgggccctggaggacagggtgaggctccggcaccttccaggtggcactcatgatggacaatctcaggggccacacaccctggacccacctcccccagtgcagagacccccacggcaggctctcagccgtgaatatggacacacaaggctcccgggacatgggcaaagggttgacactggctcatagtgtgggcaccatgtcacagggcgagacggagactcagcccccagggtagcggccagtgctgaccttgggctaggccagggcctggccatgctgaaccaggtctgagcatcctcaggggccagcctctccctgtggggtccccacaaaggtggccatgggctgtcctctgatgacaggaagccccccttcccgtcagccccgtctgtcagctccctctgccctggggtgaggcctctatggtgaggcccatggtcctggctccaacctcgcactcctcgggacccactcccatgcccggctccctgccagacccacacacccaacccagctaacaccagccccaccctgtcctgccccacgggggcagtgccctccactctccttcactggtcccctctccgtcctcctctcacccactcttaagaaacctcccacacatgagcacccgtccgtccccacacctgctcaccaggcctggctgggcctgaccctctcctgaagtgagggctgcagcctggtcggctcagctcatcagcacagacttgtttctgtcacaacagctgatgaggactgagcagatcatgggctagccaggtctccatggcctgccccaggcaccgtgatgttccaggatggtaaaatgagggaggaggtccaggtggctgacagctggctgaggcagaatgcgctgattggcgctgcccagaggggaggtggacccctgggctaagggagctccaaggaacagagctgaacccaccactaacaaaagatgggccagagccagcaccgtatgccacagcacgcagaacaaaggcctcgtgccctgtgcccagctggccgtgtgtcccctccaggcccgtcactgggcttcctgaccgcctcatctccactgtctctggtagccaccctcattgtacccttctccatggtgccctctgaatgaggccaccatgtccgaggggacatggatgactccagctggcatggccttgcccatcccttggggctgcagcacagtggccaccctctcctcactgctgggaatgttctggagctgagttggtgcagggagggtgaagaggccccgagccctccacacacccacctctggcagcagttagcagcagctggggagagaagggtgtgagctcttgcagacatggcaccccagggtatcctgtgccaggggacactttggccatgaaggaactgtcggggcatggcaagctctggggggcatcgagggtgcactgacagcacttgtaggggagcggggtcccagtctcagcactgtccagtcagacaggcctggcctgagttccaactgcctctcccagctgtttgaccccaaacatcatggttttctggcctctggaacggtgctggagagggatgaaagcatcaccgggggtgcaggaggaaccacaaagtcctgtggaagttcatggcagctgtgagcctttcattctgagtatctgagaccccaggaggggctgggcgctcgtctgggctgatgtctcacagtgaggggcggcggccccagccaggatgcaccattcattgccattgatgaggtctgggaagagaggtggtttgggggacatcatacggggtccctgggccggagggtcccatctttggaacagaggggccgggggccattccagaacagtgtccaggagagaatgggctctaagccgaccacccagccccctcctgccatgtggggctctgtgctgagtgcatggccccccagccccccgcctgtttgatggcttctcccctcccctctctgctgcctggtcccctggagctctcccttccccagcatggggctcagttaaagaaaaaactgattcctgcagatgaggggaggaacagccctgctggaggcaaggtgggcgtggggggagcttgtctcccctgatgcgcaggcagtggctggcggagcgtcttcgggggtgggggatgaaagctcagactctggcctgtgggttccagctctaggcttcccaaccaccaggctccccaaaaggtctgtagtgtcctgggcacccaggccccgatctcgggggcagggggcacagtgcctcccacaagcggctctcggcccagcctcagggctcctcacgcacacccagggcctctggagtgggcaactcctgcaccctccacttccctcagctcaaaaccagggcaggttcgaaacgcgcgtgcagctcatcataaacacgggtttggaatttctaacgcggtgcctccaatttcacaaaatattgccccactttagacattctcaaggaaaggaaatgggggctgggagggcccagggcctgtggagggtggggctgggggaagcagccatgggaccctttccctgctgctttcaatctggctcagatattttttagatgaaataaaatctgattcagtggtggtttctgcactgcccccagggtctggggtcagaattcccccgctggggcacaataggtgccatttcccatgtttgggggctcagggaacagggtgtaagccatgaggggaggggcttgggaaggtggggatgggctgctggaggccgtgggccggcgtcttggtgtggcagcctccaccacggcaggcaggtcatttgatgcccaaggcccagggccccctgtccaaggtgaggagctgtggctgggtctctggggaggccaggctgcctgcagtggaccggctataccctggagccccgcgctaatgcccatcctcagatgctcccagctccggcttgcctcagggccttggcactggtgacccctcccggtctcctgcactgtcttcagagcctatggcagcagccccacctgagttccagctctgcagtctgctttgggccacatttcctcactgcaggcccagctggctctcagcatggtatctgcccgggtgcccacatcacagagactggggtatggaggatggcaggctcccagggaccctctgggccgatctccaggttgggtgcatgctggacactcactccattctgccctccatttgcccatgctccgtccacccagccgggcccggagggtcaggggtgtgtgggcaggtgctgctcagaggccctggctatggggcagggggcccagcctcaagactgcggcctggccctgagcgtgggcgcagcctggctccccgactctccctccccataaataaaagattcccttcctccttccagcttgcgcagccgccgcctgctcgccggcccggccctttgtgcccacgcgttgccatggagatgggcgattcaaagtcctggcacttcaaggcttccctcctctcctggtgggccggggcgggggtagccgggatggttgcccgagccccagtgggtgccgcctcctctctctgtccagtaaaatgccagatcctgccggggctagggcacccaccaattctcactctggtgtgggtggctgactctggcccctaccctgaaaacagatgcgcttttacagggaccttcttcaaagtttgatagaataagggaaactgaggcacagctggtcccttggccaccgtggggaacacagagccgaccccctgtatcatgcaccatttgcacagtgggctgctttcagctgtgtgctggccagggtcatcaggctccaggacgtggccctgcggagaggctgcccttcctccatcccagcatggacggcccagggctggaagccgggatttggggtgagctgcacggggatgactaatccagccacaaagccgtcccctccacactctgcccgccatgcgggttggagctatctctgagtcaccgtggagacgttgagaatgtcgcagggtctttgaggctcttccgctccccccaatcctgttccccactcatactttttatctccccacaatctgccctttgatcatctcctaagactcatgcaaccagcagaattgacggcagcactttctggttcagccactgcctcccacctaccccactgcggcagccacttggtatttgttgcctgctcactgtggcagccaggcaagtctgggaccccttagagcctcggtttcctctcctgtgtaatggaagcagtcgtccactcttaacaaatgtccagagatgtctgggggccaggtctctgtgctgggcctgggaacaagacacctgattttgggggagattctgtcccccttgctccaccccatgaactctggtgagggtgaccaccacacaccacagttacttccgggccccaagtggctggcccatcagggacttcccgggagtcacaggttggagggaaggaagccagggagaggtggcagagctggctgcaccccaaggctgtctccaaggggcccacccttggcctccatccacccctccctggcccggacccctgtcctgcctcagcagcccagcccacggcagctgtcccctcacaggctacaaagatggtggccctggtcctggccgtggagcaggcaaggcacgtggaacataaagaaatatggttgtgaagtggccaggccatggaggaagctcgggggacctcgatgtctacattaagacctcccaggagtgggttgtcccttctggaagggtgctggggacagccgtgtggcccttttcagtggaaggatcccacatcctcaggcagtgccatcacatcccctgagaagccctgaaacccaggcatgaggatgcagctggcccggtcccggcagggaagggagtgcagcagctgggctccggctcgcctacccactgattgccagtgtcctgggtgagaaagcaggaggcttttgtgcacacatgggcctcgggactgggtcagggctcaggctccccagacgggagaaagtgcatgcagggccaccggctccccagctgaggctgagggaggtgtccttgccttccgtgctcggagccctgtctcaggtgcttggcgctcttctctgcatcttgggtttccagcaggcctgccccgccccaggacttgtggggaggctgggactgaccgcgatcccccaggaacaaggcagatgattgatagaactgggccccgcctgctctctcagcccccagagcccccagaggtgagctccagatgtcaccagggctaatttgggagcccctgccccatagaggaaaccccctgcaccaggcagagccccgcttggcccctgcttcagccgagggctgcggcccatgctgccacctcccctgccctgcagcggagctagatgatggctgttctgtcaagggggccctcggcctagagcatcagtgccactcggccaggactagctcaggtggtagtttggggctttgaccctggcctgtctgatctgcaggccgagcatcccccaccacactgttttctacaggatggaatggaaaggaagccagagaccgggagacccagccacagccatgcaggagagggctggtcagggctgaggctgctgcccctgacctgagagcaacggcaccatgcccctccatctgccatctgcacacagggtcgcctccagcccacagggcaagggggccagggctgggtcctgagtgcaggggtgtccttggcagggtaagagtcagcctaactcaaactccactgccacactttgcagtgagactgacaggtggaataaacccaccaggcccctcagcaccagtaagagctcttcagagtggcccaggcctggccatgtccctgagagaggggtgctgctggcgcgccctgagcagggggtgggctgggccctactgcttggttctatctcagatttttgctaataagcccgtcttttttcttttttttttttaataaacttttcaactttagaacagttttatctttgctgaaaaattgagaagacagtacagagagatcgcatctaccacacaccagtttcaccgttgtgagcatctggcattggtaggttagagttgctgagccaatagcggcacactattatcagccatcgtccatgcagtgttcacatttccttcgtccttaccgatgtccttttctccataccaggatctgactttggtcattgaaattgccaaaaacaaggggacacaggagtgtgtttggccaggtgggccacctgctgctgctgcctccaaatgttcatcccagccccccacgcactcgggggattttcaaagggtctcacgtgttgggtgccagagacaccctcctgggccttggattcctcctctgtgatgaaggccggggctgctggctcctccacaccacactcggcccccagcagacaggcaacaggggccttgtcccactgtagctgtggtcaggtggtccagggctagacggtcctatggggagctgaggcccccacctcgagatctccctgcccaagacaccagtggggttggggtgggtcaaaggcctgttcctccagggcccatagcaggggcttcttaatctgagggtgagagggtttgggaggtgacaccccaactcccaccccaattctcaccctccacttctcaccccacaagctatcaccatgactgcccacctccacttctcacccccacctctcacccctacctctcacctgccgctctcacctaccacttctcacccccaattcacacccctacctctcacctgccgctctcacctaccacatctcacccccaattcacacccctacctctcactcacacctctcacccacacctctcaccttccagctcactccctctatttctcccctctcaacctcttccttctctgagctcagcctccactgaaaaggtggccttttccccagatagctgggcaggggctggaccggacagattgctggcaggggaggcacacttgctcttctttggtgagagtggctcttgcctcctatgatcctggagctcaggcctgtccagcgcccctcctggaggcagcagggtgggtgtgttcctgcagacatggacagcccaccttggcactcagggcccagcaatccagcccctcctccaggcagccatcctggatcactcctcgctgctttagctgactggcatctcagcacctccccagggaatgtccccaggccctgcaaactcagtcctgtcagcccccagcccgctctgggacccctcaggaatgctcctttcctcgagtcttcttcctcccacggcctccattcccgtggattctccctgctaggaagtagatctcatcccgtttcaccatcagggaaactgaggctgggaaggtaaaggtactgcccagagccatgcctgtgggagggctgggacttgctggtggcctgtgaaggttgggcaggggtggatggctggagtccccaggaccaccaggaccacacctggcagtggaggcctagggtgagggactggggctgagcagggcctctgtgctgccactgttgaatgtgacacagctcctgagaagcaagaccagagacaagttaagcaggcctctgctaatggggcgctaacaaagacaagaagggtgagcaggcatcaggagcgcttggggactcgcggtgggacagccatgagaactcagcccacagccatgtcagtggtggcaaggagaggacggatgtcagctgttttttattttattttattttattttttattattttattttattttgttttattatttttctagagggtcttgctctgttgcccaggctgaagtacagtggcatgatcagggctcactcgaactcctggctaacatgatcctcctgcctcagctcccaagtagcggagactacaggcgtgcaccataacagccagataattttatttttttaatttttgtagagactgggactcactatgttccccaggctagtcccgaacttctagcctcaagggattctccctgctctgccttccaaaatgctgggatcacaggtgtgagtcactacagttagcctgttttattttaaaatatatatatttcctgttttgaatgggtatcctctccttccaccccatccccagcgacctgacacccccagctgtacctgcaggcggtccccctcctcacccccactagacgtatctgtgagtgcctcaccccggccccaccagacctgcaggcctctccctgccctccaacagccagacctgtgggagcccctaagcagcccccctagggaacccccagcctgatgcggctgccatccctgtgggtgaggggcagcatctcactgcagcttagatctgcgtgtttctcactctgagtgaaggtcagcagcgggtgatgggaggttcctttcatgcctttgcccatttttctcttgggctgttgctctttttcttactgatttgtattgagaaccaaaaacggccctttgtgaactgagttgccgatgtttttaccctttgttggttatcattttatggtggtttttttctctccatgcatctgccttttattttcacgaggttgaatatacccatcttttactttatggcttctgggttttgtataattcttagagtgactaaagattggttttttgccatccatgctttcttctaggagttttatggtttcatttttactttttaaatcttagttccacttggaacttgttttagcgtcaaggagtgaggtaggaatccaaatgtttcctccatatgtcaattccgttgtcttaaggccaagtgttgattgtatatgtgggattatttgttgaatattccatctctcctcttggatttgacctgcctcttctcatatttgcatttgagcctctttctggactctttcccatcgtgtgactgtccagggtctgtgttaattatcatggtcttagaatataaggcgtttcaggatgtgacatggcccatctctctccgtatgctccttctttcatgtgaacttcacaattgctctggatgggcctcctgattcattcaaggaacaagccgtcaggcttcagccaggccagagaatgggccgtgggtcccagcactgggctttcatctgggttccatcccattggcctgtgccccagggcctggctcctcgggactcagccagtcctgccggtggagtgcgcaggcgtgacgctgagtgctggactctgtttccacgcgaggccttggggtggaggggtgtctcaagggagtggccaaggcagaggaccctctttctggatgtcctcacttgcccatgggaagggaggtggtcctggctgagccacaaggccctgcaggcccaggccctgcacacatgcaccttggcagagccagccagagaggcctgatgaccagagcacccaagcggcaagggcaggcaggagtgcccaggagggagccaagctgtggccgctctgctgagccatccgttccagcaggcagcaggcagcggactgagaatgctcagttcagaactcgagcctgggcatgaaccggagcctccagaaacctgccccttaagcgggccggctaagagtggcagctgggagctggagacccaggacacaggcagcccccagcagcccatgtggcctcttctcagccacaccccgagggccccgggctctgctcccaccatggccggcctcctgggagcccctcgcctggctggatgggccagtgaggcggtggcattgagcagagggtggtggggccggcagaccccagatgtcctgacacaggctaggagaagcgcctccaaggctggcagcaaaccccagccagcctatatagtcagcaggaatcctggctaaaaataccccagtctcagaggcccaccagctgctgcagtctcagaaccccctcctcacgctgggcactgcccatgtgcccctccacctcccttgcaggcaataaggcctgcggacacaggaggaaactcaggccctgtgccagcaagtcctagccccagggcctggcctccaggactgcccacagaggcccccatcttactgcaaggccagggctggccccgccctgctctgcacccgtgagcctgggcaggggtcagggcaggccccatcaggaccagctcgggcaggggcgcaggctctgctggccccaccctgcacagctccctgtcccatggctctcagaggcagagccactggctggggggcagagccccaaggacttggtctgagtcaccatggcagaatgtggggtgctaggtgggctcttcccagtcacccctgtgggcttcaagtgaccacacggcatggctatgccctttatcctggaatcactggctggggaactcaggccaaggcccacctccccggggctcagtttccccacctgtacccagtggggatatgtggaataggggtccagtaaaggtatacggggtgttacagcttgcctctcagagtgtttgttgagtgactaaatgaatgaggaagtgagcagatgaaggcagtgagggaggctgtgaagggtgggaccactgcgctcagagcaagccctcagcctctccatctgggaaacggaacaaacctgcatgccgcatggatcatggtggcccagagtggggtgcccagggacccagggagctcctacaagagcaaggctgggcactagccagccaaggcatcctagggaccatctcactgtggccccaaggtgggtttggcggtccaccctgccttccactccccacccactcctgctgacagctatcgccatgccttccctgccttccctgctccactgggagctcgtgggtgctttcaacaggtgcccctcccccccaacccaggtttgactgcctgctgggctcctggtgttaacagcagctcccaatttagctgtcactgccaggtgggtggctctagaaggatccgtactccctgcaggggtgggggaggggcgtgaagccacagcggatgccttgggcacagcccagggacccccaccttccggagctctgcccctgcaccagatttgtgcctacagggaccagaagcctcctactccccagccccacccagccggcctccccagagagaggccaccaagttggttgtgcccactgagagaagaccctgagcccatctgctggcgaacacaagtggcccgagctcatctcaaggtccaggaaccctggggactcaccccttcctctgggcaccaggaagagtggtggaccaggggtccaggtgccagcctggcatgtcccacttggtcgagtgtcctttcatctctgttcaggttcccatcctggagatgggccacaagggatccagtccagggctgggggaggcagccctgtgggaggaggcccttgctagtgaagggtcagaggcatttggagatgggcaggcccagtgggattcttggggccactgccaggatttggttgtcggtcccttccttgtgccagccccctttgctgctgcgtgtggctttgatgaataagagatgaggaagcatattaattatggcttaacatgcaccaaagttgggcagagggactcctagggatgggagtcctcaggggtgcagaactgatgggggaagaccaggacaccctctgcagccctggggatgggggatggtgagaggcttctggaggaggcagaggctgtgggcaaagagagggctgagagaggctgccaagacgtgggtccacctaagctccccagacctccttctctggtctggaaaatgggtggtggtagtagtgtctacactgcaggactgaatgggatgactcactcagcaggcctggcacagagtcctctcgggccttgggcatgcagccaccctctgtggtgagagcagatggcaggctgacgccccccagctccctggcaccgggaccacatccctagccgcccactcagagtgcagggaagggttggtcacattgacacgcttgggcagcaggcatgtgcttgccgcatgaccttctagcttccttcctggtctctccttgcattggcctggagtggcccagaatgtgtggagcaaagacccaatttccttgctgcccatccctccccaggagacaccgagggcctggatgtccgtgagaaccgcacaggcatgccaaggaaagccatggcacgcctatctctccaggcgggagatgagcctcccgaagccctgggaagaagggaccttccaaggaggctgaaccgtgtccctgtcagcccaagacgggccactgcgaaaggtcccctcatctcaagctggcttctatgggcaggcatggagttttgagtgaaaaccctgcatgatcctctcaggggacaggaggggtgaacaaaggagggacagtgaccagctgaccaggccctgaggcattagcgtctgcctcgtccacatgctgtgcaagctcagcgaggccaaggggctgggccgaggtcacacagctgggcagggccctcatgaccggcatgctggtcgtggaggccgagccccaggttgggggtgggggtgggaggtgaggcagcccctggcctcactggaggggggtggtgggctggggaagctggcaaaggatgtgccctacatggtgggtgtgaggtggggaacgattcgggcagatgcccgtgtggccctgctgacccagtccaggcagggtgtgacaggtctgcccagccctgaggtcacagctgtctgcagtctccagctcactcctgatccccagggccacgtgtccagaaagcctgggagcttgcatcagctgggcacagatggcctgtcctcccagcacccctgctggggcttcctaggaactgactggtgtagactccgggcagcagacggccaggctctgcccacagggtccctggctcctcccatgaggtgacccgatagaactggctgtgccccttgaccaggggctccagcccttgtcaagccctccctgctagcccctcaccagccgtcagctgccctccctcccttgcccgttgggccctgggggggtgatggctccgcggtcgcctgcccagagagtacaccactccccatgctgccccccgacctggctacaccctgaaaaatgtggcttaccaaaccctcccacatgcacagcctgagaagcgggctgtgccttgctggtagcagaccgaccggctgcctagccctgctcaactctgcctctgcacccccataactccctatcagcgctggcccacacctaatcgttccagctagcacccaggagtgggctcagcttccagtggggagggcgctggccaaggtgctgaccgaggtggcggacacaggaaaccagccggtcccccagcgctccctctgtgggccttgggcctgctcccactgcacagacaggtggggaggtggaggcccaggtcccagcccagagcagctgggaacagccggacttgatggctggagagggctgtggtgccagaagcctccaggttagccctggctccccatttccccccatgcccatcccatgccccagaatggtcactttggctgctgcaggaggggtgggaggggctttaaacctatgagatagggtgtggggtcacaatcttcaattgtagtgggccgctctgggtcactggtaattgaagagacgcctgcatagtaagcacgcaagtgtcctctcaagccctctctgcaagcacagagcagcccgagactggagcctggtccaccccagcgctgtcctcagactgatggtcagtgcctcatgactcatctagggtctgatacatccctgtggtgagagctcagttcctagtctaggggctgctgcgtgcagggaccctggaggaagaatgcttgtttaggggtcaggcctcagcctcccactggctctgtcagcttcgcctgaggttccccatctgtgcaatgggtgatgacatcttggtgtggctctgggaggacctgttgagccacctcaggggctgagctggtggcactcggcagccagcaccctctggggaggtggcagtgtgtgcacagcccaccccttcaggaggccaggggacagagtggctgggggtgtctgggccccacctcaccttctgtgtggctgggaatggcatgcactccacaatgccctcataagcctaggctgggacaagggtgatagggataaagcaggccaaggtgatgagggccacagagcggcagccagaggcatgtgggcagtgcagcctccacaccaggcagagggcccggccagcatggctccaccctgggaagctgcctgccactgggatcagatgggagcaccagggctctgggaggtcctcacttcctctggacaaggcaggcaggtcaccagccctgtgccctgctcatctccctcagggccacctccatggccaggggcaggcagagagcacagggctgcccagtcaccaggtctctctgcttcatatcagtggacctgggctctgaggggagccatcaagacctcaggctggcccactccgtccttgagtcagggtcctacagactgacaccaggttggcctgcaagaccctggtcctgtcatgcagggtgggcctggggaggacccagcccagctgagctgactcccagcactcctccaggtgcagggacagcctggcagttgtctgaagaccccgggatgggcttaggagctcatcatcatcggatgccccccgagcagaagacggagaaggaacacccccaccctgtgtggtgtgtgtaggggtgtcactgggttctctggctccatgacgcccccccggccccgctgggggctggcttagtagagtgggggatgatactaagcaggcggcctcggagagcgtcttctgggtttggaggccacattccgcaggaaggaagaggtgggggacccctgcagggttatgggtaacatcaggcctgggtcccctccctggggtggtgcagagagggccacaaaggcccaagagggcccccagaacgctcttaagccttgagcctgtttcttactgaaaaatgggggcgatcgtgctccagcaaggggcttctgtgcagggggcgggggggggcggggggttcatgggtttcgtgaggccaggaagcgagtgggtcgcgcagaggccatccccaggcctcaatggccccagccgccatcccctccgccgcctgcagggccgccgcctcttcaggaatgcgcggctttgtctagggccgggtgggctgagcacctcctgctgcccggcctacgctccccggccagccgcgccgctcacgccccaacttgggcccgcgccccccagcccccgcccaggcccgcgccccccagcccccgcccaggcaggcgcctgcgcccaggtgagggccccgcccgccgccgcctcccgcgccctgcgcgcccgcggcccgagccccgcccgagccgggcggagcggagcgcgcggagcctagacccgctgccgggccggggctgggccggagcggcggcgcctggatgccggcccggggctgggccggagactggcgcccgccccgaagcgactttcggtccccgacccgctccgcctgacccctatgatgaagagggcgtccactggaggtgagtgtccacgcggcgccagagcccagcaggcggcggggcgcagagcggggtggttcgcccctcctcggagccgcagggcccgtccagggcttccaaggctggggaagcgtagccgggcggccgggagggccaccgcagtgccgcgccaggctggggccaagggcgccccggccccgggagggcggagccggaggcagcaggaaaagttgccgcttcccgggtaagttgacggcgatggcggggccgggggtggcggcccgggggtccccgaggctgggccaggtccggggtgggggccgcgggctggaaggacggggtccggcctcggcgccgcggccacgaaggggttaatgagcgggtttttttgcagaaacgcgggtaccgagagtaggtggaggtatcgggccgcctccgcccccgcctcgcggactgggctcagaacctcccgtttttctgaggtcaggcctcagggggatcaatgggggcgttggcggcagtagagggcgtgggggacaaggttgtcccaacgctgcctccagggcgggcggtgagaggaggcagcaatgcccagacatccgcagcccgagggacattgagaggcttggctgggggaatcaggggtggtggggcaatcagcatcccctccctggcagccttcgtgagactcccccgccccactgggtgtgaggtcccgcagtggggggcaagggagggtgggctccatgtgagttgggcatgccctgcctggagggtgctccccaggtgcccacccaggctgccctgctgatgtccatggtgtcgcaggctgcacacacgtttccttgcacgtgcacatgtctacacggactgcacacttgcacacctctggtgcacatgcgtgccagcgccaccccagtgtacacatgcacgaacactgggtgcacacacggactctgagggtgcatatctgtgtcctcgcccccgcttgcacgcccacggccacacatgcatgtacgcgacatgcctgctgtggtctccacgggtggcacatgctggggcccctttcacaatacccactcccgcacccacatgctcgtctgttgagtggggaggccaggcccacagacaggggcaagacatcctgggccccacctctgcctgcctgcctccgtgtcctgggggtccccgcctcgggcgtgtgtgcgtgtgtgtaacttggtatgcatctgcacgtgtgtctgtgcgcgtgatcatgtgtgcctgcgagcacataggcatatgtctctttgcctccagggtgtgggtgccccttgtgtgcctagacaggctgtggcctaatctggagcagaggccctggaatgtgtgttgggggctcattgaatgcccccagcccagggtgtgaggggcagggtctcccagccactccgcacccaccagggctgaggcagtgatagatgatggtgggctggaacctgtctggtcagggaagacccatttcaggccatgaggtcaacactgtgaccaacaggccagaccctgggcacccttggtggccgctgcagcttggctgactggagcacgtgacccagcgtgactgcagaggccccgcctccagtacctcagtttctccatggtgaggaccttcttggtgaggggttccgtggtgggctcccctacctccggtgttgtgtagggtgctgagcagatggatgccatgctgcatgatgggcaagggtggcccactagcactgtggcaagggccctgggctggggcttcaattggcaggccacacctcctgctcccctggccaccaccagaggctcatctatagagtggggaccagcaggttatccttgtaggttgtgtgagggtgaaacatactagcagaggggcagctgaagcagtggggctggccagtctctttttctaagcctcagtcttcccatctataaagggggtactgttccctgttcttctctactgaggtgaggaggaagtgagctcccatgccgggggtgggaatgggtggccatcagcacctagaccccacctggcagaggggcacgtgcagggcctgccgtggcagaaccgtgacctggatttgggtcctggctcagccacctgctggcagtgtgaccttgggtgtgacaggtcacctctctgcctcagtcttcctcacctgcaccatgggccagtggtcagggattatcggggcacttccaggctgaggctgggcggaattggcccggctttccctgtggagttccgactctggtgcttctgcctcagaatgcccagaacacctccccacaccccaactcagcagagtcctcctgggacctttgcatggccagctggcccctcaccccatccatttgcagaagggacaataaaagcccctagtcaggcaactcaggccacaggtgagtggagaggggacagggcagggatgctgcccagcttgggagaccctcccatagtaccttcactccctccctgccctccccctgttcctcacctgggggtctgtggaacccctgagcctcagtttccctgtgccagggtccttccactgggactggcagaaacgtaggtttgcatggagtgagaagcaggggagaggttgagggagggcctggcccagcaggtctctgaaagccagagggcttgtggagggtctatggaggacacccccacaggggctggggccctggaaggtgggggaaggtcctgttgtcctgggaggctggggactggcccacagcctgtggaggggctggggtttgtttgctgttgctgtgagtgacaggcaggctgtgagggccagggcatgtgggaccgtgccctccgcctccctctgcccaaggacagtgcagccttgtagcactgccctctcctcgtccctgccccagccttgaattcatgctttgtggcacggacggccctgtgcagccggtgcaacaccaggagggtccagctggtgaggacaggacgggtgggaggcagaggagccctcctgctgtcctgggcctgtggcccggaacctctcaccgggagccttggtctgtgcacctgggaaaggggtcaagaacaggaagcatacggggagtttcaggatgacctggaaatgaacaaatgcatgtgtgagccaggcgccctgcccggccctggcacagggttagtgagggctcccgacgcttggctactgtctgatcaatgaggttcatgccgtcccgcccccattctggcaagcctgacctctgatccccaggctggcctgcctgaccctctgcagccacccagggcctgggctttggggtctgcaggagccggcctggctgcctgctgcctctgcagctgtgcagatgccctctcggggccctctctgcacccctcagtgtccctgctctgcagcctggctgcacccaggccaaggtcacaggcaccctcctcgaagccagatcccagatgctgcatttgccccaactgtccgttcactttctcatttgttcattcatttgcttgttcgttcctagcctgtcagattctcttctgagccaggcaaatcaaggggtgcaatccttggcatcgtgcatctctaggattaaatgctttaaaggataggaggtaacagagtggccccggggaagcccgatcggagtggcgggcatgctaccccaccctgcaaatctccctgcactgtccctggggcccagctgggttccccacaccagttgttctgtgctgccgtttcttcttttatcgctgtattttaaacactttgcacatcgggaactattcttgtgcatcgtgggttttctggtgtgtgtggaatcccttcctgagaatgcaccatcatttatttatccaaacctgcaccggcctcctgcactgcctgcagccgtggagctgggcaccgggagatgcagctctgcacacccaccccaccatgtcctcagctggcacccaccaggtctaggggctggtcacgtgcctctcccctgatgcttgagctgatttcaggggactcggcagcagggccagatcccgcccctcctagccagctgaggcctttgacaaccgtgggctggccgggtgggtgatggtgagtgagtagagtctgggcatccatttgtgcagtgggtgccttggggccgcctctcctctccctctttcacacagcctctggtcttgcccgctatggcctgcggggcctcttctgcggggcagcagggcagcggggcatggggtaatgctgacactgttctgcagctgtgtcctgtccaatggaggcaacccacggcagccagaccaggaggtggagaagaaaggcagggctgttggcacacctcgagagtggccttaggagaggctgagtgggcacaggccagggtccccatgtagttctacacaggcctggcaggcggtaagccccattcagggccctggcacatggagccgggctgatctgggagtgaagtgtcaggtgctgacccagcctcactcagagcagcctgccctgggcccccgggtgcctcttggctctccagtcggcaccctggcattcttagctggctgtcacgggtcacggtccatggagttgaaattctttggaatgttgggggtatcacataagggctttgtggtcaaatgtgggacctgctggaataaatggtgctgatggtgctcctttcccgcagggcatcttgggctctgttttggagaggggtgggcagcaccttctctgagaggcacccctatgcgatgtacctcagggcctggtgtgcccaggaacctgttttgggaaacagtggttgaagtgcctcggaggaccagaggagacctgtgggcctccagcaagtgccccaggatgggtagaccctgccacacaaaccccgcacccacggggcgcccagtgggtggagggaccactgcttcccccagcagtttgaggcgatgtgcaaatttaacctttggatttatgactcaatttctttgtagcaaatgtcacgggaaatgtcaggccaaggctgaggctgggtgaggggcccgtcgaggaagcgggtagggctaggcaggctagagtaccgaggaggggctcaggccagggtgggcttcaggcccctcacctcctcctgggagccttcctggattgtcccttgcttgcctggatccccggcactgtgtcctcaatttgtcccagctatcacaaccttgttgagatgttgcctttatttgccttctaccagggcccagatgaggccagctcggggacatgccagaagtcccccattccccaaggctgggcagccatgggatcagcttgtgcagtgccggcttgctgtatgaccttgggcagctccacccttcctggtcaccgtaggcctctctgcagtccacagctggtggccagaggtggtgttcccagctcagtgccttcaagagtgggaaaacgcctagagtcctcagtatgtggggtgtggggctctggaggaagtgggtgggggctgaatgcagggctggggttgcggagggctggcccttggtggtcccaggggctagagcagcccctgcacacagcaggtgctcagtaaagaccaaaaggcagtgcgtggatgtggaaggtggaggtggattccagctgggagtccacagtccccagttacatgtcccccctccaccgccacatgccagatgtcattccaaggccccacgctggcccgtcaccagctctgccctgcctcccaggcccgggcgggtcagggaatggtgactgcctcctccctgccgtgtgccaggcctgtgcactggagcaggggttcaggctccctagtgctctgcatctctcctgcacacacagctccccacactgcacaccttaggcctccagatccagcctgtctgctagtgtcacatcctccgtacccaatgtccaagcccagagtctcagcctcttccctcgacccatccccaaaagcaaaatcagtgtcaaacctgcaccctgtctcccggtccatcccctttactcctcactgaggaccagcctcagacctggcctctgtccccagcctgtggccacagctggcccctgcaacctccctgcctcctgggttcaagcgattctcctgcctcagcctcctgagtagctgggattacaggtgcccaccaccaagctaatttttttgtatttttagtagagatggggtttcaccatgttggccaggctggtcttgaactcttgaccccaagtgatccacccacctcaacctcccagagtgctgggattacaagcgtgagccaccgtgcctggcctctgaaggacactttcaagagaatacacaaacaacaaatcaggagaaactatttgcaaatcatatatctggtaaaagacttatatcctaaatatacaaataataactctcaaaactcaataataagaaaaaaacctattcacaaattgggcaaaataattgaacagatggttcaccaaagaagacattttgtcagcaaacaggcacctgaatagatgctccacatctttagtcattatggaaatgcaaaatagaacctcagtgagataatatttcacacccactaggatggctgtaatttaaaacagaaaatatcaagtgttaggaaggatgtggaggaactggaactctcatacgctgttggtgggaatataacatgatgcaaccactttggaaaatagtttggtagtttcttaaagagttaaatatgaacctaccatatgacagtcattcccctcctaggtatttacccaagataagtggaagcatttgtccagacaaagatttgtatacaaaggtttatagcagctttattcgtataagcaaaaactggaaatgacccagaagtctgtccacatgtgaatggataaacaggctatgtgatatcaatacagtggaattgacttttgacacatgcaacgtggatgtgtatcatggatgaatatcaaaggattttagacatggataaatatcagaatgattatgctgagtgaaagaagtcagacaaaaaggagtacatactgtatgtttctgtttagattaaattccacaagatgtaaactaatctacagtgacaatatagaagaatggttgcccggggcagggaagggcacggggaaccttttgggggtaaccacctcaactgtggtcagaggttcacaggtacaaacatgtcaaaaggtaccaaattatacgttttaaatgggtgcaatttatgtcaattacacctcaacagagaaaaatacaatgcttattttatgcaaagggttattttgtaaaactcttttgaggaggaccgtcctggtcagcggccctcaccatcgagactctccctgcacatgggtgctgtggtgactcggcccctgggctcaccctctggtgctgtgtgcacctcaagagcaggatggaaaggtcccctccccacagcctggctgtcagacccccggcacagaggtgcaccgtgcagcctcccgtcatttcccatttgcctgcccaagctctcagtgtctgagctctgtcctctttctggaagacagccaggtttagtgttgggagcaggagaccagcatgggctagcccagtcccaccacctgaacagaggggctgtgatcctccaagctacccagggaaggtgccacctgggtgcacagctggtcccaatggtcaggcctccccttgacagaggggcagggccgtgtcatggtcagggcctgtgctctaaagccagactgagggtcaaaacccagctgccccatttacaagcttcacggtctcaggagtgtcactctgcacatcagtttcctcatctgtaaaaccgatcagtgacatctgcctggttacctgctggggcaagtgggtgagttgagtccgatgaagcacttagaacggtgcctggtatgtggcagtgtacagagcatggggcaatcactgcagccgacctagctggtggctccagtgggccttagtgccccaggcatctgaggagcccactcttcagcactgcccccgagtggctgcagcacacactcccccaggactcattcagccctcccaaggagtgggaagcctccggaacctggtgctgtccgaggcacgacacgcaggaagcagggcaggtgtcctccctggcccctcacccttcctagccaggctgcagctgatccgaggtggttccttgatcctggagtctgaagggacattgaggggctacctgtgctccaaacagaccagcccgcttctcatctgcttcacacacaggggttctgggtaagatttcacttcatttctttgaaacaccactctgctgggccagccaagtcctgtagaccccatcacttgtaccccttgacctcagcaacaggaccaagacctgtagaccccaccacttgcaccccttgacctgaaaaacaggaccacaacctacacccagccgtcctcacctggactatgaggatggtactgctcactggctccggacagctgtgtgactccaggggagccagctgtggttgagatctcgggggtcttggtaaatctggtaaactccttgtgcagttctagcgagcccagtgtgaggactgcctgttggctgggaaccgtaaatctgcttgggtttcatgagaatcttgccctgagtgacctccagctggggaactcaccctccatctgcgccagggagagcttggtcattgtctgcagggacccaactaatcaggacgggcttccacgaggagacagatttgaaagtatgctctcttcgggaagcagtagctttaaactggactagctcttatataatgggcactgtgtccctaacgaaaccaaaatatggtccaataatggcttctttgagggaagcacagggcagttgggttgtccaaagccttctttggaacttcacaggtttaaaaggtgatggttcaagaggccccagtattattcagccatataaaggaatacataaacaaaaatgtggcctagccatacagtggaatattactcagccataaaaaaataacattctaatacgtgctacaacatggaagaaccttgaagcatgatcctgagtgaaagaagccagacacaaaaggtcacatgtaatgtgattccactcatatgaaatatccagaataggtcaattcaaagcgacggaagatacattagaggttgccaggggccagggaacagggaaatggggagtgactgctaatgggttctgctttagggtaataaaaatgttctggaattaaacagcagtgatgattgcacaccattgtgaatgtactaaaaccaattaattctaccctttaaagtggtggatcttatgtgaattatatctcaattgtatctaaataaataataatttgtaaaggcctcaggagaggagctgataatcaggacttaatccctgacttggcacactacctgtcacccaactgtctccagtccttcatactcatcaggagccttgtgcaacatcacctttgcacttgaggcttcctctgcttagaatgctgatctgcctgccccagcatgtcccatgagcctgcctggctcagctcagtgactctcggcttctgctctccccattccaggtatcacagcttgtattctgctttcagaaatcaggtagtcaatcttgctggtgcctaggggactggcattctgtcacatataaagagtgggtgaccgccaggtgcggtggctcacacctgtaatcccagcactttgggaggctgaggtgggaggatcacgaggtcaggagatcgagaccgtcctggctaacacggtgaaaccccatctctactaaaaatacaaaaaattagctgggcgtggtggcgggtgcctgtagtcccagctactcaggaggctgaggcaggagaatggcatgaacccaggagagctaagatcgcgccactgcactccagcctgggcaacagagcaaggctccatctcaaaaaaaaaaaaaaaatgagtgggtgaccagcattagagcatcagggaacaccctcacccaggcactcacctgtgggatgaagccacagcacatcaccatgtggaagccaaacttggtcacatactgaggctcagcaccctcacctcttcagcctgttgacagagatccttggcctgaaggagctgtttgtctttctcttaaatgccagacctcagcagagcatcagtacaagcctgggctgcacatgctagaatatgggtggtctaaggatgtactacatacagtagcaattagtcaatatatggatctgccaggacactcctacctgaagcacactggacagcagggttgggtataaaaggggttattattacctcaagcacaccagacaagagggctgggtataaaaggggtcatgtgccaattctactagcttatcagctccatcaaaattcttatttaataatgtcattttcataatgtagtgtaaagggagatggtatacaactcaacctattattgaaatgccaccaagaagtaccatgagcaccaatctagggtagacaatgtggctgggtcaaggtacccaaaagcaatctgaacatacccactgtgttctcctccttcaacttctccctgagcttctggttgtaaaggtgcaaatctgccatctggtctccaagttttgatgcttaacggaggaaagaagaaatgcccctaattaaaataacaaataaaaaataacattatccagtttgttccattttcagaaatgttttaaatacattaaaaactactctgcactctttaaaaagtaaaaaatgaaccccaggcaatgactcttttcctatttcttttttttttcttttcttttttgagacggggtcttgctgtgtcatccaggctgtagtgcagtagcacaatcatggctcactgcagccttgacctccaggcctcaagcaatcctcccacctcagcctcacaactagctgggacaacatgcatgtgccaccattcctttttttttttttttttttttaagatatggagtctccctatgttgcccagctggtcttgaactcctgagctcaggcgatcttcctgccttggctccccaaaatactgggattacaggtgtgaaccactatgcctagccctggcaatgacgctttccaaaatataaaattgtgtaatcacaaagaggaattaagcaggtgagcttcaacagaagtcttagcaggtactaggaattaaaggaggagtgctgaaaaagtaacaataagtgaaaatgcagggtcaggcacagtggcacagtggctcaggcctataatcccagcactttgggaggctgaggtgggaggactgcatgagaccaggagctgaagaccagcctgggcaacatagtgagatcccatctctacaaaaaatttaaaaattaaaaaaaaaatagctataaattttttgtgaaaaccaatgtaaatcacatataggaaaaagactgggactgggtgtggtggctcacaactgtaatcccagcactttgtgaggctgaagggggtggatcactgaggtcaggagtttgaggccagcctggctagcatggtgaaaccctgtctctactaaaaatacaaaaattagctggttgaggtggccggatacctgtaatcccagctactcgggaggctgaggcaggagaattgcttgaacttgggagggggaggttacagtgagccaagatcgtgccattgcactccagcttgggtgacagagcaagactttgtctcaaaaaacaagcaaactgtctgggtggggtggctcacgcctgtaatcccagcactttgggaggttgaggcaggtgcatcatgaggtcaggagatcgagaccatcctggctaacacggtgaaatcccgtctctactaaaaatacaaaagagaaaagaaaaaaaaatagctgggcgtggtggtgggcgcctgtagtcctagctcttagggaggctgaggcaggagaatggcatgaacccaggaggcggagcttgcagtgaaccgagatcgcgccactgcactccagcctgggtgacagtgagactccaactcaaaaaaaaaaaaaaaaagaattgcgtatttgtttgttttgagacagggtctcactctgtcatccgggaaggagtgcagtggcgcgatcttggctcactagagcctctgcctcctgggtccaagcaattctcctgcctcagccccggagtagctgggattacaggtgtgtgccaccacaccctgctgtgtttttgtatttttactagagacggggtttcaccatgttggccaggctgatcaagaactcctggcctcaagtgatccaccttcctcggcctcccaaagtgtaggattgcatgtttaaaaaaaatcaaacctcatgaatgagaccaaagcgtctactggcgcacaggaaaagaacaccctttacttgaaattaccccagggaaaacccaggcacagcctccccagcctggcagcccctgccagcctgtacctagggtgggcgtgagcgtccacagctgggagagcagccggcacaccccagccctgctcccagggtgagccacgcatgcaccaggcagagaactcctgggcttccggctgctaagccccaggggccccagcgtcacctgctctcgtgcgtggactgagcacctactgtgtgcaggcccttctcaggggtgggagggaaggagtggtctcaccctgcagagctttcaggacaactgaggaagtttcccagggtccatgggaagtctgaaccaaaaactgcttcccagtgagtgggactcctcactttgagggatttgggttctgagccagtagagcaggcaatgcaagaggatccgatcccacatccaggctgcatggctctgggagtcctcctgccagcactctccaccaggacccctgctgcccctcagagcaccccccaccagagtatgcagggcctcttgagcccacttgggccaggagggcacccaggcctgcctttccctgcctgcctgctctcaagggttaagctaactttctccatttgtgctaacgttttccatacattctttatttatttaattttttttattttttgagacagaatcttgctctgtcgcccaggctggagtgcagtgttaccgtctcaatctaggctcactgcaacctctgcctcccgggttcgactgattgtcttgcctcagcctcctgagtagctgggattacaggcccgtgccacccccccgcccccactggctaattattgtattttttagtagagacggggtttcaccatgttggccaggctggtctcaaactcctgatccacccacctcagcctcccaaagtgctgggattacaggcatgagccaccacgcttggatttccatacattctggccattgggacgagctgtgcacccaggtgtcacattccctgggtagcttggaggatcacagcccctctgttcaggtggtgggactgggctagcccatgctggtgtcctgctcccaacactaaacctggttgtctcatccacgcagggcccccacaggacctccagtccatgcagggcccccacgagaccttctggtctgcacagggcccccagagaccaggaaggatcccctcgctggaatttgagtcccagcctgcgagttgggccagtggcatttgttctccacgtgtgactctgtaaacagctttccctcctggtttctgtctttttttttttttttttttttccgagacatggtcttgctctgttgcccaggccggagtgcagtggtgtgatcttgactcactgcaacctccacctcccgggttcaagcaattcccctgccgcagcctcccaagtagctgggattacaggcgcccaccaccacgcccagctaattttttgtatttttagtagagatggggttttaccatgttggccaggatggtctcgaactcctgacctcaggtgatccacccgcctcagcctcccaaagtggtgggattacaggcgtgagccaccgtgtctgccctggtttctgtcttgggtgtggtccccaaactcttaagcacagcctcacacctccacccagtcattcacatagaccctggggtgcgcagaggcagagggtcacccgcagaggagctgtccgcatgtccatggcagcctcagtgtggcttctctgctcagcccagggtgtggtgattccgtcactgctttaaatgtggggttcaggaggaattctgatataacagggatgtctccacatgtcttccctgccttagcgtcttgaggtgtacgtggaaaaacctctggcagggctcactctgacagagtcccggcctctgacattgaatcacccacagtctctctagtttatgtggtagggttcgggatttatgaaaatcaagtactaaaaaatgacttccttgtctctttgaattcaactctgattaatgtttgatcctatttattaacttaaaccatgaaattcccttaagtattttaaatggaattaatatacgtcatatatttgatttttattttcctatatcagttgtttggctagcaaacagaccttccaagcatttaaacagtgcttgtaaatctaataaattaagctaaaaatatgaagcacgtttaattctctggattttaatatactttgtgagcttagtaacatttttctattcctcttaaacttaaaaaaaaaaattgaaaactaggccagtttcagtgggtcatgcctgtaatcccagcactttgggaggcctaggcaggtggaacacctgaggacaggagttcaagaccagcctggccaacatggtgaaaccctgtctctattaaaaatacaaaaattagctgggagtggtggcacatgtgtgcctgtaatcccagctactccggaggttgaggcgggagaattgctcccaggaggtggaggttgcagtgagccgagattgtgccactgcattctagcctgggcaacaagagcgaaagtctgtctcaaaaaaaaaaaaaaaaaaaattggagactaatattaaagagcacaatctaaagtgtagggctggaatgaatgaatgagctctctaggcgagcaaagcctttcagggctgatgtccctcggtcccacgagccaggcctccgcaggctgagcactgagcgctgtctgtctgaccagaacatcatccactcgggcagtgccctcctggccccggccaccagggcagcgtgggagcagatccagcggagcgagggtggcacggcacagctgctccggcgcctcgagggctacttcagcaatgtggcacgcaacgtgcagtggacgtacctgcagccctttgtcatcgtcaccaccaacatgagtaaggcactggctgcgttgggggtggaggcctgcaaccctcaggggtgcgcccaggagctgggtccccatgggtggagcaggtgggctcccggcccccacttggccatgctcttagaaaaatgattcagaggctgggcgcagtggctcacgcctataatcccagaacttttggaggccgagacaggcagatcacatgcagtcaggagttggagaccagcctgggcaacatggtgaaaccctgtctctactaaaaatgcaaaaagtagccaggtgtgatggtgcatgcctgtaatcccagctacttgggaggctgaggcaggagaatcacttgaacctgggaggcagaggttgcagtgggccaagattgcactattgcattccagcctgggtgacggggagactctgtcaaaaaaaaaaaaaaaaagccgggtgcggtggctcatgcctgtaatcccagcactttgggaggccgaggaggggcagattacgaggtcaggtgatcgagaccatcctggctaacatggtgaaaccccgtctctactaaaaatacaaaaattagctgggcgtggtggcaggcgcctgtagtcccagctactcgggaggctgaggcaggagaatggcgtgaacatgggaggcggagcttgcagtgagctgagatggtgccactgcactccagcctgggcgatagagggaaattccatctcaaaaaaaaaaaaaaaaaaaaaaaaaaggttcagcagcaaggcctccatttcctcatctgtaaatggagcctttgggaagacagtctgcaatgacacacccatggctcccaggggacaggtcctgggcttgggagatgttaggccgtgatcttgggggtttggcaggccttccagaccctcaggtgtgagactctagaagagtgagtgtcgaggatcctgcctcacttcaggctcactgcagacaggtgtaggtacacatgggatgcaggaagttggaagtcgcttctgttctaaagatggttagtcaactggatatggcggttcacacctgtaatccctgcattgtgggaggctgaggtgggcagattgcttgagcccaggagttcgagaccagcctgggtgccatagtgagaccccatctctatttaaaaaaaaattagccaggtgtggtggcatgctcctgtattcccagctactcaggaggctaaggtgggaggatcgcttgagcccaggaggttgaggctacagtgagctgagattgcaccactgtactccagcctgggtgacagagtgagaccctgtcttaaaaaatacatataaataagtaggctgggcacggtggctcatgcctgtaattccagcactttgggaggccgagggaggcagatcacttgagatcaagagtttgagaacagcctggccaacatggtgaaacccattctctaccaaaaatacaaaaaattagccgggcatggtggtgtgtgcctgtaatctcagctactcgggaggctgaggcaggggaactgcttgaacccaggaggcagaggttgcagtgagcagagattgcaccactgcactccagcctgagcgacactgtgagacaccgtttcaaaaaaattaataataaaaaataaattaattaataaatatgtccagccagtgtcagtgtgacagttgtggtcattttgataacagcaagggttcaagaaagccctgggagtgatgtctgattaaatgaactgtccccccagttcttgctgtcgacatctttgacaagttcaacttcacgggagccagagtcccatggttcgacgccattcatgaagaattccccagggagctggagtcctccatctccttcccagccaacttcttcaaaccacctgaagaaaaaggtagaaccgcttagaaacctgctacttcccttggagtccccagcgttcagggaggggagggctccccctgcgggcatcccaggaggatgaacacgccatactccctgcgcactgaagatccggggccggagtgttccgagtgttcgctggcaccaagtcctattggtgacagcaggttgttttgtccaagtgcttaggtagaggttgagcatcctaatcctgaaatctgaaatgctccagaatctgaaccttcttgagcaccaacctgacacttaaaggaagtgctcattggagggtaagtatgaaatgatactttaaaataaaaaaaaatcaaaatccaggccgagcacagtggctcatgcctgtaatcccagcactttgggagaccgaggcagggggatcacctgaggtcagcagttcgagaccaccctggccaatgtggttaaaccccgtctttactaaaaaatacaaaaaattagccagctgtggtggtgggcacctgtaatcccagctactcaggaggctgaggcatgagaatcacttgagcccaggaggcagaggttgcagtgagccaagatgtgccagcctgggttacagagtgagactctgtctcaaaaaaaaaaagaatccagaatgttcccaaacatttcagttaagggatactcagccttgtaactgataacttgagaaagaaaagagaactgaaatttgtatgtgagctgattgtctttgatgggcagttgaacccgtgaagttgaacttgtcaaagatgttgacagcaagaactggggggacagttcctttaatcagacatcactcccagggctttcttgaacccttgctgttatcaaaatgaccacaactgtcacactgacactggctggacatatttatttatttatttatttatttatttatttattattattaatttttttgaaaaggtgtctcacagtgtcgctcaggctggagtgcagtggtgcgatctccgctcactgcaacctctgcctcctgggttcaaagctgcttctagctgggcatgatggctcacgcctgtaaccctaacactttgggaggccgatatggggaggatcgcttgagcccagaaattcaagaccaatctggacaacataggaaaaccccatctatactaaaaaagtttttttttaaattacctgggcatggtggcacatgcctgtagtccaacctactcaggaggctgaggcgggaggattgctttagtccaggagatgaggctgcagtgagttgtgattatgcctctacagcccagcctgggcaacagagcaagaacctgtctgggtcgggggaggcaggggaagctgattctaaatagaaatagaaattttagactcaccttcccttccctgcaagaaacaaacaaacaaaaacaaacaagaatgctgtctgtgtatgtacaaatcttcactcctgggttgagattatgatacaaaacagtttgaacattctgaactttcttaaggtgctttttttacagatctgtgacaattactaaaaacttccccaaataaaaaggacatgaaaaggtaaactccataatggacagtttaaaattggaaaccttcttagtaaatggattttgtcaggtatatggtgttacctcatgtgtcttttttttgtttgttttttttttttgacagaatctcacgctatcgcccaggctggagtacagtggcgcgatctccgctcactgcaagctccgcctcccgggttcacgccattctcctgcctcagcctcccgagagtagctgggactacaggcgcccgccaccacgcccagctaattttttgtatttttagtagagacggggtttcaccgtgttagccagaatggtttcgatctcctcacctcgcgatccatccgcctcagcctcccaaagtgctgggattacaggcgtgagccaccgtgcctggccctcatgtgtcttaaaaagaggggtgactctgatgtggggtcatgcttgaaactgagaggacgaggtccccgaccctccattgcagccagctctctctggaactaacagagtgagaactcgctcattaccaaggggaggacaccaagccattcatgggggacccacccccatgacccaaacaaccccgaccacgcccacctccaaccctgatcacatttcaacatgagatttggaggggccagacctcaaaactgcatcagatacattcatgtttaagcagtccatctccagaactcttttcatcctgcagatctgaaactctagcccacaaaacaccaactccactccccagccactggtgcccaccgttgtttctgtctctgaatttgactcctctagggacctcccataagtggaatcatacaatatttgtccttttgtgcttggcttatttcactgagcgtaatgttctctaggttcacctgtgttgtagcaaacgtcagactttccctccttttgaaggctgagtaatattctgttgtgtggatggagcacgcattgtttatccactcacctgttgacgcatgcctgggtcgtttccacctttcggcctgtgtgaatggtgctgctctgaacaggggtgaagacgtatctgggcgtctgctttcagttcttttgggtgtatacccagaagtgggcttgctgggtcacgtggtaaatcctgtggttgattttttgaggacgcaccatactgttttcggtgggacatctgttgggttttgagaagcacctgctggcactgagagctgtcttggggaacacaggtgctcctgccggagtcctcacgctctgctcacgttgcagaaggccccctggtaaggccagccagccggaggaccaccccgcagaccacacgcccagggcctggcaccgagggggaggccccgatcagcaggtgaaagcgacaccctgatgacactggctagttcaccttcactctggtcatcgtttactgtaccccggggcagctcccgcctgagccctatgaccccaaccgccgcagcctctggtaaggcctgggtatggggcacatggagagggcccattccagaggctcctaagtcaaaagagattccacaagtcaaaatcctgatcctgatcaagcacaggccttcacagtgacatttcactgtgaccctggcccagagacagagaccactgtcctgcagtgtccctgggagggaggttctgggtctgccacaggacaccacaccctggaacattgcacaccctttgcctggccttttcccagtgtttctgtcagaaatgccccctcccaagcatacaccccatcttgtgccccgagggactcgattctctccccacacacccgacccgaggctgtcatgggtagtgcctgctgctggccccagggttagggctgctcagccagtcctggctggaaaggatgaatgtcccacaagcagctttggggcctgcttggtgggagcagcccgaggatccgcccttcgtcctcctgccatttcccacttccctggctctggggtcctcatgttcacgtggttctcagtgactgggtgattgacccccatgagctgtcattattttggtgtcttttgctggacatttaagccattccttgtgtttctgccattagctattatgggctgtaacatctttgcacctgtgccttctttctttttaaatttctgaagtcctaatttgacccaaaggtgacacatctccctgtgtgccctgtcagtgatgaaacctgctctggggatgaagatgccgtggggcccacagatccaagctctcggagtgtgattctgtctcccctagaaacacatccatggcatgtcctcagggcatttgtgcatgggattaagcaaatgtttcctaatcatgtttgtccctgtgctctggcttcttgacctcaggctgcctcactggcccatcattaatacgtcgatggtgagcgcactggtgtacagcgagggggctccacttccgagacccctggagaggcccgtcctggtggagttcaccctgctggagatggagaagcgaaccaagcctgtctgtgtgttctggaaccattccctggcgtaaatgtgatgccgggagttctgcatcttcatgtgagggctttgccaagacacagagaacccgcagggttgttggctcagcggcagatcgtcccacggggacagtctcttgtggtctgtgtctcccccttcagccccctgtggggcagtgagcctcctgctctgcttctgtgggtgcatcagagcccccccagatgcccacacgcagacgcgcacaggcctgcacgtggaaacacagacatgcgcacacgcaggcccacacacagacgcacacagagctgcacgtggagacacgtgcgcacacgcaggcccacacgcaggcccacacacaggtgcacgcggacctgcacgtggagacacagatgtgtgcacatgcaggcccacacacaggtgagcgtggacctgtgtgaacagatgcgcgcagacctgcacgtggagacacagacatgcaggcgcacaaagagatccctcaaggctgacacccaggaaggggcctctcacttgtgggactcccgagatgcagtggccaacacgagtgtagtgcccagttcactgctggataagacagaggcctgttctggtcacacatgggaggcagaacccagagactgggcccaggagcccttctgctgacagtgggaactcccagctacgtgtgggggtccccataccagacaaaggtccctgaccttagtcttgcccgagaggccgacacagcccagctttggggtctggctttacccacaagaggccacaccttgccacagcactgtttatctggcctgtttcagaagcaccgtcagagtggcgaaggcaggaggtggtgcacgagagtctacgttctagcatccattcaagtgagggaaaggcgtttcgtacttagaaaaatgcaaaattaatgattctcacccacacatgagactgtggattcacccatgtatgagatagtggattcagagccatgctgtggctctcatctgctgggagccagtagtgtttgtgctttggttttgcttttttagctacatggtttatgtgaggtgcggacttacttgagttgctctgtctttacagggagcttgctttttctctgctggtttgttttcacttttgctgtctctgtttagaagaaaacattagaactggggtgtggtggaaggatgggagcacaatctgggaggggaagacctgctctctctccacataccaggagggagtggcaggaaggggagacactgtgccggactcagggagtcaagagcgtgagcacccccaggcttcaatctgctgaacgttgtgcatctgggggcgcccgtgcagcaggaacactctccccatcacaattcctctgggcacagtggagagccatgagtgggggctgtcctgggggctgcgctatggtgagtgagcccacgccaggagccagttcagcccagcctcattcttctcctgcttctttgctttccaagttctagttcataagcaaccagcacagtacctggaatgtaagaggcgcttggcttataaaagagagaagaaaggaacccctttcaccacgagggacgtcaggcccagctctctgtcccgggcattcatcttttttccggcaattagcttcagctctaatgacctgctgtctgctttatgttgcacctatgatttccagattgtaaagtttgtggcaaatgtattaacgttcacatcccatttacagattagcaaactaaggatctgagaggttatgtgattttcccagtctggcggagggcagggccctgtcagaagccgagacacacctcgtaacagcttgttatttggggcttcccatcagtgaggcaggagtcataatggggccctggcttctgggcaattcccataaaacattgtgccacctgaagatggaagtgtcagaggaaggcgagatgttatttctgaaagcatctaccctcagaaagagacagaggagtgcatcgcagctgtgtgaacccggggtggtggtggttccagcagcggggcacgtggtggacgcaagacggccccgtttgagttttgctgctaggtgacatgtagaacttgaacttcagagggtgctccttggaggccctgatgagagagacacagaagggaagggagactgttcccatggtcctgcctctgcggcagcgagcctgctgctcttgcagctgggtggctgttcggtgcagggggccggtgaggaacacggtggggagcagcctgcgagggcgccgggctttcagcactcactatacctgctgtttggtttggccaggatggcctgggagtccccagggccgggcaaagactgcccccaacagacatgggcggagggaaccgtctcacccctgcctcttctcccttctctacgcagtgtcagtgggacgggagggtggtctgcccggggcttcaagctcctgtccaggaaccggacccatgtcgtacgccagtgcagccacacggccagcttcgaggtgctcatggacgtctccaggtgtgagatgggcatcttcttgtggccactatgcccgctgagcctacccccaaacctgcccctcctcaaactaaatcttccattctaagcgctttgaacgaagcaaatcaaccaattaaaaaaatatattccaggattggccagagtctgtgaagatttccataacaaatccccgttacaagggttttcagagagccctggttgtgcattaaaccccgcgatggcaaacccaaagctcaggctctgaggagctcttggagtctgcccctcgcttcagagatggtctgtgcgagggtgccgctctcctcccgctttgatcataaggaaggtgacagctgctggggacggtaggcactctccctcagggccacaagctgggctgcaggataaaagactgggcggctaatgtttaacctctggcattttaagcggcctgggagtgtgagccggccattgtgggcctgcagatgaactggggagtggcccgagtgctgtcctcggcaggacagtgctatccagccaggaagtgggtggcagccagcctgggagtggcctatgtgggaccctcctgtctaggagtcagagccagaggcctgggtggcctcccctggcccctccccagggctgcgctgtagctcaagggcccaggccaccatccttcccgagggctttctgatgtgaagtggccctggtttctgtcacagtcttggaagggtgagtcagccctggggcagggctggaggagggctgtggcttcctgtacaatgtgcgggggaagctgtcccacctgtgcccccatctcatgggcaaatggcactccccagcaggacccagcctggagaggggttcagtgattagtggactttgttcatagaagggcagggttgggggttgtctcgtggccaggacgccgggcaacatgtgggccaaggaagctgaaattgaggcggaaggaaggaggctggagtgggagtccgaggctcccatggcctgggtgccccaaagttagcggtctctgaacagccctgaaccagtggagggagactggggtgctgctcctggccccagggatgtccagggcccgggcattgaagggacctcagaaggggcagttccaggcccagggctgtgagcactcggcctccccaacccagccaggtcttggcttcccagctcctagttccacatggtaagcaacgccttccagaagttaccagagaaccagagcttgttgttccccaaatgcagaaactccccagggacctgggtcctgggcaagtgtcctggtttgtaaaagcacaggaaacacagcaatgtgaacctacacactgctgaactgtacgcttcaaagtgtccaagatgatatgttttatgtcatgtatattttagcacaattttcctttttttgttttttgacacagttttgctcttttcgcccaggctggagtgcagtggtgaaaccttggctcactgcaacctctgcctcctgtattcaagtgattctcttgtcttagccttccaagcagctgggattacaggctgcaaccaccatgccgagctaatttttggatctttagtagagacggggtctcaccatgttggccaggctggtctcaaactcctgacctcaggtgattgacctgcttcggcctcacaaagtgctgggattacaggtgtgagccactgtgcccagcctgttttttaaagacatgttcactgcctgtaagaaatgcataataaggtggggtgtggtggctcacacttgtaatcccggcactttgggaggccgaggtgggcagatcatttgagctcacaagttcgagaccagcctgggcaacatggcgaaaccctgtctctaccaaaaatacaaaacttagccaggcatggtggtgcatgcctgtagtgccagctacttggcaggctgaggtaggaggatgacttgagcctaggaggcagaggctgcagtgagccaagattgtgcctctgcaacagagccagaccctgtctcaaaaaaaaaaaaagcataataagggatctggaatttaaaaaataggtccatataacaagctataatagagacgtgcagctggcacaggacatccatccactggtgataatgatagaacacgtcatattgcacgatagtaggaaaaacaggacagatgggaagggtgcggatgaccagcgccgtagcaatctgaagcatcgagcctgccagtccacataactgaaacctgaagctctgcccctgcccagctctgtgacttccagcaagttgtttagcttctttaagcattgattttctcacctggaagatgagggttgcattcacactctcttcatagctgtgacctaaggatgatatgaaacgacgcccttggcagatctatcagaacccctaccacataataagtgctcagtaaaaggttttgctgaacaaaggaaattacattcatgttgtattaccacaattacccactttctttataaagcggtagtaagtctttcagccaaaagaataagtccatgatgggattaagtgaaagtccaagaggtactgcatgcacctaaggtggagatgtgtttatcttttgcataagctggggatgtatttggaaggtttctgctagcccagaatttgggtggacaggctgagcccctcccaacagcaggattcacctatggggttggttttgggtagacaggctgagcctgccccatggaactgtaggggcttacgaaggcatttcgtttggggaaggagctcatccaggaggactgggatctctggttatatgtgacttctgacctctgggcatggaggtctctctccagaggcccaggcctggacacgaagggagagaggcctccattgtcccacaggggccgaaatgcagacggtgcatccccggtgccctggggaacccttctctgatcatcaggattctcttggactccggggtccttgtcctgctcaggcatccctgccctgctgtccttcagggccctcaacacgatcttctctggacacgagtctggggatagccgggtgttgtgggctccaaagggttgactccttgctcctgggccccacagagagtccttgtgctcagtgcactggctgtgctgcaagatatcctggaattcgaagcacacagtgctggcttgctgtggtacctgtgcaatcaaattgaaggcaagatcaccaggaaggaacacagggcttgcaagatcacggaaaaccttcttggagttgttttgacacaccactcatgtcaagtgtctgggtacttgtaggatggcccgccactccacccaggggcaggagcaacagggagatcccacaagcaaagtgaactgggggatggggtgagtgggctccaggcaacagagccctactggcaggtcctcaccccctgggccggaactggagtgaggggcacagagtgcccaggtaaccgctcctgggaacagtggggaactgtcagatgctcgaactttcgagagctgggctctgagcgtcctcgtggagctgccaactcggccaaaggagaagcgagcagtttcttctgttgccgggcaacacgccttttaaacctgagcgagtgggtgcgcatgcaaagaacgggcgcgagtgacagagcgaccttaacggattagcaccttaacggattagcaccttaacggattagcgtggcaaggtatgcaagcaagtcacctgctggcaatttgggggtggggagggggaggtgcgcaatacatactggaaggagaggcacccacacaaaggacgcaggaagaacaggtgcgcacaaaggcacaatggcggcagatctgcccgtggatcactgaagattcctgctctcctgctgaggtggagattgcagtgaactaagatcacaccattgcgctagagcccgggcgacagagcaagacttggtctcaaaaaataaataaaataaaataagtacaataaaataacaaaacaaaacaaagtaagaggagatgatatctggtcgtgttttatggccatctggtaagctagattctttcctttggttttattgccaatcaatgattagaaagaagcagtttgctgttggcttgtttttcccctcaactaaatgtaagaaaaaaaaagagtcaaaaataccgaagctaattttaaaatgtatgtatagagagagacttggtcttaccttgtcatccaggctggagtgctgtggtgccatcacggctcagggcagcttcgacctcatgggctcaggcaatcctttcacatcagtcgaccagatagctgagattacaaatgtgggaaaccacaccctgctaatttcttgtattttttgtagagtcggggtttcaccttgttgccgaggctggtcttgaactcctgggctcaagcaatctttctgcttctgcctcccaaagtgttgggattataggcatgagccaccattcccgccgaaatatttttgagattcatagagatgagtaggtcataataagagtgcacaacttgtagttatatttaatatcttttgaaattactcggcacccccattgtaatttaaatgatttgttcctgacctggttttactttgttcctgagggttgcagatcccttgaacaatattccacgaatgaagcagtgataataaacctgcagctgccccgagggggcgctgtgcggaggttcacaaagggacctgggtctccctggtgcggatgcgggggccgcctccattctgctttctgacactgccaccgcggggccaggcttgatgtgaccccatcactgctcagttcactacacagtttcatcttttgatatggaagatttgactccatccacgttccttaggaggttactggaaatgacagcgctgtaaatttctgggtaaatgagcagccaacatttttgggagctgtcacacaaccacactgcccttccctctgcctgaaaacctttaggcctgattgactcggagaaagcccattaaactcagcccccactgacttgttcatttccactcaaacgtttgtgatagtcccaacacaaggcttgtcctccaagggacaacttgtaaacacttctaagagaaagggttgactgggcccggtgcctcacacctgtaatcccggcactttgggaggccgaggtgggcagatcacttgaggtcaagagtttgagaccagtccatgatcttggcttgaagaggcaagaccctatagtttattgaacattttaagcccactccttgatccatgagccgcagaatggatgttgtattagcaaaaatgaaaacaacattaatctccttgtatcatcattagagctcctggctgactggttacattgtcaatcaacagtaatattttgaaaggaacagtgggcttaaaatgttcaatatgctgtcaacagatgtgctgtcatccaggctttgttattccgtttatagagcacaggcagagtagatgtagcgtaactcttaagggccctaggattgtgggactggtgaatgagcactggcttccacttaaagtcaccagctgcttaggccctaatgagagagacagcctgtcctttgaagctttgaagccaggcattgacttctcctctgtagctatgaaagtcctagatgtcatcttttaatagaaggctgttctatccacattgaaaattgtcatttagtgtggccaccttcatcagtgatcttagctagatcttctgggtaacttgctgcagcttctgtatcagcacttgctagcttcgccttgcacttatatgttatggagatggcttctttccttcaatatcgtgagccaacctctgctagcttcaaacttttcttctgcagcttcatcaccaatctcagcattcatagaattgaagacagttagggccttgctgtggattcagctttggcttaagggaatgttgtagctggtttgatcttttattcaaggcaggaaaactttctccatatcagcaataaggctgttttgctatctatcatttgcgtattcactggtgtagcacttttaatttccttcaagaacttttcttctgcattcacaacttggctaactggcctagctttcagccttttggcttttgccgtgcctttctcaattcgcttaagcatttctagattttgatttaaagtgaaagatgtgggagtcttcgttttacttgaatacttagaggccattgtagggttactaattggcctaattttaatattgttatgtctcaaggaatagggaagcccaaggagagggagagagacagaatggctagtcagtggatctttcagaacacacacaactttatagattaagctcactgtcttatatgggcacagttcatggcaccccaaaacaattactatagtagcatcaaagaccactggtaatacatcaccataacagttataataataatgagaaagtttaaaatattgcaagaattaccaaacttgacctagagacattgaagtgagcacatgctattggcaaaatagtactaacagacttgtttgttacagggtagccacaaacccccaatttgtaaaaaacgcagtatctgtgaagcacaagaaggtgaagtacaatctgaggtgtatctgtattttcttccacgttgttaggtgtcttcttataacctaagttttagattttcctagacaataacttaaataattttagaacattataaattacttctcccttgaaggattgcttgtggtcaggagtttgagaccagcctggacaacatagtgagatcttctctctactaaaatttaaaaaaatatatagccaggcatggtggcgatcctcccacctcagcccagctacttggagggctgaagcagggggatgacttgagccaggaagttgaggctgctgtgagccattatcacgccactgcactcctgcctggacaacagagcaagaccctgtctccaaaaaaaaaaattacttcccctttgattatagaactttgtcacatatcaagttgattaaatgaagataattcaagcattaagtaattatttaatgctttttgtgttcttctagtttgagttctatgattctatgatcttaagatatttaccttaatatatagagagacatatatattaattattatataacacaaatcaattatttcaattaataatttgaagtttttttccatttacttggtacttagaatgcagggggaaatatgatataggatggttagtcatacataaggaaaattctttttgtacacttgacagtcttggctacatacccaattctctgcttttttatttcctatggacacttctttgatgatatatatgtatggcttgggggaggcggttggcttttgtttcctgtgagacagatatctaagttccatagatatctgttccttccctttagaagcaaagaggatactggttcttttatttcaagatctgtaagttaaaattggacagtctgaaatgcataatctttttcttttttgagacggagtctcactgtcacccaggctggagtgcaatggtgcaatctcggctcactgcagcctccacctccctcccagtttcaagtgattctcctgcctcagcctccagagtaactgggattacaggtgcctaccatcatgcctggctaatttttgtatttttagtagagacggggtttctccatgttggccaggctggtctcgaactcctgacctcaagtgatccgcctgcctcagcctcccaaagtgctgggattacaggcgtgagccactgcacctggtctgaaatgcataatcttttaaaactgaaagccatttctaatagtgttcttaatttgtcaagaatcgtatgagaagtgccagtgccctttgcctgtctagctataagtggattatcatgcccaccctttggagccagcagttttggttcagtcctttggtctctgactactcacagtctgcaggaaagagcaggttgtgacacttgactagtttatgagagcagaagctgttacgtgacacttagcacatactgctctcagaggccccagatggatcattaatgctcggaacgtgcgtgctttatggagaaaccgcctaatcaacggaggtagattccctaatacccatatcatctttcgttaactctcttaagagtcaccctaaaattactgtgctgacgatcactgtatttcattaagtatccattacaaaacaagcccttatgagtttagcttttatttaacaaatacattgttctcttctaacttgtgccttttatcatccgttgaagctttagaatagtagaatgttcatgctgaaaacgtcttggcattctggtttattatcaggtttacagatctgggactgaaacccgcacaaggataaatggctgcctcaaggctatcttgtgagtccagggcgttatgtaaccagctttcagtactattgctttaagggttgcatcttcctttttttctatttttaaaaaatcagtgcctctgtttatacacaattatgtttttaatttaaatatgcagctaactgtaataatttttaagtgcttatcatgagaaggggtaatcgagttcccatttccttatctctaaaatttcgctgtccagagacaaccatttttaatttttttagctgttgtctttagggattgatggtactagattggtaatacaagaataaccaaccggaatagagaagatgtttatacattcagtaaacttttctttggttttagatttttctgtctatgagctttagttgcgttattgttttcttgctctggaaaaccctaactgaatgcaatcaagatgcctctaaaggttcaattgagagagctttattttgaatgaaaaatctcattgttttttgatgaaatgctagacttagaaatggattggttaaatctgaagaataatgaaaccacttaatctagtataaaatacttttaataaatgaacagaagattttagtgctgcctgaggtcatttaatctcagattgacattgagaatgcagctttattgggggatgtacttcatgaatgtgtgggccacagaagaaaagattggctgtttcttgctggagatgagtggaatcaaaagaattaatgggctggaatggtttagcaggcatatatttatgtgttatgctttgcttgcattctaagctttttttcctaatataaaagttaataatttgtcaactagtaacctctgtgtcaggtagtgtgctgagtgtttaaatagaagttagggaataaaaatagtttctattctcaggaagtttatggactagtcagtaaaaaatacatcagtaattaaaactcagtaaattaaaacttttgtttatggttataacagaatatcagaccaaatctctgatgagactactgtaaaaactgtttaaaatacaaaaacaaatatctttgatggcactggggactaaccaaggcagccaggtcaaatttggcaggagccaaaattgtagagaaaaatcctattgagttgagcccgtatgtacccctgcttttttcccttagggtggtggctaactctacacatggggtggagaccagacaaagcagtggtccagagtttgtttcataaccactgagtagtgggagtaaaacttgaattgagggattctaaggcagccaagatttgagggtccaagatcctaggaaaaagacaacctcaagagtaatgaactcagtcaacatggtggcacatgcctctagtcccagctactcaggaggctgaggcaggaggattgcttgagcctaacagttcaagattacagtgagctttgatcacaccactacactccagcctgggcaacacagtgagaccctatctctttgggaaaatagagagagagaaagagggtagtaaactcaatatttgacttagcttttgctgttaaggtatttttcaaagtcagaaggagaaattcagtagaaagctattacccaagcctaaaaaacgtaagcacagtttttgttctcacaggagtaggttgacaaaaaattagatttcaaggccagccaaagaggaatgacaatgggaaatactccaggccttcggctgagacctcagaagaattatgacctacaaataaaggttgaccagaagttatcagcttgaaatccagcttcaaaactttgattggatcagggtgatcagcccttattctagttacctgccagaagaaacttagcccctatactcttggaacatactatcctgcattccatcaaaataccaggcatggccaggcgcagtggctcatgcctgtaatcctggcactttgggaggccaaggtggtaggattaccggaggccaagagttcaagaccaacctgcccaacatagtgagaccctgtctctataattaattaattaattaaataccaggcatgccaataagcacgatcaagtgaatgaaaatcaagagaaagaatgagtaacagaaagaacttgaggtgatccagatattggaactcttagataggcttttaaaataaccgatttatgagtttaaggaaacagatgaagagatagagagttttaccagagaactggaatctataaaatagaatcaaatgaacattttattttattattttattttattttttattttttgagatggagtttcactcttgtcacccaggctggagtacaatggtgcaatcttggcttgctgcaacctccgcctcccaggttcaagcgattctcctacctcaggctcctgagtagctgggattacaggcacctgccaccaggcccagctaatttttttttttttttgtacttttagtagagacggggtttcgtcatgttggccaggctggtctcgaactcctgacctcaggtgatcctcccaaagtgctgggattataggcgtgagccatggcgcctggccaaatgaaaattttaggactaaaaatacattagcttgagttacaaactcccaagcatgtgtttcacaaccactcaacacggaaaagatttgtgaattagaggactgatcagtaagaaatatctacagtgaagcaccgagaaatgaaaggatgaaaaaaatacagtgtagtggagacacaggacataatagaggggttaagacacatacaattgggttatactaagagaaaagagagggctaggagtgtcataagtgctaaaagtcaaggacagcaaaaaaaatctttaattgctagagaaaaaagatactaggttaagaggaataataagattggcagccgatttctcaatagataacaaaaagaggatttgtcaccagcaggcccattctgaaagaaaaaggaagttctcgtcgcagaaagaaaataataccaaagggaaacaaaatttcaagaaggaataaagaacagtggaagagtaaatatgaaggtaaatatatatgaatattgactgcagtgtaataaaaatgtcttatttaaagatacatgcaggtttaaagtttaagataaaatggttcaaaagttaggagggggcagtaaatataattaaggtgttgcaaggtctttgaattgttcagaaggttaggaaattaatttgtcgtagactctgagtaagtgaagggctgcacattgtaaatctctagtcctacacgctgctacagttgacattcattgcacggagttactgagaactcaaatgtgactattctgaattgagatgtgctgtgattataaataaacaccagattttgaacacttagaagatttcatatagaaaaatagaatgtaaaatgcttcatttaaaaaatactgattacatgttgaaatgatctcttttttttgagacagagtctcgctctgtcacccaggctggagtgcagtggtgcatcacggcaggctccacctcccgggttcacgccattctcctgccccagcctcccaattagctgggactacaggtgcgtgccaccacccccggctaatttttttgtatttttagtagagatggggttccaccgtgttagccaggatggtctcgatctcctgacctcgtgatccacccgccccggcctcccaaagtgctgggattacaggtgtgagccactgcgtctggctgaaatgatcatatttttaatatgtttgattaaataagatacattaatatatatttttaactttttcaatgtggctactataatatttaaaatcacatattgttaacaaagtaataaaagaatggaaaataagaggctaacagaagagaaatggaatattaatacttgattaatccaaaataaggcaggaaaggagagaaaaggaacaaagaactaagggtacagtaatagatgtaaacccaaatatgtaaaaatcacattataggtaaataggctgcatattccagttaaaagacaaagattttcagattaaaaacaatagacccaaccataattttgttcaaaagacccactttaaatagaaagactggaagtaaaagagttggaaaagatgtactatgcgagcactaaccaaaggactgctggaagagctatactaatttcaaagcgtcatttctcagaaagaaatattactagagatagagattgtccgtaatgataaaggattaaaacaattacaatagccaaggcacccttagaaaacaatgtgggaagacttcacgctgcccagtaagactttagaggcacgtagagcacatcataaattcatatgtatctagtaacgcagccccagagaatataaagggaaactgatagaactaaaaggcgaaataggcatatttggaaattttaacacattcctctcattaacgaatagaaaaagcaaatgaaatttagtagagctacagaacatgtaagtaatgctattaactactttgtcctgactgatccataaaacactgcaccagacaacagcaaattgcacattccctttgtgtgtgtgtgtgtgtgtgtgtgtgtgtgtgtgtgtgtgtgtgtgatggagtccctctctgtcacccagactggagggtagtggcgtgatctcgactcaccacaacctctgcctcccggattcaagcgattctcctgcctcagcctcccgagtagctgggattacaggcatgtgccaccatgcttggctaattttgtattttcagtagagacggggtttctccatgctggtcgggctggtctcaaactcccgacctcaggtgatccacccgcctcggcctcccaaagtgctgggattacaggtgtgggccaccgcgcctggcctgcacattccttttaattggccacagtatattcatcagaattggccacatgcactctcaaaaaatttcaatgaattaaaatccttcagagtaagttctcaaagtggagggaaaaatgtgatctaatcaaagtgatgaacaaaagcatttgataaaattcaacacctgtttattagtttccaaaaaaacccccacagaacaaatttctaacaaactgggaataaagggacttttaaaaagatgataaagggtatctacacaaaataatatttatagtggacattaagcctaatggtgacttattgaaagctttcttccagagatgaggaaagagacaagaccctgctctcatcacttctattcagtgttgtatgtaaagctctactgggagactgaggcaggaggatctcttgaggccaagagttcaagactcacctgggcaacatagttagatgcccatctctacaaaaaattaaaaaataaagttctagtcagggcagaaaggcagaaagagagataagaagtataatacttggaaagaaagaaataaaattctatttgcagacatgattatgatgtaggaaatactaacaaagatgcatgtaaaatatgagaattaatagcaagtgaaaaaaatttcaggatctaatttttattagcatttaaaaaataaagtacagtggccaggcacagtggctcacgcctgtaatcccagcactttgggaggccgaggcgggcggatcacaagatcaggagtttgagaccagcctggccaacatagtgaaaccctgtctctactaaaaatacaaaaattagccaggtgtggtggcatgtgcctgtagtcccagctacttgggaggctgaggcagaagaattgcttgaacccaggaggcggacgttgcagtgagctgagactgcaccgttgtactccaaaatgggcgacagagcaagactctgtgtcaaaaataaataaataaataaataaaaattatagccaggctttgctgtgcctgcagcagattagacacagaatgcctcattttaaaagctcataataccaagtgttggcaaggaagcagagaaacaagaacacttgcaccctgctgatagggctctaaactgttctcgccagtttggaaaacattggcactatctgctgaagttgaatagtctccttaagagtcaaaagctggaaacaacccaaataatcatcaagacatgaatggacaaatgaattgtgatatataaggtatacaaaacaagcaaaaaaaaagaacaaactgttgcaacatgcagcagcgtggatgaatctcacacgcataatattgagcagaagcagccagatgcacgggagtctgaactatgattccatttaaatgaagccaaaacagtggtgggaattaatctattataatatgtcagaagagtggttatctttaggggaattgagggaggctttctgggattctgattacattctgtatcttgatttgggggaggtggctacatggtgtattcactttgtgaaaatgcttttagctgtacttatcatttgggtacttcatgtatattatacttcagcaaaaattaataaaaaatatttttggtattttcaggaatgttgttgccccaattatctgtggttctgaggtttttatgtcacatgtttctgatattttactcttcttcatttattccagatgatttattaagatccattagattcattttcttttctatataaaacaaattatttatagtatagtgtattcgttttctgttactattgaaattactacaaatgtagtggctaaaacaacacatagttttcagcttagagttgtgttggttagaagtccagcatggctcttactggactaaaatcaaggtgtcagcagagctgtgttcttttctcaaggctttaggggagaatctgtttccttgccttttccagcttatagaggcagccatgttttttggcttgtggccccttcctccatcttcaaagccaacagctggtcaagttgtcacattgcgtcactctgaccataggttatctgcttttaaggtcttgtgtgatttgattgggtccacctggaccattcaggatcatcttcctgtccttaaaattcttaatcacatctgcaaactctcttgccatgtaagtgaacatgttcagaggttccagagagtaagacatcaatagcttatggggctaccacagataccttatacaattatctcctgaaagttgagtttctaggatttagttgtgttatttttttttataacttgcataccatacaactcaccaagttggacagttcagtggtttttaatgtatgcacagagttgtgtaaccatcatcacaataaattttaggatattctcaccacctcacagccctaggcagccaccatgggtttgcctgtcccagacatttcatgtaacaggaatcatttgtggtcttttgtcactggcatctttcaggtatcattttttttaggttcttccatgaggcatgtgttagtacttcacacctttctatggctgaatgattttttttttttgagacagagtttctctcttgtcacccaggctggagtgcaatggcgcgatctcagctcactgtaacctccgcctcccgggttcaagcgattctcaggcctcagcctcccaagtagctgggattacagacatgcaccaccacacccagttaatttttgtatttttttttttagtagagacagggtttcaccatattggccaggctggtctcgatctcctgtccttgcgatccgcccgcctccacctcccaaagtgctgggattacaggtgtgcaccctgataagtgacaagtgctgattaatttgcatttctctcattatgagttaggttgatcatcattttctgtatttgtgtgtgtgtgtgtgtaaattgattgtgtgattcattcattttgctcattcttctgtctttttttggtctttttcccttcaattttaaaccattttggatgtattagggaccttaagcatttacttgtgagatattgcaaatatactttcccagttttttatgtttttaaattctatttatgatggttttctcgtcatgcaataacattttcactttttttaattaaaaggattttttatttttaagattttaatttttatgtagtcacatcgatcaagtctttgttttacaatttcagatttaaaatcgtagttagaaaaccctggactttatatttgatatggtgtgaaataggtctcagcatttatctttgccccctttgtgtatacacttgacctagcactatttgctggaagactcttgttttctgcattgctgctttggttataaaacatgtgtctataaatatgcagcttcttcagagactgttttactagtttattcttgtgccagtgctgtattgtcttaattattataagtgcaaagtttgtgatttggtgcccttgtgtatatttaactttgtcattacccaaaggcaaattgtaaccagagaagtgtgatgagtaatccacgttgacatgacaatggagggtggttttcaatgtaattattatcaaatgaaagaatatttaacttacggaggaagaaagattagttcaaagacaattttacttttattagcaggatataaaagaagattgaaaatataagaatatgttgagtttatttactggctaatagaggagggacaaattggcaggaaagtggtatgactttcattgtgtgactttttggcatcatagttgatggccagtttttgtgaacagaaacaagtcttaaagaatatgaacaggccaggcgtggtagctcacacctgtaatcccagcagtttgggaggccgaagcaggcggatcgcttgaggccaggagtttgagaccagcctggccaacatggcgataccctatctctactaaaaatacaaaagttagctgggcgtggtggcacacgcctgtagtccagctactcaggaggttgagtcagaagaatcgcttgaacccaggagggggagattgtggtgagccaagatcatgccactgcactccagcctcagtgatagagtgagactttgtctcaaaaaaaaaaaaaaaaagaaagaaagaaaaagaaaaaaggctaagcgcagtggctcatgcctgtaatcccaagcactttgggaggccaaggtgggtgggtcacctgaggtcaggagtttgagaccagactgaccaacatggtgaaaccccatctctactaaaaatacaaaatttagctgggcgtggtggcgcacgcctgtaatcccagctactcaggaggctgaggcaggaaaatagcttgaacctgggaggtggaggttgcagtgagccgagattgtgccactgcacttcagcctgggcgacaagagcgaaactctgtctcaaaaaaaaaaaaaagaatatgaacagtccttgaaattaatgaaattagtgcagtgtctctctctctttttatgtattctagatttcataatgtgacagccctaaatcataaatcaccagagttaaattctgtttaattcattgaaaatattgatccctttttctgcctcttttttttgggggggcaggtggggacagggtctcactctgttgcctaggctggagtacagtggcgtgatcacggctcagtgcagctttgacctccttggctcatgcgatcctctcatttcaaccttcccaatagctgggactacagacatgtgccactttacccagttaaatttttaaattttttgtacagacagattctccttatgttgcccatgatggtgttgaactgggctcaagtgatgcacctcggcctcccaaaatgctaagattacaggcatgagccactgtgcccagccttttctgcctgttcttaacctaatggtactgtattagaactttcataattgaataacagaaatacactccacatggagtcactgacatttagaactggaagagactttagagattagttacttataaactactttgatttgtacaaataaattcagtacaattatctgagagagggcatggttccagataggagatagtgtaaatcggttggctaactcatgccaaagagacaaaacttttgggttcttttgataaaaagtagtttttattttttttccccacagatctttaactcctctgtgttcccttcatttctagaggaagtgaaaacatttcttcactactttttagaataataaatttacagccaatttattatccatagtgttttttaaagctcatattttaaacattgtctttataaaatataaatattgcaaatggtctttatcaagtaatatgatcatttagacagcataacccttgctcaaactgtaaagtctctagttttttattaatatattatgcatgttttagaaaatacctcctttcaatggtgactaaaatttgactactacagaattataaagtaaaaaacataaatttcagaaaaaattctttttttctttttttttttttgtgacagagtctcactctgtcacccaggctggagtgcagtggcgtgatcttggctcactgcaagctccacctcccgggttcatgccattctcctgcctcagcctccctaagagctgggactacaggcacccgccaccacgcccaactaattttttgtatttttagtagagacagggtttcaccatgttagccaggattgtctcgatctccagacctcatgatccacccacctcggcctcccaaactgctgggattacaagtgtgagccaccgcgcccggcccagaataaattcctttagatactggcctcatcatggaatcactttagagcaatgaggattatttgactctcaatgatatttctttctggaaattgcaagatgacacttcctgtggcattataggattttcccaagatatcatgtgctatcccccatcatctgaatctggcatatgtggacacatctcaggcttccataaagtctttgattacatatatgattttattgttttaaaaagaagtacatgatttggccaggcacagtggctcacgcctgtaatcccagcactttgggaggccgaggtggctggatcacaaggtcaggagtttgagaccagcctggccaatatggtgaaaccccgtctccactaaaaaaaaatacaaaaattagctgggtgtggtgatgcatgtctgtagtcccagctacttgggaggctgaggcagaagaatcgcatgaactggggaggcggaggttgcagtgagccgagattgtgccactgcactccagcctgggcaacagagccagactctatatcaaaaaaaaaaaaaaaaaagaagtacgtgattgtttataaacctgtaaagttctatttctgtagcgcagtatggtgtgctgcttactacccgtcagaaagttttggtaatagggctcttgaactcagtataaaagtcatgagctttgttgagtctcaaaatatctaatcttgcttgatctactaaattcgttttcattttctgttgcttctagaccaagagcagtgatgaccttttagctggaatggccagaggggtaacggtgactaatggtgttaaagggaaggaaagctcctgcccatctgcagcaccttcggcatctgcccctgccatgaccactgtggagaacaaatccaagattagcacaggtatgggtgacattcagtctgagacttcaactgcttttttgtttgaataggcaggatgcattggtgtttacagtgttccatctcattataggaaattgtagacatacaaaagtagatggattgatatttcagcccaatacgctcatcacgctcatcaccattatcagctcacagccagttgtaactctgtgatacccaccctcccctcttattattttgaagcagattctggacatcatatcatttcatccataaatattttattatcttggaaagagaaggattcttttaaaaatataatcctaataccattatcagtccttaaaataattgataatcattccttaaatcataccttattcaatgagtatttaaatttctaacagtcttataaatatttttgttttatttactatctatttttatgtttggatcaggactcccataggtccatatataattggctgatgtgtctcttaaatcttcttttttaaatctatgggtttaacccaattcttgcagtttaatttttgtggaagctggtcacgtgacctatagagtttctgagcatgtggatttttatatcacaatatccccatgacgtttttgcccatcaccctttgttgtgtgtatttattgtaaatggcattggagacttatgggacagattcaggtcccctgtccccccaatttgaaaaaaaaaaaaaaaaacaaccaaaacaccatgttgaccaggctgatgtcgaacttctgacctcaggtgatccgcctgccttggcctcccaaagtgctgggattacaggcatgagccaccgcatcatttaaatgtactgaaagtccaggcatggtggttcagagctataaccctagtactttgagaggatgaggcaggcagatcacctgaggtcaggagttcaagaccagcctggccaacatggcaaaatcttgtctctacaaaaaaaaaaaaaaaaaaaaaattagccctgcgtggcggcgcacggctctagtcccagttacttgggaggttggggcatgagaatcctttgaaccccggaggcagaggctgcatgcagtgagttgagatggcaccactgcactccagcctgggcgacagagcaagaccctgtctctaaataagtaaatgttgccggtaatcctagcactttgggaggctgaggcgggtggatcacctgaagtcaggagttcgagaccagcctgactactatggtgaaaccccgtctctactaaaaatacaaaaattagctgggcattatggcatgtgtctgtagtcccagctactcaggaggctgagacaggagaatcgcttgaacccaggacgtggagggtgcagtgagccgagattgagccactgcacttcagcctgggtgacagagtgagactccatctcaaaaaaaattaaataaaataaaaaataaaaataacagctccctaacagctccggaaagataaacagaaaacagaaaatgacatgctcagcccttgaggccaaaatgcccttccccagagcagctgccagaagacagggagcaggatcgggttggaggtcacttctgggtgagggggagaatggtcagacccgtggcaggggtgttggagcctggtcggcctcactggaacagaagagagctgcttcatgatgctcaactgacaggcagagcctcgcataacccaagttctcatggttcagagaggccagccagtgcggggacaaagacaggcacgcactgaaatggtttcctggaagacggcccggttgcatctctcaaacgggaccagattggaagggagaccagctgctttgggcaaccgaggctgcttctgggtgaactcccaaactagatggtgccgagagccctggacctggcagctgggctggacatcacatggctctgtattccaggaaacggcatctcagtgcttgtctggccagttctccaaaagaaccatccacaggccatttttccattcccttcctatgcacagactgggctgggcctgatcagaaaactctcccttagggttttcagtcactggcgaaacttgagcccggcactgaggataggatgttaaaatgtgactctgggccaggcggcggctcatgcttgtcaacccagtgcttttgggaggctgagctgggagggtcacttgaggtcagcagttcaagaccaacctgaggaaaatagatctctacaaaaaaataaaaataaaaattagccagctctggtgacatgcacctgtagtcccagctacttgaaaggctgaggtggcttgagcccatgagttcaaagctacagctatgatggtgtcactgcactccagcatgaaaaacagagtgagaccatgtcttgaaaaaaggaacaaactaggcatagaagaaacatacctgaaaatggccaggcccagtggctcatgcgtgtaatcccagcactttgggaggctgaggtgagtggatcacctgaggtcaggagttcgagaccggcctggccaacatggtgaaaccccatctctaccaaaagtacaaaaattagccgggcgtggtggcgggcgcctcccagctactccggaggctgaggcaggagaatcacttgaacctgggaggcagagtttgctgtgagctgagattgcaccattgcactacagcctgggtgacaagagccagaatccatctcaaaaaaaaaaacctagaaataataaaagctgtatacgacaaagccatagctaacctactacagaatggggaaaagtgaaaagcgtttcctctgtaaacaggaacaagacgaggatgcccgttctcaccacttttattagacatcacacaaatatgcaagagaaaaaaataaaagccacccacactggaaaagaggacatcaaattatccttgtctgatgaagatgtgatcttggatttacaaacatgtaaagcctccaccagaaaactctagacttgataaataaattaatacagtcatttgcaggatacaaaatcaacatacaaaaatcagcagcattttatacaccaataatggtctaggaaagaaattaaggaggcaatcccatttacaatagcaacaaaatgaaaaatgatatgccacagaggaaattttaccaaggaggtgaacgatttctacaaggaaaactacaaaacactgatgacaaagtttaagaggacggaaagaaatggacagtcatttcatgctcatggaaggaattcatagcattaaaatgaccacactgcccagagcagtctagagattcaatacaacccctaccaaaataccagtgtcatctctcacagaactggaaaatcgtaaaactcatatgaaaccaaaaaagagctcaaagagccaaagtcatcctcagcaaaaacaacaaaactagaagcaccccatttcactgcaaattagaatgacaaaatttttgacaagtgcatggtaaccaaaacagcatggtcctagcataaaactagacacatagatcaatgggacggatgacagagcccagaaagacagccacatagtcttggggcttgtgtctctcctgctgtgcatccatgctgggtgctttacatacaacaggcagacaagaagtccctgttgcaagtgaggacaaagtgtgggaaggccgtgagggtctgcagtcccagatggccttggcctcaccccgcagtgcgcttttgcaccagagtgccaccttcttctccaggtccaggtcttcagcagtgaccccagaccccagctgtaagggaggtggcagcatcagaggctccccttgcctgagtggcagcagaggaaacttgcatctatggggcctagaggcctgggatgtgggggagccattcctgggggcaagtgtctgccctggtgctgcatctgctgccttttcacactgggtgagaccccaagagacagcctgaggccggtcctcactcactgtctttgaggacctgaggggcagctgacagtgggatgaggctggccccctcctctttggtgacaggaagcctcccatggaactgtaggagctcacgatggcattttgtttggtgcacgaactcatccaggaggtctgggatctctggttttatccgacttctgacctctgggcatggaggtctctctgcagaggcccaggcctgggcacgaagggagagaggcctccattgtcccacaggggcctaaatgcagactgtgcatccccggtgccctcaggaacccttctctgatcatcaggattctcttggactctggggtccttgtcctgctcaggcatccctgcccccctcttcaggagggccctcaacacgatcttctctggacaggagtctggggcacaactggatgttgtgggccccaaaggggtgactccctgctcctgggccccacagagagtccttgtgctcagtgcactggctgagctgcaagacatcctggaattgggagcacacagcaccggcttgctgtggtacctgtgcattcaaattgaaggcaggatcgccagcaaggaacacagggcttgcaggatcacagaaaacccttggagttgttttgacacaccactgatgccaagtgtctgggtacttgtaggatggccctgccattccatccaggggcagtggcaacagggagattccacaaacaaagtgaactgggggatgggatgagcaggctccaggcaactgagccctactggcaggcccttggcccccggggccgggacaggggtgacagacacagagtgcccaggtaaccactcctgggagcagtggggaaccgtcggatgcttcaactcttgagagctgggctctaagcatccgccttagctgccaacttggccaaaggctatgcgagcagtttcccgttgacgggcaatgcatctttccaacctgagcgagtgggtgtgtgtgcaaagatggtgcgagtcacggatctgcgcaggaagggtgactttaagggattagcatggccaggtatgcacacaaggcacctgctggcaatgccttggtggggagcgggcagtgcacacaagaggtactggagggagaggcgcgcgggaagaacaggcgcgcacaatggctgcagatccacctgtggatcgctgaagattcctgctgagggttgaggctgctgggctggaggactgtatggtccatgcattgtaatgtccccttctctccctggcccggagccccaagagctatccggactctctccaagacctggttctggcccagcaaagaggtctcggcaggggagcaggattcccggcccagcagctggctcaggaggtgacagctttgggattcgcatctgagcatcctcctactcttctcctgggaactctgttggggagggttgctcagaacagaagtgcctgggacgcccagatcctgctggagtggcagctggggtgatggccagggcaggctgggagggacatactttccataggacccagtgctttcatctccgtgcaactgaccaagagaaaccaaacccaaactccttcctttacacagacctatttgagggaggctgggtattgtttgtgtatttcaacctaacaagattttgagatagttggaatgcagaaggagacaggaggactcaagtgtcctgtcttttgcaaaaatgtcaaacgtagctactcagtctcttttttgtttttttgtttgttttgaagactatggttattttgcaaaatatatattatttgagtttctctaggtgctatttttagataaattaatatacttttttcatcagcacatgaaacgttcttcaaaacagatcctttgttagtccacaaaagctgtccctacacattttaggaaatcataatcataatcattccaaagatcagacaacagaggaataaacctagaaatggacatcaaggcaaactacagaacctatacgcatacatgaaaattaaaccccaccctcctgaatgagcactgattcaatgaagaaattaaaatgaaaatccgaaaatgttttcaaacaaatgaaaatggaaacatcatataccaaaagcctttggattcagcaaaatcagtgctgtgagggaaggttgtagcaataaatacctacatccaaaaagtagaaagatgaaaaattaataaacttatgatgcaccttaaagaactagaaaagcaagaacaaagcaaaaccaaaattagcccatgaaaaaaataataaagatcagaggagaactaaataaaatagggtctcaaaaacaacacagaaatcaagaaaaggaattactggttcttagcaagaaaaacacactttgggtatttcctttttttttttttttttttttttgagaaagcttttttttttgagaaagcgttttgctcttgttgcccaggctggagtgcagtggcaagatctccactcaatgcaagctccaccttccaggttcaagtgattctccttcctcagtctcctgagtagctgggttacaggtgctaaccaccatgcccagctaatttttgtatttttagtagagacggggtttcaccatgttggtcaggctagtctcaaactcctgacctcgtgatctgcccgtgtcgtctcccaaagtgctgggattataggtgtgagccaccgtgcctggcctcaaaatattcttttgagggactcttgcatacaagccccaagaggcaggtgcaaaaatgtccatagaaacacagtaatagaaaaaaagaaaatccagactgattcaaatgtccattaacaggagaatgaataaattagttggaatcttcttttcttttcttttcttttcttttttttttttttgagacggagtttcgctcttgttgcccaggctggagtgcaatggcacaatctcagtttgtggcaacctccgcctccggggttcaagccattctcctgcctcagcttcctgagcagcagggattacaggcatgcgccaccacacctggctaattttgtatttttagtagagacggggtttctccgtgtttgtcaggctggtctcaaactccggacctcaggtgatccgcccgcctcggcctcccaaagtgctgggattacaggcgtgagccaccactcctggccattagttggagtcttcttatacagtggtgagactgaatcagccacagttgcacaacagaatggatgaagcttagaagtaatgttgggtttaaatggccagtcccaggctgttacatttaccatttgcaataacaataggaactaaggtaactgaagaatctaacaaaaactatgcaagacctgtatagaaaaattataaaacttgattgaaagacatttaaaaaatctaaataagagagataatacataatctactctttgtggattgggagattcagtattataaagttgtcgattctccccaaattgttctacagatttaatgcaaatccagtaaaaaattcaacaagaggctgggcgcggtggctcaagcctgtaatcccagcactttgggaggctgaggcaggcagatcacaaggtcaggagatcgagaccatcctggctaacatggtgaaatcccgtctctactaaaaaaaaaaaaaaaaaaaaaaatgagccaggcgtggtggcgggtgcctgtagtcccagctactcaggaggctgaggcagggaatggtgtcaacccaggaggcagagcttgcagtgagccgagatcgagacactgcactccagcctgggcgacagagcgagactctgtctcaaaaaaaaaaaaaaattcagcaaggggtgtgtgtgtgtgcctgtgtgtgtgtgtgtgtgtgtgtgtatgcaagccatagacagaatactttttttttctttttgagacagagtctcactctgtcgcccaggctggagtgcagtggctcgatcttggctcactgcaacctccgcctcccaggttcaagtgattctcctgtccctgcctcctgtgtagctgggattacaggtgtgcaccaccacatctggctaatttttgtatttttagtagacacagggtctcaccatgttggccaggctagtctccaactcctggccgcaagtaatctgcccacttcagcctcccaaagtgttgggattataggcgtgagccaccgagcccagctagtacacagaataccattttttacttaagtatattaatctagaagagttttttttaaaatacagtataccatttttatctataacacttaaagacaatcaaagccaaattatgctgtttcaagataccatatacttagaaaaacatctataaaaagcaagagaaacatacaaatcaggcccatctggagagaagggagtgaagcattgcgctgatacggggataaatatgctggttgggtagacaggcagtccttatgcttttggctgacgtagatgttacgtactatttcatgtgttatcacactctccagtaaacacgtaacataagagaataattaaccactatcaagcgttctcatcttgagacaggaagatgtagaggaaagaccttgatgtgtgtgtcagttacaaggatgtacaccagtgactgacatgacttggtgcaaatcttgggtagagacctatacttaagctcctcacccccacctgccgaggcgtaagggctcagagggggttccatggggtgggcgggagtggtaagggtcgaggtgcagccacagcctggctctgtgcacaccccctccctccccctggtcccatgtgcacaccctctccctgccccctgccccttgtgcacaccctctgtaccccccttcccgccccagcctgtgtttgcagtgctacagggtggctgcagcctttgcctcccacagctcctcaaggtcagagggctgggaacccctgggatgtggctgggatgaggaccctgcccctcctcaggcatttccaggcaaggggcacagagacacagccagcccagcagctgagcccctcctatcaggccaggtgggaaactgaagcatgaacacaaccccagactggaaataaaaagccgtcatgtactgtgtgcctactgaatgccaagccctatgccctattctttaatgtcatctttaatgagatgtcttcactcagttcaccacatgatagtagacaggtatttatgatgcgcctactgcatgctgggcacttttctgggccatgaggactcagggaggtccctgctctggtagaagtcaaacccgacaggagacagagactaggggcccacacaccaggaggaagaacccagtgcagagagtgccagcaggaagccacaggggcagggaaggcgctcctgggagggtgggtggctgcgtcctgaggctgagcagggggagctggcctcgggacaggatgtgcgcaggcgtggagcaggaagttcctggaatgatgggcaagagggagcaggtcactgggggcaggtctaaatactgggggctgcattgggatagcagaggcctcggacaggcccgctcagcatgtagactcccctccctggccccttccctaggatgacagtggaggtccatccccaggtggtggtgagggcaatcctgacacagagaccccagcccagctggcaggggaaggggagcccccaaggacccctgtatgttggggcgtgtcccgccaggcggccctccatggtgcccagcagcagccctgcttgcggaccctctttagtccccactgttaaaaaaataattcagtgaaaattgacactagctgggcatggtggtaggtgcctataatcccagctactcgggaggctgagacgggagaatcgcttgaaccagggagtcgggaggttgcagtgagccgagatggcgccactgcactccagcctgggtgacagagtgagactccgtctcaaaaaaaaaaaaaagaaaaaaggaaaaatgacacttgccaaagcgctgtagggaagactgtccaggaccgtgtcactaggcataagggaccacggtgatgagattctgcagtgggtaagagactgggctcagcctcgaatacagcatgggcaagtgggatcggaccgtcaaggagcagggggaagactatccaggaccgtgtcactaggcataagggaccacggcgatgagattctgcagtgggtaagagactgggctcagcctcgaagacagcatgggcaagtgcgatcggacagtcaaggagcagggtggggggcagcgcatggaaagtgactaagaggaagcatcagcagccagggattctggcttaactcccctaacagaattcttgctgaaggccggccaggatggccagaccgcacctgggggacagagggggaacccgatcagatgtcaaggacggggggcttctcgctaaactgactttgcaggattcttgctaaaactagagtttataaggaagtgctcagatgtgcctaggagaaggctcaggagcctaaataaagcttgaccaagcagagaatctttgtcaccagctgtggtgagagtgaggcccagagtgggtcagggcttacctgctcaggttgtgcaattgggaggggtccatcaggagcccggagtcttcccactgggggctgagtctgggccctcagggcacatataggtagatgctgtcagacccgacaccccatgcagtgcagactgggatgctggtgcctgtggcacagactggtcagacccaccccaggctagacattccttgcagggagagctgaggctgctgacaccaggaacagacaaacaaggtcatcaccaggtaatgagcttgttacccacatcaggcaaggccattgctgggtaatgagttggcctcctgcagagccacctgcgctgggatggttcccagagatctggctagccagtgccacaggaggccggggcacagttccagggcctagtgggcaaggcaggggtattcagggacaaggtgcacctgagtccccacaggaagccccagaccctgcagtaagacctggaacaagtcattctcctctctaagctctcaaagaagaggtcagctcaggggtctgggaggcaaggtctcctagagtagactaagctggccgctgccatgctaacacacaccctcccagccagccgctggtcctgacagatgaggaaactgaggctaggtgttttcatgaggcctctgaacccagaacccagtacccagtgtcctgagcaaagcccaagccagacctgccagcttatgtgtacagaggccccactatgcagcctgcactcctggggcctaaaaggaccatcacctccccttctaagaggctgggcacaggggctgggtcccagccaggccacccttcctcctcctccaaaggcccagcagcagctgctcccagagcaagcagcacagtcgcagcaaaggctggacaagtgtcctgtgctctgtggtctgagcagagggccaggggccgtgacccacatggcccctccaggagcagctccaagatgagccttcctgtccccaccagtgtgtccgggacctcagggtggatcagccgcacctgccggctgctcctgttccttgctcttcctggggctccccaccacctttgggaggcagctccaagaccctgctgcctcccttgcttaccctcaggcccctgctgggtgtgccccctccccacacagacccctgagccagcttcgaggactctgcctgcatctccacgtccactctgatgactgtgaagctacagtcacactctccgcctccacccccgccctgccgggtccctgcagcagctctcagaggcccccacagcccctcccacacacagagctcgcctggccctgccgtctgagcgctcccctggctcccaaccgcccttgggctctgggacataaaacctccagccaaggtggctgccaagttttatttaatagccatagagcacaaaagggatgacaattaagtcacacggagagactgccccatcgggacccctggccaagctaagcagaggagccctggggtttcctctgaccccccactgtgaatgcattactgacgggcaaggtggccagttgcccacccagcctgcacgtctgcatgcacagagctacagcctgggcccagggacagccccgggagccggtggcttcccacaggcacagccagcctccccacccccaccatgcctggcccccggcccagggcacactgaggggaacaggaggggaaggagcaggccctgcactggagcctcagtcagctcctctgtgccaggggcagctggagctggctgaatttgaggaacttcccggaggaactggagagcagacctgtgtgcgcgccccgctctgccacgttccctgagggacacactgctttgaccagcccccaccccatctcctctccgccagtccccggtgtccaccccagccccgctaccgatgaagctcaagccagggtccccatcacctgcttcacggccatccctgcacttgagctcaggggctcagggttgtgctgacacgcctgcctgtccacccctcaccgacacctctgcagtcctcctcagggcccaacaggacccccaggaccccgctcccattctgcccttgctcctgccaacctgtcttctctatgcccatgactttggaaccctctgccacaagtgccagcccccacatctgtagcccctgcaggaacaagccctaatctggactcattgcaatggctcagcttctcttccaacctgtccataaacctccaggcagagatcacaaaactaacagctctttctgcaaatctggactctctcctgcaccttcttcaccgtccaggcctccctgtcatccgtcctggggacctcagagatctcttcatttcacaggtgaagacttggctcagagagggcagagcccctgggtcacacagcccgtctccagtagggctggggaaaagaacccagggcgctcttgttggcagtgttttaatgactggggggagggagagaatggctaatgaggctctagggatcagcacagccagctgctggaggtcccagaggacgggtgactcagcaggaatgggggagtctgaggggttgacagagtgcccaattctcacctcctcctgcaccttccagagagacgggctgcagggagtgattgagtggatgaacatgactagagggacccagtcttctcctcagcagctgcttgaggacagtattagcggtcccctcaatcccccccccaacacatgcacacatgcactgacctgcaggggccagatcccggtggacccggggacacagcttccaggggctgtcttgccatgtcccttcccagatctgcctggattcatgccaggccaccctccacaatttgctgagggaggccccagagtccagggcacccagagtgctaactagcccctgggggtacagggagaacagcatgctgtgtgggggatactactctctgcccatacctagggccctgtggcggccacaggcagcactgcttatgcagaggcactggggtgagaaggagtagggtgcagtagtgagggctccacagagggtggaagggctgcaggggaaggcagaccagcagggatgccatgagggcctcagatgccaggctgcagaggtggacgggctggccagctcctctccccagcctcctactgtaaaatgggagaggatcccagccctgctgattcatccactcactccatggcaagacagccactgacagctctgtcctggggcccacccgggcctggcctctgtgcaggctagcactcagtatgcttagtgccacactcggcccaggagaaatgacccagccctgggctcagagaccccacagtgggtggatggaaaacagtcatttaaatacaactgtgaagggtgctgtggaggaggggctcgaggtccccagtgtgggatggggtggtcatggaacgtttccctatctaagtgggaaaagtgagagccaccaggaaaatggcgggggtggggggggagaggaattatgcaaagacccagaaggatgaagaagactgttggattagaggaggttaaagacacagacaggcttggacatggtggctcatgcctgtaatcccagcactttgggaggccaagacaggaggatcacttgaggccaggagttcaagaccaacctgggaaacacagtgagaccctatctctacaaaaaaaaaaaaaattaaaaaaaattagccgggcatggtggtgcacagttgtagtcccatctactcaggagactgaggtgggaggatcgcttgagcccaggaggtggaggctgcagtgagctatgattgcaccactgcactccagcctgggcaacacagcaagatcctgtttgtaaaaacaaaacaaaacaaaacaaaaaacccagcttgagatggccagggatttccagaggccctaggcagaccgccttggagagtaagggagaccctgaagagctcccatggaagggccagcagcctggggctggagatgccacctggatggattcctccagctgtgtggactaggggacagggtgaggagataatggcctggactacatggaaggacgtcgccctgagccattgaaaagggctgtggggtccatgaccactcctggctttcccttgactatgatggagacagtagcttccagtgtaaaatgtgagctcagttcctgactcgtgtctagcgggtggtgcctggtctttggctggcgatgctccatgtcacctatgcccagaaactgggccatgccctttgtgaggacctgcccacaacgtcgtcgttcccgcagggtcccctgggaaccgggctgcccgagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagccccgcgccgtcccccgcgccgcgccccgcggcccgaccctgccgcggacgctcggcaccgtgagcgccctggtcgccgcctccaggcccgcagacgacgccccggacggcccagcagaatgcggagcgcaccgagccccggccaggaagaaccacaagaagatgccagtgccgcctggggccccgcaaggtggcggggactgagggcggccgcacaagggcagcctaggcgaggtgcggaaggcgtcgcgctggctactctggtacccccaggacggggcaagtgagcagatcggtccccctcgtggagcgtggctctgagtcaaaagggtgcccgggtgccgccagttagggctccggtactggaaggagggggtgggccacgtgcgtctagggagtgcagctggcagccggggtccttgccagagactgagtccggctagagaacagggtggagcccctttggaccttagagctgggcctttgggccttgggtctgggtgggcctttgggccttgggtctgggtcagcctttgggccagggctgggtcagcctccagggaacagccgagactcctcttccttggggtgactgcaggttctttttcttgcaaggtctcagtgaggaggcagggtctccacgcactggaatagtgtcaaaccacacacaagagcacagaacccagggacacagggcggctgagacactcagctggtgatggtcctcaggatggtgtcaaccagtatgtaatcacattccacagggcaccaactggacagaggcctccggtcagcctcactctgactgcaaccccctctcactggacagcatcacctggacacagagcctcacctagtctgtgtcccatggacacaactttgctttggacagtgacaccaagaatactcacccctttacttagccagaccacaggcagccacctggacacaaacatctctccagagtcagcctccacacagactccacagcagaactcccagggaggcactggggcatggcttcagagcaccaggcagcgctccgcggtgcctagcacccgctcagccagggcagcctgcagcggagcttggagccagcagcttctcatctcttggcctcgggaaatgtagctggagtcatcatttagcagagcacggtgtccctgggttggccacccagcttagttttaaaataaaataatgtaatcttggcctaatggtggaatttctgactgctagatgttctccttccatctgaccaggggattcagacacaatgtataggatgagggtgggggcccttctccctctgagaggaacctggagaggcccgggttctgctgaggtaggagagggtcactcagagggctcccacggaacagacaggcacactgaggcctcagtgggattagggcaggaaatgcccctcttgcaatgggggaccacgccgggtcacgcacccaccccctccaggctacattaggctaaggtcactctgtgcattatttcattatttcacatggagggtcgcccacggttgacagaaccacaggctgagccccaggcccatcagagcgcagtgcacaactgctagggtgggggaagagcagggggctgctgcggggaccgaggctctcggagaggccaagactgcgtgccccttaagaggctgctgtgggccgggcacggtggctcaagcctgtaatcccagcactttgggagtccgaggcaggcggatcaggaggtcaggagatcgagaccatcctggccaacacggtgaaaccccgtctctactaaaaatacaaaaaattagccgggcctggtggcgggcacctgtagtcccagctattcaggaggctgcggcaggagaatggcatgaacctgggaggcagagcttgcagtgagctgagattccaccactgcactccagcctgggcgacagagtgagcctccgtctcaaaaaaaaaaaaaaaaaaaagaggctgctgggggcggaagttacccgtgagcggtatggggtgaaagtgggagggtccagcctggggcagggtgtagaacagggtcatctgagggtgcagggcaaagagatcaaaacggggtgggagaggggcagcgcctgcgggaggagccaggcaaggcccggggaggggtgtggggggcgaggggggacggtggctccacctgcacccaccggatgggtatggggtcctcgaagacggtccagagcaccgtgggctcgcagtcaggcggggtcagcgacccagcgaagcgacagtagctcgaggtgttgggccgcatcgacgccagcgggaaggtggacatcagattcactgagagccccgggcggcagagggagggggattggaaccagcctccctgtgccctgctggtgccatccccagcaaaccccccgcccctgagccggaaaacgacccggtggctcctcacctggctcaggcaccttcctcaagcccgacactatggcgcagaagttggtgttgctacagtcctgctcctgggaggggctccaagtgcgaggggttctgagtgagggagtctctgaagagggaactcagctggggtactctaagcaggaggctcccagtggcaggaggcatctggcatctgggaaatggggtggagggttctcgccgccactggccctgccgattcaggcattcccaccgccccatcctcccacagatcctatagaccctagagatccccccacggactccacaggcctggcctgtccacttccaggatccccatggaccccttttttggaaacatacatagaatcacagccctgccttcaccgccagcagcacctccagcagcagggcctgcactcgagcccatcaccgtggcgtggtgcctcctccatgctctggtactttgtgttactgtggaccacgtgcatctggggggaggcacagatgtgggagatacccagctgccctcaccttgctctctctcacctccgtgggagcactccggccaccccaccttgttcccgagtctacctccatagcctggcgctgcctgtccaggctgtgctccgagtctgctcgcctcgggcccccccaccgccggcagttgaagtgcagctgcagtgcgcggtagacaggcaacagcagcccagcctcccaaatctccaggtggttctgaggatcagtgtccattcagagtagcaatgaaggggaggaggcacacgacaccctctctacctcaccacctgtccatcttgtgccattagggcacagggtatgagcagaggcccttcctcaggccaggtttctccccagtgcggccccattgcctccatggaatggaacccatggtgtccatggctcctgctggtcagcagagcagagctccacagactgcaggggaaacccttcccccccccacacccagcatggcatggaagagggcagagggcagccctcctggtgtggggctctaagcccagctgtgtgtggtcagggatcctggccctgccagagaccctgactcctggtcctcaggggccatggctggttgtgatttgtaaggtgggacctggcacctacacagagggtgcatctggactgctgtgtgaggatgctcctttcctctgaagctagcccctgtggagggtttttggccctgtaggttgtctcagctcccgtgtgtagggggtcctggtccctgtgtacacgcaggagctctcatgccctgtgtggggctcctgcctctgcctaggaggggtcctgaccacagggtgctgacttgtgtggctgtcattctccagggtccaagggcctggaggtgctgagtcatagcctcggaagatgaagggccctagggtagagttccgccggaccctgtgaaagtcaatgttgatgagggactggcctgggcccccacaggcagggggccagcttcttccagtgggtggggactgctggaacaaggactggggcctttggggtggggggggggtcagggaggcagcctgggggtgcagcagagagtggcccccatacacccagaggatagcccagcctcaggaaacctagctccctgcttcccccacacctgaacaggtcacagcaccccccttctcttgtaccctgcatctgacctatccatctagtctcccagttggctgccccatggtgagatgaaggtggaagggtctccggcacacagttgcacacccacactgggacctctatcacctgcacacacttgggctggccacagtaacgggcacaccagccttgactgactcgggaccggcaatcacagcaggcccagactcacacacagggggacagtcacgcacttgcacctgatgcccagtcagtctactggggcagacgactacagacagaaacctgcaaaggccacagagtgcagggtgcagactgtctcttggccactcttgcaccactggcacatgctctggtggtcccaggacacagactgatctgacacagcctcacatgacactctgtcctcaccatacttgaggtcctgggagtcatagcaccaggcacctatagagacagtgggcaggaggctgagctgagaggccagtcatctgggccctctccaagccccatcccatcagctggggtccaagaatgaagtaggtcaggggtttaggccaggggaggccagtgaagaaccttctctcctgtcacccctacctcagtattttctctccccagtccctccccactcccagtggcaagacctaaggggtggtggagcatggcaagagggtagattggaggccagacaggaagagtcctggtgctcactctcagagtctgcgccacaccagctgcaccgcaaggcgagcatgatgccaggggcgtgcgtggctcagtggcagccgcagctaggaaggactagaaagtggctagaccacgcagccaggatgctggcctggctactacatatttattcattagctagctgggctaggggcgtggctactgaggagaggatgggaggggtcggtgcccaggcagggccaccaggaagagcgcgagcgctccaaactcacccaggtgtgctctggtcccagggctgcactgatgccagcaacaatcgctgaggttaatcctgcaggggaggggtgacctattattatccccacttacagtccaggaaacagaggctggggaccagaatgacacaccaaagccaccagcaagaaaggtcaaatagtgagggcaccttggaccccagtgcccatgactttcggggcaaggatgggaggaaggtgtaggatgtctcttgccccactgtgggcccggaactgccaccccatcccaagaccacagcctccctcctacccaggcccccctgcggatccaggccaagacggagccctgcaggaggtcagaggaggggacttctttgcaccctgcgcctctttccaatcgccagagggcagggccctacccacattggggatgggaagacagcccctacccagaggcagggctcggggctctgtccagagtgctgacagtgacctgtgtgctcgggactcaacaccaccactccactcctgccccagcagatgggataaaaaatgaggggccacatcctcgaggctcccatccctgccaagggacttaccagttcctttcctaaccctgactcctctcgtgtccggccgcaggacgtccccccagtatacacatctggagtgcccccagagcagggcatgcaatcacacttcctgggcccactaccctctgagacctagagatggcactgctggacatgagtgaagaggccccagaggacctaggctactttgtaacattaggtggcttggactggagggaggggctgtttccagccacccggatgatgaggggagcttagaggaaatggcgctgacggccaggttccaagccctgccctaccaccccgtcccatgctagctcccagatggtgtcaagcagccttgcctttatgtggatcctgtgcacgtcagcaacacctgccaaggcagcagccgatgccccaagcagggctgggtgctgcaggatagctgtaggcagctcagggctgctgctctccctgcacactccacctaggggctccaggctcagctctgcctggtcctcagggggtttgatggacgcctgcaagggctgcaaaccctaggtgcattctgctgaaaggtgggtacccagcctcttccaccttagcctgtggcagccgtgggggccacaccaaggactaaccatgcctcttccggaacacaagtttatttggcatttggatgaaatgattctcacagcatcttaagaaaagttagtgtcaacccaaccaaaaactaaaaacccttaatgaaaacataaaaaaacaggcatcaagacaatgtacagtatcaaatcccacctccgcatggcaggtcagagggcacctgggctctgagaaaccgtggcaagctggtcctagaggaggaggacccctggagcacaaggttcagcaagggtgaccccgggacttgctggtcagactggggactgcagcaggccttgcaaagggggcattctggatggtggtgcaagaacagatgagcgagtccagctctcctcatgctcccaagggcctcctggagccacagtggcagcggtgttccaggcagccctgccatgtggaccttctgcctggcccaacgtgccagtggcctgagtgcttgtggaggcccatggggaaggggccacccagcaaccccggccagcccaaggcccaccctctgcagcctgcatggtccactttaccccgtttcctcactgccccctacgtgtctgaccggcccctaatgttcctctggtccccaaaggaagcgtcccagtcccacacatctcgtgccagccaccctgtcccgcacacacagttctgaggcctggcaggaatcctctgagctctcaggctcaggcccgtgggggactctgctgcgtggtcctcgggccctcactggccacctggcacccataatgcacatgcctgctgctctggaacctggctgccctgccccagtgcatgtgggatccacggcatgcttcctgcttcgtcctctgcagccagtaggggactcctgtggccaggacttccttgttaagtagcagcccttctccaaggggagcacaagcctgcccgcacacagcctccagcatcatgctccagcaggccaagctcagggacaggcaattcagtaacaaaactcacagctctggacagttctggcacaaaggtcaagtctgtctgtgggcaactcaagattctcattccacatgggatggaaaaaatgggtctccagccacagtgtgagaatgtgtcaagaagtggactgtgcatggagtccatccccgagcagcaccacagaactgcatgcttcagacaggcctcccaggtgctgccccgctggtctggaaagactgagcgagacagcactgcctcagcacagcccaggatgcatcgatgaccctggaagagtgggcccccagtgacccgtgaagttccatgtgccaccctcacctgcagacgcttggccacatacacacacagagacacaaacatacaaaggaaagatccagacattcaacgtagaaaagatatggatgtgctaaaaatcgcacagaacccgcttaatctccaaacctcagaaatgttaaaggccctgtgtcaggcaacaaaaccactgcccaggagcaggcaacagggtccgtcaggcaaaagggtgccaggaagggcccccagcccctgcgctgctgaggaggggccgggaggtgtgcatgcggccgctgggcactgagctgcagtagtggcggtgatgtaaggagtggactttaaggagatagatgcagcccaggatggtggtttcagccacccctcctgcaatgaagcaaccctttatggcacaaatggggccgggggcaggcccaggggcaattcaacaggaggcaagagcccagggctccagagtggagagacaggaggcagctcagtccccagaccccagcagagcatctggggcctcggccccactccagagcttcttcctgagggagccatgcacagcaatgctgggagagggactgatggggtggggtcaggcctcctgccacagagctgggctgcagagcccagatggaaagacacagtgaagagctcaacctccttccaagctctccttctcagggcttcaggttccagagccccaggggagctcccagccaggggcagggtcaccttgatattcacaactgggcttgtgggggccatcttcagtgcaaccgttgtgacaaagtcaagaggctgcctccctgaagcagacccactgcctacgccacactgacggtccagaggccccctcctgagggcggccagcaaggggcactgtggcagctcccactgtgcctgtcccagactgggtcagcaggtctctctggacagcacactgcaccaagtaagcccaccaaaaacgcatcaggtgtggccatggcccacagtaccttcttcattccctgcctctaacatgtgcggtctgaatgaattttgtcactcttctgccatttataaaggagaagacagtgatccaaagctatgcatgtttctgaagccctcaaggaagctcggtgcaggccatcacttcttttggcagaaggcgggctgtggtctctatgtacacacgcgagcccgccagtgacgtgcggcagtgcgtggcgtccaggctgggacaggggcctttcaagtctccccagggaccggtgttttctacaacagacaggtgctcccagaccgttggggtacaggccaggccgtctacaccacagtattgagggagctgcggctgtggcggccaccccctggcagtgcctctgcagctggggtgctcccgctctgggcagggtcagggggcacgagcagggcgctgctgctgtcggcagagtcttccaggtctgccagagaggcccccgcagtgggcagaggctgctccaggcgccggagtaatgcaccttcactcccaccatccccaggggctggcaggctgacctccacaggctcaaaagcatcatcgtctgcaggaagagacagaggggtgtcagaggcaggtacgggcctggcacaggggatgcaggggagctaggcaaaaccaggagacactcctcctgcctgaaggcccccctgaagctgggtggtgagcaggacctgggtggctcccccgggcctcagattttgaaggaggagcctgccccacatgacacctgttgtacctactgccccctgtggctgggaacctggtatatgcaaggtgcagggcccatctcacaaaggcagacacgggcctgtcccaccatcggtgtgaggtaggggagacacactgaccagcagtcactagaacagaggggcccaaagggaaaccgtctcagactcagtaaggtgaagacccggctcagcaagaaggcaggggcatttgtcatcagggaggcactgggcccaggtgggtggaagaacattcagggctgcagctggaatgtggcaaccggagtgtgggcaacagggctgcagtgagcggcctggaaaaccacacaggtgtttgcaggaagctctgatccaaggcaggctgtgtggtaggcagtcgactcgctttgttttgcccgatctttattacttgctttttttttcttttaagagacaggatcttaaaagattgcacactggtgtgcagtgacgtgaccatggctcatgacagccttgaattctgggctcaggtgatcctccattctcagcctgcccagtaactgggactacagctgtgcccactatgcacggctagttctgaattttttgtggagaaggaggtctcacaggctggtctcgaaccaacctgggcaacatagtgagacccctcctcccgcctcagcctcccagagtgctggattacaggtgtgagccactgcgcctgggctgcctgcttgtcattaccataggctgtctctgaaagctaacagcacaaggccccggtgatgcacctccctcccggccagcccctcacagcccccaccctgctctgcagcctggcccacacaggtgtctgggatctgctgccacccaccaccatcccttgcaggaagctggtcctaccctggaagactgtgacaatctgtgtcatgagggcaggggtcaaatgcaagtcttttctgcacccccagatcatgcaagagctgtggcagctgactaaacaaacgaacaggactgagacctttaggcacagcagccccagcctcacaatgcccattctgccgagatgggcaggcatgcaaggagccagccactttggggtggcactgcctaccaaatatactacaggtttgtgtgtgttagggggcctaatgcacagggagatgggatgggacacctgcactgctcaacagagacagagacaggccaggggtcaggggcctgccactccttagctacacagccttgaggaatggcgcccactctcagatgggtggtaggctccaactatgggccagtagcacagaagccacgctttcctcccacctcacagagctgcctcctgacacgacaggaggggctgtcaccatggtgtctctagctcatgtgtctacagacaagtgattggctcctgggtctgggccagccctgtcttcacaaccaccactgtcgggctccccaggtctctagagctgggctgagggccctgagggctgcccagatgacaggtgctcacagaaggcagggaggtaggagggaggggtcccaggccttctcagagctctctgcacagattgccaagggcggccaggcagggagatcaggaccccttctgcacgggcagccccaggagaagccttaaaggaaaaaccaaagacaaagccggaaagaagtgaggtccctaggcctctgcagctgggcaagagtgctgggctcagccccacgtgccaggttacttgacaaggtgttccctctccctggggagtcaggcacctgcagggtcatagaacacactgtccgggtggatggaggcctcgtagggcggcggagggtcgtcgggctggccgatgtccgggtacttgtatgccgtgtagggaggtggagggtcgtggaaatggaaagtcccaccctctccgtcgtcagaaagatgcagcggcgtgaggcccgtgccaaacccgtctgggccgtaatcaaagccagggatcctgcggccgaggttgaagtggtgcactgggccatcaaaagtgtgcaacgggaacagagacaagtcactgggggcaggctgcctggctcctgagccccccacccccaggctgggcctgccgtccctgagtgcacacacctgtgccccgctgcctacccctcggccacattcggcatccccatgagacccctggtgtgctccgtggcatgtctcaccctcaccacaccaacctgtccctctgggctgacacttctgtcagacccagcctctggctgaccacacccctccagctggaagggtgatccgggcctctgaccctcagaggcctccgagttctgcccaccctgtggctcaatgggaataaggagggtcttggcaagaactttcctggcccacaggtgaggacacagaccccacaacatgtggccttcaaacctgcctctgcccctctctgtccagggctggggagctcatggagacatggggtgacctggggtggggatggggaccagggttgtggccctcagagggcacttacagtttgctccaatcagggactcgatgcgctcccggcgccgctggcgcagccggtggaccatgaagagcagcagtgacaggatgaggaaggaggagatgcagctgacgaccaggcgcatcccgctggccatggagtcaaacagactgttgccatctgagggggaggggaggaaatggccgctctgagaagggggccaccctcgtgctacgctggggatgctgtcgtcctcctgcccaggcgggctgtgtggacaaggcacacagtgtctccctgcacccaaccatctttaggatacatgtgaaataaggccgctcaaaatcaagaacatggtgacagcacagaagcagaagagcgaatcccaggtcaggaggagcatctcaccatggccccaggctgctgtgtgccaacacccctctgaccatcaccggagcaaactaggatttcctgtcctaggactagcactcctaggaggctgcgctcatgtgctgtgtaccccaggtgtggctggggagcggccctcctgcagaggtgcacatccttttccaggggccagggctgcacacaggcctcccacgtccgtccaacagcagccttccttttgtctgaggcctgggctcttgggaggaaggtgctcagttgcccagcaagaatgagccagggggcggtgagggacagccctttcctggtaggaggccagggttggccaggtaggcaggggtctcatggatgacagttgctggcagtttggagtgggggtgacgcccctgcggagcatggctcgggcggctgccgtagggaggacaggctgcaagggagtagcatagggcatcaggaagccaggaggaggacctgccgcagcagagaagggaatgacagaggcctggaccgggtagtgacagactgggagaagtgacagtataaggtacacttgggactcggattgccacaactccctgatggactgtgtaggggaacagtgagcccctgtgggcagccgcacggtcaactcaggtatcatttcacaaatgtgcctctgctgtggttgggcgtgaagcctgtcactccaatccttaacaagccatggcagagaaaatgcgcatcccctgacgcacccagccctggcatacacgtgcagatgacacctggacacaacactgggtctcacaggctccccactgagatgctctcccggctcagccacacccacacattgggtacacacgcaccaagcgcaggtgtaggagggctgggtggacccgactccacctctttgctgggtgagtaggcaggaggggccatgaagcttgaagctgagtcccagccaggctagacgccaaggagcactgagtctaagctgctgcgccttcctctgctcttcttcaaccatttcacgcttttcgtgaccaccacttggctgggatgctactagtattcagcaggtggaggccggggtgctgttcaacatcctccaggacagcccccaacacacagtatctggtccaaatgtcaacaccgccaagagggacacaccctgccctggtgcagtgcacactggggacaggggctcgatatgagctgcccatggggaggcagagatgacatgagtggtagcaggcatgaaaggagaatctaccagccacacatctataacatggctggcagttccatgcactcctgacttgggtaaactggcaactcacagaagtcacagaataatggaaccaggaagtggtcccagaagtagcttcctccacagaccaagagtgaaggccagggaggcttcaaaacgaggagtgacccatcagctcctggaagcaggaggaccccacaccagcagggaccctgctaagctaggaatggccactcccacctctgcaacaatctcggcaggcaggacccctactgcctgccccaaggagacacttcacaacccccgtgtgagtggctgggttcccagagccctcaagccattcctgctagcccagtacactccatgcccacacagatggcagcgccagctcctgtcctcctcccacggggccaggaagcatctccaaaagctgcattttttgctgacgacacatgaagtgaatatgtgagaaggatacatcctctcaccaattagctgcttttcctgatgcctctgaccctcctccagtctcaagggcactgtcatcagtgggagaaagcctagtggcccagggactggtgacgtgcctgttcattggaggccagttcagagatcccaggggagctcctaagaaagcagcccctttgcaatgactaactcttaatccgttctaaaataaacccaaggacacggtcaaggtcccaactgtccctccaaggtggggaccggaaataatcatctctcagaaccaagccacttgtagtcaagcacaaagaagagagcctgccccagaagccagaggccagcccaggggccccagaggccccttgatagggctgatctctccatggagttctgggctgtgcagttggggttgtcttttgtctctcagctatcctgcagctcccagagagaggatccagcctgtgcaagaagagctccagtgacaaggagctcaccatttcattgagcttggttaagtggtaacagtttcaaaatctccatcagagacaccatggggagcagaaggtcagcagggatcagaagctgagaccaggaacccaatgtgggctctgtgcctggcagctgcaccagccaaacacctcaccatgcctctgggaacctcatcgtatcagggctgcccgacagcagcagagcaagcaggggcagagggcggcatgagtttcagctgctctgcaccttggccagcacttgatgctatcagtttcattactttagcctttcgagcaggggtggtaccccacgtggatttagtttgtttccctaatggccaatactgagcatcgtttcagctgcctgactgtcatcctatatcttctttgataaagtttaataatttacatcttcttctaaagccatttttcaatagcattgttttgttttcttattattgagtttttatgtattctgaatacagacctttgatctgtgttttgcaaatacttgttttgattcagtcaggggcttattttttcatttccttaacagtgtgttccaaagaacagaagttttcaattttgatgaagccaaatttgtctgttttttttaaggatcatgctaaaaatgttgcctaacccatggtcacaaagatttctctcctatgttttctcctagaagctttataattcaaggttttacagttgtgtctatgaccattttgagtaaattttacatacagtaggagggacagtgtaaggttcgtattttttggcatatggatgtcctgctgtcccagcaccagtggttgaaagactatcctttctccactgaactgctcttgcacctttgtcaaagattaggctggtctgaaggtagtgagtcatctcgattgattgttcacagtcagtaacagatcaaactccttgttgtactcttttcccgttctcacgactgcacttgactcgtcttaaacaaacaaaaacagagagatcacctgattatacgtagtgtgggactatttctggactgttgtgttccactgatctatgtgtctgccccttcatcgataccacactgttgtgattactatggctgtacagtaactcatacattaggtggcatggatcctccaactttgttctttgtaaaaactactttggctattttaattattttgcctttccaccaacttttatctacctttttatttaagagacagggtcttgctatgttagccaggttggtcttgaactcctggcctcaagcaatcctcttgcctcagactcccaaagtactacaattacaggcatgagccgctgaacccagccctattttatttttactttttgagatggagtctcgctctgtcacccaggctggagtacagtggcgtgatctcagctcactgtaacctttacctcccaggttgaagtgattctcctgcctcagcctcctgagtagctggtattataggcataagccaccatacccaactaattttttgtattttttgtagagatggggcttcaccatgttggccatactggtcacaaactcctgatctcaagtgatccaccctccccagcctcccaaagtgctgggattacaggtgcgagacaccatgcctcgctccacctgatttttagaattagcttgtcaatacctacaaaaatgtctgctagaattttggttgggattatactgaatctataatttgggaagagctaacctcctaatgatattgagacacctgatccatgaacatggtatctttccttttatttaagcctttttgtcatcatggttttacagtttgcagcaaacagaatgtgcacatattttatattatttataattgggtatttcattttttttggtgctattattaatggcacttttctcaaaattttcaattttcaactgttacagatagattatataaatatgatgaatttttgttacgttgaccttatatctggagaccttgcttaaacacacttattagttctaataactttcctgtagattccctaggattttctatgcaatcatgtgatctgcaaagggagatggtttcatttcttcccctctggcctggatggtttttcatttcttcttgccttctggcactggctttgacctcaagcacaatgatgacagggtggcaagagtagacactcttagcttgttggaggggacattctgatgcttaacacatgacatcctattcccagagtctccagttttggtgatagtgtctcggttcttgagcactttccagaagaaggccctaggagagtcaggagcccatggaagcatggccacagggcaggcagagcagggcccagctaagtcgctctggccgtgcaggagagagggctgcagctgctctgggcccacccagatgcactaagggccctgctctgctaagaagtccttggggctgggcaggctctttaggccatacatgcccacaaatgggtcatccttgtacacatctgggcattcttacaaagcttggacagagtggcaaggcagcactggtagactcctgagaaatggaaccaggagtccaggtagcatggcttgtgaacagagtttgactcttgtagccagtcactaagctgggggtttaaagttatgtggccgggcacagggaacttgataagcactcaaccagtgcttctcatggccctaaacagacatgcaccctatacgaggagaaactgccctgcagaatggggtccaagcatcaccctctagctctgggtcctctggtgggcttggctgcaaatgtagccttgtgctcaccacagtcaactgcacatgtctgatggtacatgccacagtgcccactttcacccagcctcaggcacagcctctggaggacagctttgtcctcccacccagcagccccccagtgtggagggacactgacaacattccactcaggggcagctttcactgttgtggcccagcctctagctgcagcctctcctccacagggcccctagagacagagatggccatcacaccctgcccaagctgctcttctacaggggccacaagtccaggggcttccaaaagtccccatcatttcattcctactgtggcacccaagaaagaaagaaactcatacttttgatttacatttctcttgagatctgaattcacacagagctgcagctacaccggtgtgcagaatgacaaagcatgcccgtggagtgtgaggggtgttaacatctcagagagcagtggcccacctgctcctctctttttgcaagtggaagggagaggatcaccctgagatcagattccctgtagtgtctaccttaaagcccccgcctggtggtgaggagtctgatctcgaaactgagaataatacttcatctttttctcgaagattctaaggtaaaaatggatgactgtaagcaatgacaactgtcactaccctccatatcatcatactagagaacaggaagagctccaatgtggacataaattagaagtctaggctggacgcggtggctcatgcctgtaatcccagcactttgggaagctgaggtgggtggatcactcgaggccaggagttgaagacctggtctggacaacatggcgaaaccccgtctctactaaaaatacaaaaactagccaggcatggtggcatgcgcctgtagttccagctactggtgaggctgaggcaggagaacggcttaaaccctggaggcgtaagtttgaagacaagtttgaagctgtcagtggtgacttgtgaacaaacagccacacttgagttcaagttcatttgtgaatgctgcctgtcaccccagaatgggaaggaggcagctggaggggtcgtgtcagacacgcccactagagtagtggcatcaaagtctctgagacatctctgtgacaaacgctgccattgctgctgcgcgatgctccataaactctcctgagtcctcaccactgaggaagcaaagggacgcccagcctccagccccaaatagggaggctgacttgggacgtcctatcaagagtctcacctgggtccagacacatgaacttgcagcactctttggggtccttgcggtactgttggcagccctggggcctctcacagagagcagccacacacatctcaggctcccctccatggcaggtgcagctcaggcatgggtcgtcccccttaggggtgaagtagaacccttcatccaccacgttgtccttgatgtcaacacatgtttgacctgcaatgagcatacattgtgtacagatgtatacaatgccaaaaaaggtagcctccccgtgtgggccacactgccaaaaaaggtagcctccccgtgtgggcctgtgaatgctacctgttaccttagaatgggaaggaggcagctggagggggcatgtgagacatgcccactagagtaatggcatcaaagcctctaagacagctctgtgagcaaacactgccatcactgctgcaccacttgacatgagctgaccttccccacctgggcctggggaacgaacaaggcaactgaagacttggccagattgtgctgagagtcttcccagggctggaatgccatggatctctggcccatggcacagggagtggctgtccaagagcagtcactacaacactgttagaacaaagtacatctagccagggcaaatggaggccggagagccaggatggagcacaatgccagactccagggtcactgcagaagtgtttgcctggaagttgctgaagtagattacttatgagattttctcaattctaagatgcagctgctatgagtattaaccatttcaaaatcagaatgtgtgtaaggaagctgccagttctgcttgggaaggcagtccactggacctgaggcacactctgcacagagctgacctaggatgagagtaagaggaatggccatggctaaaaacccagagtcttcaactggtaggcagacgttgcaaatgcctggaggagagacaaggaatgaaggagcctccaagagagccaccctcagtgaaaggcaaagagacatgagaaggtagcttcttacagtctccaaatggggtaaggatgtctagaaaaaagactcttccgaaatttcacaatcacaggtctatgcctcacttaagattgtagtcagctgggcgcggtggctcacacctgtaatcccagcactttgggaggccgaggcaggcagattgcctgaggtcaggagttcaagaccagcctggccaacatggcaaaaccctgtctccactaaaaatacaaaaattagccaagcgtggtggcatgtgcctgtaatcccagctactcaggaggctgaggcatgagaatctcttgaaccccagaggtgtaggttgcagtgagcagagattgtgccactgcactccagcctgggcgacagcatgagactctgtctcaaaaaaaaaaaaaaaaaaagattgggatcaaatctaggtcacccatgtggtcaggaactcccagggcaagatactcacatacaattattccctggctaaaatagagaaaaaagaatgaacagaaatgaacagagctcccagagaaatgtgaaacaccattaagtacaccaacatatgtgaaacaggagtaacaaatggagaggagagagagaaagaggcaaaaaaaaattagtcgaagaactaacagctgcaaactactcaaattcattgaaaaacaataacctatacatccaggaagctcaacaaattccacattcctaggataaatgcaaaggagccacaaactgacacatcagagtgaaaatgctgaaagtgaaagacaaggcgaaaatacgaaaagcagcaaatgggacgtgacttgttacttctaagggaaccccaataagacaaacaactgacttctcagcagaaacaacagaggctggggcagtgggataactgctcacagaaaaccatcaaccaagatccatatccagcaaagatatcttctgaaaaatgaaagtaaaataaactttcccagacaaacaacaagtgagagaagttgtttgcagatccaccttataagaaacactaaaggaagtttttcaggccaaaagtatgcaatccccagatagtaatttgaatacaaataagaaactgaagagcaacagtaaaggcaatcgtgattataaattatagcctacatgcatagttttcctcctttattctcttagctgatttaaaaagcaattgtataaaataatatgtatggaatgtagtattgggtctatgacatacaaaaatataacacacttagatttgccaagaatggcacaaaggtggtgtgtgggagcaaagctatactggactaaagaacttcacctaagtctcacatcttattaaaacactcattcgaaacatgtcctagacttaaatgtaaaacggaaaatgattaaaattttaggaaaaaaacacagaagaaatgtaaggctaggcaaagagtacttggacttgacaccaaaagaataatccataaaaggaagctggtttcagtggctcgcacctgtaatcccagcactttgtgaggccgaggtaggtggatcacctgaggtcaggagtttgagaccagcctggccaacactgtgaaaccctgtctctactaaaaatagaaaaattagccaggcgtggtggctcatgttggtaatcccagctacttgggaaggtgaggcacaagaatcacttgaacccaggaggtggaggttgcagtgagccaagattgcaccacttcactccagcctgggcaacagagtgaaattctgtcacaaaaaaaaaaaaaaaaaaaaaaaaatccacgaaaggagagagaaataactaggacttcattaaaattaagaacttttgttctttgggtaaacttatactgccaggaaaaaacagcaacaacaaaacttttgttcctgaaagctcacctgaagaggatgaaggcaagctacagactagaaaaaatatttgcaaaccacatatctgacaaaggactggtatctagaatacataaagaactctcaaaactccacagtttaaaaaagaacaaaacagatcattagttcacacctgtaatctcaatacaggaggatcacttgagcctaggagttgcgtttgaagccagcctaggcaacatagtgagatcctatctctatagaaaataaaaaacttagccaggcatgacggtgcacacctacagttccagctactcaggagactgaagtgggaggactgcctgagcccgggagctggaggttacagtgaactatgattgcaccactgcgtttgagcctgggtgacagagcaagaccctttctcaaaacaaaacgaacaaacgatgcaaagagaaaacggaagaataatgtgaacaacagagaatatacagatggcaaataagcacatgaaacatgaagaggttttaacatcagtagcctcagggaaatgcaaattgaaaccataaggagccacaggtctacatacatatctgcatacctaacagaagggctaagatgaaaaatagtgaaaacagtaagcgctggggaggatatggagaaattaaatcactcctacgttgaatcactcctacgttgatagtgggactataaaatagtacagccactctggaaaacaatttgcttgtttctttaaaaactaaacctgcaactacgatacaatcaagcaactgtaatcctgggcatctatcacacagaagtgaaaacacatttgcagccaggcgtggtggctcatgcctgtaatcccagcactttgggaggccgatgcaggtggatcatctgagactgggagttcaagaccagcctggtcaacatggtgaaacccatctctactaaaaagacaaaaattagctgggcgtagtggcacatgcctgtaatcccagctactcgggaggctgagacatgcgaatcgcttgaacccaagaggcggaagctgcagtgagccaagactgtgccactgcactccagcctgggcaacagagaaagactctgtctcacacacacacacacacacacacacaaaagaaaaaaagaaaaaagaaaacacgtttgcacaaaaacctgtatgcggatgttcacggcagttttcattgtaatagccaaagactggaaacagcccagatgtccttcaacacttgaggcctatagtttgagaccagcttgggcaacatagcgaaatcccgcctctacaaaaaaaaaaaaaatacaaaaataagttgggcacagtggcatgcacctgtggtcccagttactcgggaggctgaggtgggaggttcacctgagcctgggaggttgaggctgcagtgagcagtgatcacaccactgtactctagggtgacagagaccttgtcgccaaaaagaaaaaaaaaaggaacaaatcattaataaaagtaacaatttggatgactctccagggaattatgagtgaaaaaagccaaccccaaaaggttgcaactatatgattccatttatagaacatttctgcctcatgatgatacctgacaaaggccagaccacatatgaccaaaggcctctgacctaccacttctgtagcaaccagtctagggcagtcaggatctggccagtggccaccagcttctctattttgagtccatacttccaactggaaacccaccagggaaagtcaaatatgttccccaaaccaatcacctccactgccctgcttctagtcaggctgcctctaatcagagcatacctggagcctttagggccctggtgaaaagccactgtgctggacccaactccagctgcaggagggtcagaagcacttgtgaaggctccaccctggatcctcagggcactgggcctgcttaaggctcagatacagttagaacatcagaccctactatcagcatgctaacaagccttgagtcacacagtggactactgctaggcgggctgcaaaagacagactctagagatgtagcccaaagggatgacctcaagtagagggtggagcagacattaagaaaaaccctctggcaaaccagcctccacccagaacaacaatgctgctaaatacgaaagcctgaggtgcactgagggcaactacagtgccaacaaaccccaagcccagcccaactctcgcccagatcaacgccctgcactgtactaaagacctccccacaagaaaggcctagtggaagtaaaggcatagccactgcaagcacaaaactactgaactcagtctctattgtcccacacaagatgtcagagttccaatgaaaagcctagaaaaaagtaccatgctccagagacaaaacaatcaaaaaaccagactcaaatatgacacagatgaaggaacttccccacagggaatttaaaataactacgattaatttgttaaaggctccagtggaaaagctggacaatatacaaggttagatgggaaattcagatgagagatggaatctataagaatcaaatggaaatcctataaataaaaaaacagacaaaatcaatgaaacagatgaagaataccttcaatgggctcataagcagacttgacatagccaaggaaagaattagtaaacctgaggacaggtcaacagaaattactcaaactgaaggactaaaagaatccaagagacatgatgactagatgcaatgcatgattctggacaatgaaaaaaatagctataaaggatattattggaacgactgataaaactggaataatggattgtggattactgtatggtactgtatccatgctaagtgttctgattttgatccatatagtgtgggtacataagaaagtgtccttgttcttaggaaatacacactgaagtataaaacgcttaattaaggtccacagtatcttcagtttactcccaaatgattcagaagaaacatgtagagaaagtgaatgataaagcaaatgcagtaaaactgaaatactgtaactggtgagtctgtgtaaatggtgtatgaaaggaagttccttgtattattctgccttttccataagcttgaaattatacctaaattaacaagttacagaagtctccctcgcctgacccagatggtcctataaggtggttctatcaaacactcaaagacaagtttatctccaacttggacaaatggatttagagaacagtaaaataaaatgtttgccaactcattttagaaaactaatatagtataatacagaaatgagtcaatgtagtcccagctacttgggaggctgaggcaggaggctcacttgagcctaggagttcaagactgtactgtgctatgatcgtgcctgtgattagccactgcattcttgcctgggcaacacagtgatgccccaccttaaaaaaaaaaaaaagagagagtcaaggagagtatagaaaaaaatgtaacaggccaacctcacttcttaaaagagtttcaggccaggcacggtggctcacacctataatcccagcactttgggaggctgaggcaggtggatcacttgaggtcaggagttcaagaccagcgttcaagaccagcctgaccaacatggtgaaacgccatctctactaaaaatacaaaaattagccaggcgtggtggcacatgtctgtaatcccagctactcaggaggctgagacaagagaactgcctgaacccgggaggcagaggttacagtgagctgaaatcacgtcactgcactccagcctgggtgacggggcaagactctgtctcaaaaaacaacaaagagtttcaaaaattctaaatatcagcaaaccaaatccaccaatataatatattatatatatataaaccatgaggatggtttaacataagaaaatccatttatatgaaataatgactgaacagactgaagaaaaactacataaccccaataaaatccactaaaagcatttaataaaaatcagtacacttttgtaacacaaatattcccagcaacctaggaataggtacttctttgacttcatacaggtacattctaaaatcctatagaaggcattctgtagaatattgatacattaaaatagcattctaagttgagaagacaagaatgctcactaccaccatttctaatcatcactgtcctggagactgtagcaagaagagttgactgggcaacatagtgaaaccacatctctaataaatgtaaataaataaataaatgtcaaagatttgaaagaagaaacaaacccatctaaatagaaaatcaacaaaatccacaaactaagagaaccaataaaggagtttagaaaacatatcctaaaattcacatagaaaagggtcaaaaataggcaacataacaggcaagaacaaggcagaggaagtcgtaacaccagcagtcaagatttatcatgaagctctctctgttgccagccacctgggaggagctgccgccccggccgcacatctgcaatggatggtcgcgaggaatcatccggcctgatcaaggggaataagcagacccacagcactgagcctgagaacttaaaggctgcagctccttccactacaacgagctgattcactgcaggactgtgggtgtggacccggcagctgatggcaaaggtgtggtggtggtcatggagtggagatccggccagcagaagccagccacctcctatgaggggaccaccgtcgggtggacacggtggctcacacctgtaatcccaccactttgggagggcgaggtgggcggatcacgaggtcaggagatcgacaccatcctaacactgtgaaacccgcctctactaaaaacacaaaaaattagccgggcgtggtggcaggcacctgtagtcccagctactcaggaagctgaggcaggagaatcgcttcaacctgggaggcggagcttgcagtgagccgagatcacgccactgcactccagcctgggcaacagagcgagactctgtcccaaaaaaaaaaagaaaaagaggaccaccgtcaacaagaacgcctgcaccatgctcggcaacatcacacacatgatccgcaagaacaaagcctctccccaacctgcgcacagctgccatcccagagccagcgccatcctgcgaagccagaagcctgtgatggtgaagaggaaggggacctgccccaccaagagctcctgagacccctgtcccccaaaagcaatagagttagctggctttaataaaaaaaaaaaaacacacacaccatagactggcaaggtaaacagagaagcagagaagcagagagaaggatggcagaaatggggggtggggaggtgacaaacagccttagatgctccagagatgccaagtccttgggtcctcattcccatttactctcttaacaacactgcaacagggaggacagggatgattgtctcttccgtgggaaaagaagctgggctctaagatgcttccgtgggctctaagatgctgaccagctgccctggtcacagagctgcaaatgggccccaagaacaaggtgtgagctggtaaggggcgtccaccgcaacactgcaaatcaggttctgcctccgaaaccttgaactcagggtccaacaaagtgacacaagggcccagacattccccaagaacgccagctcaagggggcttacttcttttacacagaaatgaagacttctcgtagcagctctcggcgtgccagctgtggaggtcgtggtgccgcagggtggggaaatggaagcactgaagctgggcacagaacacgttgtcgttctcagacatggccgaggcaaagatggggtctgggggcaggaacacctctgaagagcctgttggggagacaaaaggtggggctggacaacatcacatcagaggacaagctgtgcagtcctcaaggggaccatggcgtcagacaggatcatcaaccacagggcctggaccgccaagtactggtggtcactgtggccaggtgttcactcgggactccccaacctcctgggagtcaccccaggtgctgggcctagcgggagccactccttggagcctgcaagcacacaggccacaaaccctgggtagcagtaagtgccagcctgagcaccagaagagggtgctggatcacggttagtgggtggcatttaaagttagagcaacagcataataacaaagtaatggattgtggcacactggattaaaatgcaaacaggggaatgggcaagggaaacaggcagggaagctctcccttaggacagcacactcagataaacagaagacttacaaagtccacccaacacccaggagaaaggcgccgtcaggcagcattggcactggccggcactgccagcagctggctgcagggaacacttaggaagcactggctcccggggacctctctcagctcaagggaaactgtcacccactcagctcctgcctaagccaggcacaaggcagtcagaaaccgtgtacccctgccgcagagagcgtgagggttggggactgctaacctccaagcctctcttttgcaaggttccaggtgggctctggccatgcccagggcatggcacagccagccctaggccccactctctcccctgcacggcccttccagtctgggctgccaagattccttgaggcttacccgaccaggatcaatggaaacacaaagcaacctttccaagaagcagaataatgaaggcacacctggtgctctccccctcctaagacagcagcagtgcagctcaccccatttataagcctccagcattctcacctgcgtcttttggagctctgtttatacccagcacgaaacatggggctctgcctcaaaaaagccagtgagtctggaggcaggcctatgctgtgggcctgtggacacatggtgccctgccatgggcaggaggacagctctcaggaagctctgagacctgcaagacctgtgccaggccagcaggcagccacagcaacagctgtgcccccttcccagggacatacaggcccagcatctcgcctgcctcatctgcatctatcagacccacagcagagcaggaaaggggcccactgtctggagtcacctccccataccacctggagggctggtctccactgctgacagtgggtgccaccaccatcacgctgtgcaccaccccacctttcctccaggcccccgagcccctgcacaccctcctcatctcccacagatgccttctcacctaagtagagcccctccccttttaaacactgttttcttcactatttgccttcttgtcccgtggcaagaaaaccaaacaggttccttccaatctttaacaaacaaaaaatcttcagcgctgaagctagttgccagctaagagctcctgcccacaactacagtacatgacagcagactgagaccaaggacacaaatgacctctccgggcagagtcctgggacccagcatttgcccacgaaagctgcctggaccggggcacagcaagtcagagtgagtcaggcaaccagcaaaacagggttcgtgtggcactctaggccagggcccagagagccacacagtgctccctcctggcagcaagctgcatgggcacctgtgtagcgcccctgcccaggggagctgctggtggctctgcatccaggtgctgaatgggggctggtcatgcgggcactgcatgcctacccgaggtgcagccttgcagagcgggcaggtgttcgtctttggagcatccctggaagaggtcacagtggcagccatgaacaaggcagcctgtggggctggagaagaggctggggagtggtaggtgatgagggtagtgaaggaaggggctgctggccttgatggaactgtgatttctatgagaaacgagagctgtgaacaagggagcagaggtgaaaaggacccccagcagctgtgtgaggagcggtggggctggggccaggagaccagacagaggccacgagcacaatcgggtgacggatgattgggtgttagatcccggtgggggctgcaagactggtgccaggtgatgagatcctggacatattccaaaggtgtgagaggagcctggaggcttcccgatactgcactggggatgactcctgcagattttcctccagggcctcccacttcctcctggacacccccttacctcaaacatcccgctcttcctgaaggaccctcatcctagagaaaggccctgtgagcagagctgccctggctaccagagtgactgggagcagttcctcgtgcagagccctcctctcaagcctccctccaagacactactcctcaccccctgccaccccagcagatccagtcctcacctcgacagggtggcggcaagtttccaggtgcccctcccatatgtccacacatgaggtgtgcgcaggactctgacgggagccttgggctgggccgtcaccagccaccggaggacaccctgctccccagactgatacacgagggcatctgaacctgattacctctgccaccacatcctctcccacatgtgcgagcagccactgccacctccatgtccaccgctgctcgccgagcctggagaaccctccccggcccccgagtcccccattgttcgagtggtggggagaccttcactcacttttctgagccctcaaagaacctccccttcctgtctcgccacctccacagccacagaatgagcctccactcgggcccaccaggggctgtccagatgctcccgaatgccccaccacggtggcagctgccccactcagggtctgtctcccctccaagaactgtggcctgaccccagctgaccccatcctagaccaatggtcagctcacccagagggcagggtctctacaatgcaccttccagtggctgctaggccagcctggcccctccctcactgctgactgaggcttctaaacgctaggtcccacaggctggcccaggaccacagccctgactgctggcctcagcgggcaacaccatacaatccctcaggtacagcaccagagaaagaagaagacggagaccataaaggactgggcacaagattttgggggagaaaagaaggcttctactaagtcacacacctcctgacctcagccaacctgcaatgtgcgtgctgagacaccacgggggacaaatgagggccaggcactgagtaatcttaaatgagcaagtgacacaacatgtggacacatgaaacacacgctgttttcacttttatattttaaggtaaatatcaagtatgactcaccagacagaagctacactgctggtgctgacgggaaggccctgggagcagcacgtggggcggtgtggatgattctccctacacaaggatctgtactttttcaacctttctgcacaaatgttacagaaatcctggcctcatgtcttctggcagcagcagcggcagttctgtctccagggcacatcatgacctggtgctgtcaaacctgcagggtcttggcccccaggcggggctcacaggctggtgtgggcctgggggagcgcctggagagcgctccaccaaggcgcacaggaaccctgcggaaacgagctcccaacttcaaatgtgtgtgcagggtaccgacacatgggcatagtaagcgtctatgtaccatggtatcactcacaccccaatctggaacatattatacaacacagaaaagatggacaacatgtagatgaaagaaacatttttcaacatcttaatgtgaggcccttccaccatcattagctgatattctcaggtacaatattttcttagggaagggttcagaatgagtaacaaatgacttacatccatttcccatggttttttgggtatttttgggggggccaacacctcagaccccaatgacccctctgctttgcaccatgtccccaggcaggagaaaggctggggtgggctgggctgggctagacgtgctcttgctagcttgttttatactcagtactgtcttcactctgcagcttgcttttggtacaggaatttttaaaacgattccactatggagagaggagtgcgtgcacccgagccacctcggtgctgaccgcaccctgctgcttggctcctctctgccctaccaccctgggagcccctcccctgcagactccaggatactggctcctaaaaccacacaaccacagtcctattgctgcacctaagaaaatgaatcttccacaagtccccactcatttcttgaattgtcctgtggaagattttataagcctcccaacctaggacaccataagggttcttgtgccacatttggttttatgtttctttaatctctttaagcccagaaccactcatgatgctgagctgcatcaagggccagttatcctgcagcagaagaattattgttattgttactatttgttttgtgaccactatttaaatccgctaacagagttcccgaatccatttaactgggcacaagcaggcagtggcacatggtcacctccgtggagctccgggatgctgtggggccccttgcacgttgagccacacaaatagggagctctatgccagctgcagctgccagcaccaacatacgtgttcaatctttttctaaattttaggttcactctcctgcctgaggctccaatggagtcactgagctgcacttggccattaaagcccacccaggacccttgccattctcacaccaagcatgaggcccccagtccccaactctgaatgtgctgtcatcccactcagaatcatgtcttctcttcaaccaccagtgtcaggaggacaagctaccaggataattatgctctatgaggcaaactttgactctggggcctggaaacccagaagccattgattagtcaatagcaatctaaacaatgcactcataaagccagggaatgcaaatgtggctggggctctcaggagggcactggtggtcatgagaacagggtggcatctgtcctgagcaggatcgggacagcaggtgtggccccagtctgctgggctctgcagcccccacctctgctcctgccctgtcccagcagccaggcatggccccgcctctgtggggccctcttttctccagggaagccggccacccaggccttgacccttttcaaccctgtccccaggcccatcactcctcatttatccttcttagagatacttaagacatcaacagcaggactgggatgtgtttacgaaaagaacccaaatcctagctcaagccacaggcacaaagtacagcccaacagacagggaaggggcagggcaagggagtgtgaccctggcggcagctggagaaggcactgctggagtatgtccaggaggagctcgccagtgccagggcaatgggacaggaagggcaagccaagtccgagcccagggaatgtaaaggaaacagcagccatgtttcctttacgtcgtcttggtatttccaagcagctccgcataaaatctttgcgcacacacacacatgcatgctcactctctctctctctctctctctctctctatctgcctgatagtttccttcaggtctggattctacgtctgacctttgtcctggcaagcttgtcctcccctccagcctgccaggggcacactctgcatgctcatttttatactccaaggtctttaacttcaaaaggaggcgggggacaatctagaaagctggccaaagtgagatgcaacagagggttccagagacagccaccgcccaatgcagggcctgatctgcaggctgcactggccccatgaccgcagccctccctgcaactggggctcacccactccctgcacagcacccctacgggccaggcagcactgggtaagagggaggaggggaggccccgaatcagggtgactctgcccagcttcaaacactcccacacaccagaagggctcacctttgaatgccacctcccagcgaccttccaaggagcggttccggccagtgataacatactgatagccaacccacaacctgcagggcacagagacagagacagagatctcagcggcaggagggatgcaaccatcaatgactgtgtgttttttgttttttgagacagagtctcgctctgtcaccaggatggagtgcagtggtgcgatctcggctcactgcaacttgacttcctggttcaagcaattctcctgcctcagcctcccgagtaggtgggattacaggcacaggccaccacgcccagctaatttttgtatttttttttttttttttagtagagacggggtttcaccatattggccaggatggtctcgatctcctgacctcatgacccacccgcctcggcttcccaaagtgctgggattgttttttaatagctatactgacctccacaacactgagcttctaacatgagacactcatgttagaatgcattaaaattcaaaacaagaaagttcacagggcaggaaaagttttatctcagggaactcttgccaagactgtttctatgagctaaaccggtaaagctttcacaatttaagcaagaacaatcttattcttggtagacatgaaaccccatgaatacaactcggtgactatgctaaaaccataggacagggcactccacaggggagattttcatggcatgtgaactgcatctcaataaagacataagtccctgcaaatatccactaccatgggggctgaaaacacttgcacggcttcccactcagagccagcccacctcaggcctgcagcctgctcctgagcatgcaggcctagcactgaaaggaccttgcactggcatctggctgaccgccataagctcctgcctagtccatgtcccttggcccagctttccagccccaagcctagagatgcccatcagcaggtctccccgcatggcaggagcccagggatggcacactctgccctatgctgtgcaaccacaaggctgtcctcagagatggggctgccctgccctccgggctataccctcttgcttctccactggactcacaggcctgtcctcatggggttagtacaacaacctgtgagctaagagttagtttcctccctttgtagctgcagaaggaaaaacaactccgtcttgtgatttgccaaactctcacagggcataactgtggagtcaaaacccagcttgggtcttgaagcgaaggcccccttgctttcttggggggaacccccacctacactgcacaccccttgcacaaggcccacgaagccccacaccaagcagttctccccacacaagccagcacccccagccccctgcctgcgctcagcaactgcacttgtacaaggagaggggtaccaatgaaaggggctgccccacagtcccacaaagtagcagcagagtccagcctgcccctgctcccaggaccctccacctatctcgatgcacactcctacccatggatctcctgggcttccagtgggcgaggctggtcttcccaacctgctgtctgccagctgtgctccaggagtttactgagtggtcagaggccatgtgctcagtagtcatcagactctgactccagcccctcaggtccccaatccaggactcacttgcgctggtccttccaaccaaagctccgctcgggctggtcccattcctgggccaggacaaagcgcagctcctggtcagtggagaaggtggcgagagagccattcaggcgctggcaggtctgcgcggcatcccagtagttctccccgctcaggtagacccggtagcagctggccgtgccttcgtagtggtgccaccctgtcgggcacttccctaggaaacataaaggacagaaggggagttgtcccccaagttaggatccagctccaaaatggaaattatatgtactccatcagggacaggcacaccttgtaaatcaccctagagaagtggggaaactgaggctcaagaggacaaggtctgcttctgaaaccacattgcagaaatgctcaagtttctctaaaacacagattcaatgatacaagtacattcggtgactcttcccatttctataagatcttttaatttattcactagtcaagaacggctgctgaattaagtcttgtaaagtggatttcattctctgggttaacaacacagcacaactcccatgcagttcactttgggccctgcttccaatgcccagctctcctggcctccgctgccagctagctcactcccctctctcccttttctacttacatgagcatttgcagtaggggctggccaaccctccactaaaacagcagctcaaaggataacagctgggagagccatgacactgtgtgacccgcccctgcctcccacagccgaaaaaaataaggtgtgggcgatgccacaggtggcaaagctaaggagccagccagcacttgagtatcaatgagtctggccagcgtcctctcacttcctccacccatcacttccgactcctacacccacacacgggaatgcctggtaatttacagctcaccttaggtaacaccagtgacctcttttatagaatctttaaccttcaaatgttgggtacctcatattagtacactggagaagagtgacaatttttagcaaagccagttgtaaaattaaaaatgccatttttaaagtgcagctatgtcttgtggcactagtaaaacttctagacacgtatccccatgtatttattatgtaagcatgtgtgtgtgtgacttcttcataaaggcacatagattacagaaaaagaggggcacccctagcccctaagcatggccacagctggacagcaccatctgctcaccgtgaagggtacacctgagtgtgcaaggaagctctttaggtgcagacaaggaatcagagggctggcaacagtggctcacgcctgtaattccagcactttgggaggccgaggtgggcagattgcttgagctcaggagcttgagaccagcctgggcaacatggcgaaaccccctatctaccgaaaatacaaagaattagccaggtgtggtggggcacacctgtagtcccagctacctgggaggctgaggttggaggatcacttgagctcaaaaaggcagagactgcctgcagtgagccaaaagtgcgccactgcactccagcctgggtgacagagtgagaccctgtctgaaaaaaaacaaacaaaaaacaaacaaacaaaaaaaaacaaaacaacaataaaaaatgtcaaggcatcagctctcgagaaggtgtgttgcacattcattgcgtgtttcctgggtgccacaccaatgcatgcagcctgaccacatgccccgcaggtggctctgcaccgtctccatgaagaggtgaggacactgaggcaggcagaggccaggcccctatctcaggcaaggtgagaggaagccctgtagggagggaagctggctgaggcatggagggaaggagacatcccaggatgggagccagctggctggggcatggagggaggaagcactcctgtgcactgactcatcttctttatgttctgaacttggtggagttgcttactacccaggcagaagtgctgcctgttcaaaactgaacagacaggcaaggggaaggaagaacatggagctgagcatcaggaccccctggggctgcactgtgaactgccccttccctacaggtggcctctcagcctcagtgtcttcacacaccaagcctgtgcaccacacttgcactgtggggacccgttcgggctgtgggcacaggccggagacaaagtgcatcaccaggacatgtccagccctgcttcagccgcaccaacatgcgtgaccacctggaaacacctggccccactctggccacccagggttggtgggggttctgccagaagcagacctggtcacctctgaggtgctccccagtgctgaaagtctgggggctgaggagtaacacaagcagacaggcccaaggcagggcagcaggcccatccagtatcagtcctgcctggtccacagccgctgctcagcgtacttgggtacctcgcgcctgagagggtctgctcagggccatttcagtggtggcttttcctcccctcaaccttccttgatgatctcatgcccctttaaaatttcaatgtcataggtaatttattaaataactaatcaccttaaaaatttttcttaaaatggctggacacagtggctcatgcctgtaatcctagcactttgggaggctgaggtgggtggatcacctcaggtcaggagttcgagaccagcctggtcaaggtggtgaaacccggtctctactaaaaatacaaaaattagccgggcgtgatggcacgtgcctgtaatcccagctactcgggaggctaagacaggagaatcacttaacctggaaggcagaggtttcagtaagctgagattatgccactgcactccagcctgggtgacaagcgtgagactccgtctctaaataaataaataaataaataaataaataaataaataaggagtcgagccttcccattttattgctgtatctaaactcagagctggtttcctcatttataaaagggaataatacaactttggaatttccaagggccagtgccttctggccctgaaaagcagtcactttgtgagaacaagcagcctggcctcagagccggttgacttcctagggccttgagtcacataccaccactccagcgctgggtgactgcgggtgggtcatcatgcagcctcattcattcccctcactggcctccaagggctgctttgagaaacccctcacgcagcacagtagtgctggaaaggcaggggtcatgtcaggcttgcactccccagtgtcccagtcagggcaggtctgcaacttactgctgaagcgaacgggctgcgccacgttcaccgcgtggaagtgcgaagggtcgcctcctctggcccgcccctgccgcggatccacagcctccttcccatgatgaggacgcacctccccggtcacttctgaaagcaaaaggagatgtgtgctgtgagtcctgcctgtgcagtcgcagtctccctggccagcatggttcagaccactcagggctgcaaggccggagggggggcctgtagcacagagtccggcaatgcaggctttctttagagccctatgaaacactgccgctcgcatcaaatgggtcccgtgtgcttcttattaaaattatgccgtggcagtttttgttttttaagttactattgtgaaatggaggccctcttcattgcattttctaacaggtcattgctagcacagcaaagggtcctgcataaattaaaatccctcagcagttccagccccatggggatggcccatgaaagagttctctccagagcccaggctgcccctaccccttccttgagggccttctctcccagtatgaaggagacccacgtgtgcaaccttcctctgcagcccttgtcctggggcctgagctgcctatctgtccccctgcctgctggtcccccatggctgtgaaggcctccaggccaggacctcagtatgttcctgtctggctctttggtgcttggcacaggccctggtgtgcagcaggtctcagtgcatggctagaaggtgtcaacaggcagctgaagatgaggaaataactatagttttatacagcatgatctaatagtaatttgcacaccagtgcttccacccacacactctcttttgtcctccaacccccttgtgaaaaaggagaaccacactcctcccatctcacaaggtgaagggcagactcagagaaggggagtgacttacccaaggccatggtgcaggggagagggccctcatgggcccgctcacctcccactctgtacaggtgtaccctgatgtgtcatgaagggcatcgggtacaaggtcaggtcagatgggaaacaaacttggtctgcaaggctgcacacagacagacgcctgccagcaagtgcactctggctgcagatggcgagtggggcctcggctccccaagggaggtcacagggagggttaggaggcctcctgcaaagcctccttccctgaacctgaaccggcagtcagcgccacctgacgagcccctctccagcaggttggttctgctagtgtcatagactttgcaatggtttttatttaataaaaaatccacatgcttttttgctcatgataaagtaacaaacattcaatgtgaaatgcttgaaaaatacaaaagtttgaaaagacaataaacaacaaaggccatatttaactatgcgagcatctgccccctcaccaagtctcttttctacacaaatctttaagaatactgggatcacatcagacactccatttcacgacttgctttgtaagcttaagactataaacagctttctatatttttaaatgggcttaggaacatgacttttgatggctgcatagtattccacaaatggatttctttcatccccataatctctatggtttgaggttaggctgtttgcatttttttcattattctagaaaaggctgccttaaacaccttgtacacaagtgcgtatgtagtctcatttctgagactctggatactcactcagtactcaataagcatagttccatagctcctgtcaggcatgtgatggggatgggttgctattcgactgggaatcactaaaatataaaatatgctacctgtgtccgagacactttcaacagaaagtgaagacctcaaagggagaagcatcttcaaggcttgtgttttttggtagaggtgtctttggggtactttaccaccccaaaatacaacctaaggacctcagtgtgggacagtaactggcaccacgacaggcctgatgctgtaaacacgcagtacttggggaccatcagctctttaggactggtcccatgtcctaagccatgctacctgcagcacccgacactctgggtaggagactcgacccacagactcgctggtagctctgatgcagggatgcagccactaggatggggcatcagcacttggtggagaagggaagagccacctgagcttctgggcctgagactggaagctgagaaagaacagaggggctttctggcagatggagcagctttggcaaagggcaaaggcagacatatccgggataaacctgaggccaggcctgagtgtggctggagaatgtcactgaacttaaattcaacatctccctctgctcaaatgggcaagacctgtggctccactttgtatcctggcctcttccccaagccaagcacagtacctggtaaaattgctcacagaaagacaagatgaactgagggcagaggaaagggaagagaaagaagagataacagagggacagtgctgccaggtcacatgggcaccaaagaccaggttgttacatgttgactgagtgaagtcatctgccccctggggtgggagaccaggtgaaatatttcagaaacataaccagaaagccaaatggtgataaaggacaccactctgttgagcaggcttctctgggtttaggtggcaattgtgagccctttcttttttccatcatgcatctccatatccaaatgctcacattcatcccctcacccccacgtttattcaatgcccattctgggcccaccatggaaacctgccagcacagacacaggcctttgccagcaagaaggggaagggcttggctgtcaagatgatgctgatgtcagacagtgtcctgggggagagtctgggggccaggctggggaatgcgcatagcacaggacagaacccttacagacctctcaggcctgcctctgacagtagagaatgtccctcttcccgcggagggccagcctttggtaagctggggggcctcttccacctccaccagggccatggggcccgagcagccctgcctcacagcccagctggggacctggtgcaggggtcactgtagcacccagagccacatctgctccgactctgggctccatgacctgtgcagctcggagcacatgtgcccctcctgcctccagcaccactagagtgccacgctgctgcttccccagcacaggaacacactggagagcaagttcaacaaggaaacagaatcagggagaatacctagaataccactccacagactatttattcacaaattacttttcgtcacaaaaagggaaagaaatattcacaatagtgatcaaacttaacatcaccaataatgagacaaaatgaccttgggcctcgtgatttgataatttatgacttacatagtattgctacctaaaaaaaaaaagtctcacctgaagctaatcctgaagaaagagacaagtccaaattgaacgccattctacagaactgacctggactcttcaaatatggcaatgtcatgaaagacgcccaaagccccctgcaaaagagggctgggaatacttctagattaaagaacaaagcaatacggcaataacatacttacattaatccttgaataaatcttgaattaaaaggggaaagaaacctgtaaaggatgttctggggataatgaaaagaatctgaatatggattacacagaatagtactacagtaaatttcttgcatgtgaaaaggcttctgtagaggattgttcttattttttgatcatagtatttaggggtagaatatcataatatctgtaacctctcaaagggttcagaagaaaaacacaaagagcaactgcggcaggtgaacccgggtaaaggtgcggcaggacactatcagctggtgaacccgggtaaaggctgcaggagtgtttattgcactatgattatgagttttttatagatctgaaattattcatattaaaaggtgggcgcagggacaaggcaggtggacacacccagattcctcccacaactcaagcagtaaacaaatcaagagttaactggtaagaagataaaacaggtggtgtctgggttaggggacaccagttcagctgaaaatcagggttctttactcagggaagagaggacagattccccatcgccatttttcttccactaagctctcagaaccccaggctccaggcagataggaaatggtcctttatggaaaaaatctgaccaggtcaagaagaaagtccccaacaggaggagattcccaacgaaacatatccagctggttcaccctccagggaagcccacgtgcacagaacttcaagtccctcagccacatacagcagatagggaaggaccaccaaacctctgaggcagagacccaaaccacagaggaaaatagcacagaagaaacaagtacagagacaaaaagttaaaaccaaaaacaggccattaacatcctcaaagtgagaggttctactgtactcatgaaacaagaaaagggtgctattaagaaggagcatggaccgggcacggtgcctcacgcctgtaatcccagcactttgggaggcccgaggtgggcagatcacaaggtaaagagatcaagaccatcctggccaacatggtgaaaccccgtctctaataaaaatgcaaaaaattagctgggcgtggtggcacacacctgtagtcccaactactcgggaggctgaagcaggagaatcacttgaacccgggaggcagaggttgcagtgagtggagatcgcaccactgcattccagcctggcaacagagcaagactctgtctaaaaaataaataaataaaatttttttttaaaaaaaaggaaaatgcagacaacactatccatcattacttgcctctgaaaatgatcttgtacaaatgaacaggaggccaggtgcagtggctcacacctgtaatcccaacactttgggaggctgaggcaggaggattgcttgaggccaggagttggagaccagcctgggcaacacagcaagaccctgtctctatgaaaaataaaaataaaaataattagctgggcatagtggcatatgcctatagtcccagctactcaggaggatgacacaagaggactgtttgagcctagctgtttgaggctacaatgagctatgaccacactagtgcactccagcctgagtgacagtgagacctgtcacacacacaaaaaaaaactgaatacatgacagcaaacatgaaaactcataaaagatttggcagaagttatagaaacctactaaaagtaaaataatcaaagagatggaaaactgcagaggagaaaacgaaaactgggaatcaatccaagagctccaattcccaataataaagagttccagaaaaagggaacagagaagaaaacagaatagaacagagaacaggaaagtgacccctttccctaagctgtaaggcatgagtctaagatgaaaagacccactgaggaggcagtgcaatggttcaaaagatacgcaaaatttccaggaagaaaacaagttatgttcaaagaatcaaaaattatgtcaccagcaacactggtgttggagtaaaaatggagtaagcttaaccttcaaaattatgggaaaaacttatttctagcttatgattctaaaaccagccaaacttatgtgcaaaggtaaaataaggacacttcagacatgcaaacaaggaaacacaaacctttgtctcctatgttccttttccacataagtggggcagtactcgactaaaatgaaggaataaaacaaaacaggaaagatataaaaaccaaacaccagaggttccaacgcaaggagacacaggtgagagtgactgattctcccacactgatggtgaacggggaagctggcccagcagcactgacaggtgaggaccaccaggggcgtctgggaaaggaggggccaaagaactctgactgatagagatctgtaactgaggggacatcaggaaagagacttctaggtacttaaaaagaaaagatatatatgaatctacaggattcacaccaaattggaaaacggcttggcaatttcttaaaaaattaaacatggctcggcacggtggctcacgtctgtaatcccagaactttgggagaccgaggcaggcgatcgcttaaggtcaagagttcgagactagcctggccaacatggtgaaaccctgtctctactaaaaaatacaaaaattagctgggtgtggtggcatgcacctgtaatcccggctactcaggaggctgaggcagaagaatcgattgagcctaggaggttgcagtgagccgagatcgcgccactccactccagcctgggccacagagcaagatgaaaaaaaaaaaaaaaaagtgaaaacacaatgttgtgccaacaaaaaggaaacggagtgctcctgcatggcccagctaggagcagcactgaaagcaggcaagacctcacagagcacagggcccagactcacccaccaggcttagggaagaatcagcagagaatgcctaaaaccacggaatttaaagacacacagataaataccaaatgaaacagctaaaacaatgtttgccttgaaaattagaggggttcatagggtttgctattaaaaaaaagacttacagaatcatttgaatattcaaattgtatgcataagtaacttgaataaagataaaactaaaaatttgaagtagacaatcaaaatcagttcctctacagatctgggatgccccgccccaccttttttttacatcggagctgccgctgaggcatctactgctctgattcctgatccttttattgtgacccaggtttcccgctacaggggttgatgtcctctgcattaccaacgtgctgcagctgcacaaggaggtaattgatacaggcctttttaaaattattgtgccagtcccttccaatccaaggatacaatctttcatttctgggaaattttcttatataacttctttgctaattccctcctcccccatctcctctattttcttttaaggaatttgtattaatcagatattggattttctgaactcatttttaaccacttaagagtgtacagttgggctgggtgcagtggctcacgcctgtaatcccagcactttgggaggctgaggcaggcagatcacaaggtcaggagatcgagaccatcctggctaacacagtgaaaccccatctctactaaaaatacaaaaaattagtcgggcatggtgaaaattagccgggcgtggtggtggacgcctgtagtcccagctacttgggaggctgaggcaggacaatggcgtgaacccgggaggcagagcttgcagtgagccgagatcgtgccactgcactccagcctgggccacagagcaagactctgtctcaaaaaaaaaaaaagagtgtacagttaagtggcattattaagtaccttcacattagttccataacaaccatcaccaccatccatctccagaacttttcatcttaccaaacaaactccgtatccattaaacattacctcccaatttttctctcctcccagcccctggcaaccacaattctacttcctgtatctatgcatttgagtatcttgatagcacatctaaatggaaacatacagtatttgttattttgtgacaggcttatttcactgagcatatcctcaaagtccatccatgctgtagcatgtgtcagaattccttcctttttaaggtaaaccatattccactggatggatagactaccttgttgttgatccattcatctgtgatggacacttgggttgcttccaccttttggctactatgagtaatgctgctatgaacttgggtgtacaaatctctcttcaagtctctgcttccaattctttggagtcgaactgctaagttgtatgataattctacttttattttttgagacagagtcttgctctgtcgcccaagctggagtgcagtggcatgatctcagctcactgcaacctccgtctcccaggctcaagcaactctcctgcctcagtctccccagtagctgaaattaacaggcgtgcgccatgacgcccagctaatttttgtatttttattttatttattttttaaagttcactttattttttgggggggaaggagtcttgtcctgtcacccagactggagtgcagtggcatgatctcagctcactgcaactttcgcctcctgggttcaagtgattctcctgcctcagcctcccaagtagctgggattacaggcatgcatcaccatactcggctaatttttttttatatttttggtagagacggggtttcaccatgttggccaggctgctctagaactcctgacctcaagtgatccgcccgcctcggcctcccaaagtgctgggattacaggcgtgagccaccgcgcccggcaggtaattctacttttaatttgggtggcactgtcatactgttttagtagctgcaccagttcccattcctaacaacaccgcagagggattccactttttctaaatcctcgtcaacacttgtcatttcctgttcaacagcaaacatctaatggctgtgagctatttcactgctgttttgatttgcatttctctaatcattaatgtgcttatcagtcatttgtttatcttctttggagaaatgtctactcaagtcctttgcacattttttttttttttttttttttttgagatggagtctcgctctctctcccagtctggagtgcagtggtgtgatctcggctcactgcaagctccacctccaggattcatgccattctcctgcctcagcctcccgagtagctggaactaaggcgcccgccaccacacctggctaattttttgtgttttttagtagagacggggtttcaccgtgttagccaggatggtctcgatctcctgaccttgtgatccgccggcctcccaaagtgctgtgattacaggcgtgagccgccgcacccagtcctttgcacattttttaaccaggatatttattattattgagctgtgggaattctttttatattttaaatattaacccttaccagatatgagtttcaaatgttttccattctgtaggctgccttttcactctgttgagtgcttcttttaattaatagaagttttaaattttgacgtagcttaatttatctattgtttcttttgttgcctgtgatttaagtgtcttatgtaagaaatcattgccaaatccagtgtcacgaagactttattatgtttttctaagaattttatagtttaaggtcttaaatttaagcctgatccattttgggttaagttttgtatatcattagctaagggtctaactttattcttttgatttgtatgtccagttttcctagcaccattcattctgaaaagacactttttccctcactgaatggtaatggcatccttgtggaaaataatttgaccactgtatgcaaggacttattgctaaggctctgtattctattccattggtctatatgtctgtctttataccaatactacaatgtttggattactgcagctttgtaataaggtttaaagtcaggaattatgaggatttcatatttcttcttctttttcaagactgttctggctctttggagtctgctgagattctatgaacattaggataaatttttctacttcagcaaaaaaaacttgttggcattttaatagggattgaatctgtagattgctttaggtaatagtcacatcttacgttttacagtccatgagcatggaacatctctcaatttatttttgtcttttttttttttttgagacagtgtctcactctgtcacccaggctggagtgcagtggtgcgatctcagcttactgcaatcttcacgttctgggttcaagcaattctcctgcctcagcctcctgagtagctgggactacaggtgcacctcaccacacccagctaagttttgtatttttcaccaagacaaggttttgccatgttggccaggctggtcctgaactcctgacctcaagtgatccacccgccttggcctcccaaaatgctgggattacaggtgtgagctaccacacccagtgtcttctttaatttcttttaacattttgtagttgtcagtgttttcagtctttcatgtgtacttaagaatattctttagtacagacagacccccaacttatgatagtttgactaaaaaatttttcgactttacaataggtttaagacataaatctgttataagttgaggaatatctgtattttattctttgtactattactgtaaatggaattattttcttaatttcctcttcagatagctgagttagtgtacataaatataaatacaactgattttgtgttttgactttgtgccctgcaattttgctgaattcatttattagttctaaccatgtttctgtgaaatctttaaggtttttatatataaaatcatgtcgtcacacatacaaacagggataactttacttctccctttccaattttgatggctttctcttcttgattaattactgtgggcaattaacttcaatactatggtgaataagtggtgaaagcagacatccttgtcttgtctctgatcttagaggaaaagctttcagtctttgaccactgactgattttagtttgctgagacatccttgcattacatttggtccaagccttttgacagactgctaaacttggttaacttggttttgctagtattttgttgaggattttgtatcaatattcacaaaggatattggtctgtaattttctagtagtattactgtctggctttggtatcagggcatgttagagtcacagaatgaattcacttgagaaggactgatgttaattcttctttaaacgtttggagaattcatcagtgaagccatgtggttcaggacttttctttgttgagaggtttttgattactgattcaatctccttattaattatagtcctattcagattttctatttcctcatgattcagtcttggcaggttgtatgtttctaggaatgtgtccgcttcatttaggttaagcaatttgttaatgtacaattcttaacagtattctcttataatcctggcatcaagtaatcctcccaccttgaactcccaaagcactgagatgacagatatgagcccagcccaaaatccaaaactcttgagtgccaacgttgtactcaaaggaaatgctcactggagtgttcaactggtaagtataatgtaaatattccaaaatcagaaaaaaatccaaaatccaaaacacttctggtcccaaacatttcagttaagggatactcaatctgtattttgaatgtggctttttcttgattaggcattttcttagctgggctaagaaacctctgactgttttccagagcttctataaagttattccatctagtccctagttgcttattaatgttttctatggtggaacgagaacctggagcttcctggactgccattttaccaatgtcagaatacatttttttaagttttattacatgaataaagtaactgctaattgagggattactgtgtgctacattcttgtctaatccctttatatgtagcatgtaatgtaatcctcacaacaaccccaagtgacaggcactattattttctccattttatggatgcaatttgcccaaaggatcacagccagtaagtggtgaaagcaggggagcagccccagtccctggctcaagcccccacatttaaccacgatatgacatacagcagagctggctgcctcaggccactttgctgtggcccttctggtctggtgtgctttgttcagactctggcgaatatccacagtggatgttttcttctagatctggtcagcactggttgtctttcatcataagaggaaggtgacccagctagccagaggctctagtgagcctagtgggctagacgcttgtcagggaccacggtgggagagctagtctttcagttggaaaccttccattatgttgacacttttctacctcttgtatgaagtgccagtgtctctagaaaagactcctccaatctcctgtctgggaaaacacctggctgctgacatctggagagcagggcagaagacaggcctgagcatcctacttattacctacttgtcactacagagaatttctcttaattcctctattttcaacctccacgactcccctctgttgtacctggtgtcacttattttgcagactttaagtgctgtctaatagaaacacaatgcaaaccacatttcaacaagtagaaacaaacatgaaattaattttaatactttatctaacccaatatattcaaaatactattactgcaacatggaaacaatataaagaagtattcatgggatgttttacattctttttttgtactaggtctttcctatttggtgtgtattttacacctgctgcacatcttccttcaaaacagccacatgtgactcatggctactacactggacagtgttggtctagaaaatcaactcctgcggggcacagtggctcatgcctgtaatcccagcactttgggaggctgggggcaggattgctagagccccggagttcaagaccagcctcagcaacagggcgagacctcgtctctacaaaaaatttaaaaattagctgggcatggtggtacacgcctgtagtctcagctactcaggaggctgaggtgggaggatcgcttgagtccaggggtttgaggttgcattcagctgtggtttcaccactgtactccaatgggcaacagagcaagactctgtctcaaaaaaaagaaatgaaaccccacatcttatggtagcagaaagagtcacccagtgatggaaagtgaagaagggaatgcgagtgccaagagaattccaccaatccctatcccactcccatgcctatgcctgatgcctgccacccttggcactcagagccttcaagcgctgagcctttctgggaggctgctgggcaaactgcttatttcttgttgttctcactcaagcaggcccatggttgcagctgctctgctacaccaggtcagtttaactctcccattggcttttctttggaaaggaaaaaagctgtataatatgtgaaacatttcaaagaatgtatgtagcacacatgtaagattcataagcctaataatatagttgtgagcgacctccccacaccccatttaggaaatcaagcattattttgcttctcccagtcttatatccctctgtctctccaccaggaactagaattttgtgtatcactgcgcttatttttttcttttagtttaccacatgtgtatgtatctataagtaatataacgatctgttttgcttctctatattgtgccatatgtcgtttttagcaacttgcttttagctgacgttctgttttcaagattcatccatgttgctgcataaacctaacattcacttactgttgctggtgtataacattccatcatgtgagcacagacatttgggttgtttccaagacatgtatcaatggcaaaaattaagatgtctgacaaaaccaagagttggagaggatgtggatggcttggaattttatctgctcctttacacccactctggaaaaactgtacaaacaattctgcaaggatttttccagagtttccctaaatagaaatcctggatcacaggaaataagaatgttcagctttgcaagataatgtctctattccagagtgggtgtaaagaagcacataaaatttccacactatccatatcttctccaacattttaatttttgccagtctaagcatctgtaaagtggtatctcactgtatgtagtcttagaatactaacgaggttaaatttaaatgtctttttctatgtttaatcaccatctacgaaatgctttataggagttctttatatacactgaattagaatccttatcctttacaggctgtaagtgttgcaaatatcttctctctactctagcttgtcttttcacagtctttactggtgttttttggggttttttttgtttttttttttttgaaacagggtctcactctgatgtccagtggtgtaatctcggctcactgcagccttgacctcagggacccaggtgaatcttcccaccttagcctactgagaagctgggactacaagtgtgtaccaccacatctggctaattatttctttttttttttttttttttttttcatagagacaggatttcaccacgttgccctggctggtctggaactcttgggctctggcaatctgcccaccttggtctcccaaagtgctgggattcctggcataagcacctggcctattggtgtctttcaataaacgagagatcttaattttaatctagcaaattcagtcatttttattttagagtgaatattttatgtgattaagaaaaaggtggccagaggctaggtatggtggctcatgcacctgtaatcccagcactttgggaagccgaggcaggcagatcgcctgagatcaggggttcgagcccagcccggccaacatggcaaaaccccgtctctactaaaaatacaaaaattagacgagcgtggtggcagatgcctgtaatcccagctactcgggaggctgaggcaggagaatcacttgaacccaggaggtggaggttgcagtgagctgagatcgcaccactgcactccagcctccagcctgggtgacagagcgaaactccatctccaaaaaaaaacagaaaaaaaaagaaagaaagaaagaaaagaaaaaggtggctgggcgcagtggctcatgcccccgtaatccaggcactctgggaagccgaagcaggcagactgcttaaactcgtgagttagagaccagcctgggcaacgtggcgaaacaccgattctacgaaaacatgcaattagccgggcatggtggtgcacgcttgtagtcctagctactccggagactgaggtaggaggatggcttgagcccaggaggcggaggttgcagtgatacaagaacgtgtcactgcactccagcctgggtgacagagccagaccttgtctcaaaaaaaaaaaaaaagaaaaagaaaaaggcacacttccctatcaaggtcttaaagatagtctcctataatttatccaaaactgaatttcctgtatgttgtgagttagggatccaactgcatccttctccgactgtcacagcactgtgtttgaagagtctgccctttgcacagcgatatgtaattccacctctggaattcaagcttcttaggtctgtttctgacagcttctgtctcactggccaatttggatttccctgagccaattttgaagtaaatcttgatacgggcaaggcaagtgctccctcctcattcctcttcttcacaacgacctctcaatactacgacttaattcttctcaacattttagaatcgacttatcgcatttcacataaaactcacggagctttaaagatgcactgaatccacagaacaatatgagtttttaaaagattcggtcttcctaggcaagaacattctgccactatttacttgtcttctttaatgtctcttaataaaactgcaaatttttctccctcaaaaattttacacatcttttgttaattctcgtttatatcaaagatggttcccctctccctctccctctcccccctccccctccccctctccctctccccacggtctccctctccctctctttccacggtctccctctgatgccgagctgaagctggactgtactgctgccatctcggctcactgcaacctccctgcctgattctcctgcctcagcctgccgagtgcctgcgattgcaggcgcgcgccgccatgcctgactggttttcatattttttttggtggagacggggttttgctgtgttggccgggctagtctccagctcctaaccttgagtgatccgccagcctcggcctcccgaggtgccgggattgcagacggagtctcgttcactcagtgctcaatgttgcccaggccgaagtgcagtggcgtgatctcggctcgctacaacctccacctcccagccgcctgccttggcctcccaaagtgccgagattgcagcctctgcccggccaccaccccgtctgggaagtgaggagtgtctctgcctggccgcccgtcatctgggatgtgaggagcccctctgaccggccgcccagtctgggaagtgaggagcgcctcttccctgtcgccatcccatctaggaagtgaggagtgtctctgcccggccgcccatcatctgagatatggggagcgcctctgccccgccgccccgtctgggatgtgaagagcacctctgcccggccacgaccccgtctgggaggtgaggagcgtctccgccgggccaccccgtctgagaagtgaggagcccctccgcccggcagccgccccgtctgagaagtgaggggcccctttgcccgggagccgccccgtctgagaagtgaggagcccctccgcccggcagccgccccgtctgagaagtgaggagcccctccgcccggcagccaccccgtctgagaagtgaggagcccctccgcccggcagccgccccgtctgggaagtgaggagcgtctccgcccggcagccaccccatccgggagggaggtgggggtcagcccccgcccggccagctgccccgtccgggagggaggtggggggtcagcccccgcccggccagccgccccgtccgggagggaggtggggggtcagcccccgcccggccagccgccccgtccgggaaggaggtgggggggcgcctccgcccggccagccgccccgtccgggaggtggggggcgcctctgcccagccgccccttctgggaagtgaggagcccctctgcccggccaccaccccatctgggaggtgtacccaacagctcattgagaacgggccatgatgacaatggtggttttgtggaatagaaaagggggaaacgtggggaaaagattgagaaatcggatggttgctgtgtctgtgcagaaagaagtagacatgggagacttttcattttgttctgtactaagaaaaattctcctgccttggaaaaaaaaaaaaaaacaaagatggttccactgggaaaacagaaaccatgctaagggatttctaacacgaagggtttaatacagaaaataggtgctttcaaaacaactggcaaggctatatagtgtgagcaaaagtaaagtgggctaactccccatctaattcccacagtcattgtcaagagtcaggaagctactactgccatctataggttaggaaactgcaaaaatctgctgccaatactgcagctgctctgcagccctgagacagctggccagtgggggaaggcagaagccactgcaaaaagtcacctcaaaaatctaagcccatgcacacccccaacatacactatggcctgaggaagaaaggttccacctcccttccacttgccacatttcccaagacacatgtcatagggcaaatgacacacagaagcctgctgccaggtggttctgagtgctactgctccagcattccagcctctgaaacccacggacaagcccagaagggagtgagtgggaaggtactgaatgcccaggctgtacctagcatgtcatttccctcttttcaaaaacatgcagaaattactgatctactgttacatctttcccctttttttgtccctttggttttacattttttatactcctttttagcaggcttttagcagggcaatgaagtaaccccataaggtaactccagaagtcctgaagtctagttcaaaagcaacttgactgagaatggcccagggcttccctaggggttactgaaactctcctcatacaaaggaaggtcacagcttttgagcaagggtggttattagctaactctctacttcccccacaaacacaaagagtttccttttttgagaggggaggaggttgggggaagggagagtgtcaatgaggacttgactctatatctatgattttttaaaaatttcttttaaaataaactagaaaaaaaatcacaagatttagcagtcattaattcaaggaagtaagaaaatacgtattacacattctttgtacatttttatgacttaatttgctcagaatctcaactttaagaacaattagaaatcaacctgcttggccgggcacagtgactcacgcctgtaatcccagcactttgggaggccgaggagagcggatcacaaggtcaggagatcgagacgatcctgactagcacggtgaaaccctgtctctactaaaaatacaaaaaaaattagccgggtgtggtagcaggcgcctgtaatcccagctactcaggaggctgaggcaggagaatggcatgaacccgggaggcagagcttgcagtgagcccagatggcgccactgcactccagcctgggcaacaaagcgagactccatctcaaataaaaaaaaaagaaatcaatctgctcaccctccagactgtgacacagcactatacaaggacaatcataggaccgtgagtcaaggagaagcagggtgagccttgtcagggcagtggcctcctcagcccacccagaacactcctaggccctaccaagcctcagggggcttgcacacacgggtcctcattgtcatgccttcactgctcagccctggtgcaggccaccactcgtaactttcggcttctatgagagattttatttttctgtctagggaaaacatatggcaaccaatgtaacttcaagccaatactcaagtgcaaagttgatgcctgctccatgccaggccatgtggtcaagagaaataaaacctactccttgccttcaacaagtcttcagagcgtggaaagatgaacaaggtggcaactatgagtgtggataccactatgttcagcgtgtgtaacaggacagttattacaaacaactacaaaagcaaagccaaatggcactttgagaacaacaaataaactctgcttccatttgaaagcaaaccaagaatcatctggttctctcttcaggaattctccaagaggctggatataaggtctcactctatgagtcagacaaggggaggctcccactcataaccacatggtcgtccccaggctgaccaaccagggaacttcagcagcccaagcactgggaagcccactgggaatccactttctctgggctttgaccccaaagacccaccagagaggctcccagacaaaggactgtcccagaggctcctgaccgggccaacaccatccaaaccctcatttggaaaggcaaacacctctaccagagacacgcataatctgatgaagaatgggctccagagatgatcaggaggggccccctctaaacagcattcttttctttttttttgaaacagaatctcactctgtcgcccaggctggagcgcactggcatgatctcagctcactgcaacctctacctcctggattcaagtgattctcctgcctcagctgggattacaggtgctcgccaccacgcccagctaatttttgtatttttagtagagatgagatttcacgatgtcagccagactggtctgaaactcctgaccttaagtgatcctgcctgcctcggcctccaaaagtgttgggattataaggcatgagccactgcacctggcttttttttttttttttttgcctttgagacagagtcttgttctgcagcccaggataaagtgcagtggcacaatcttgactcactgcaatctcctcctcccaggttcaagcaattcttgtgcctcagcctcctgagtagctgggattataggtgtgcagcaccacacctggccaatttttgtatttttattagaaacggggtttcactatgttggccaagctgatctcaaactcctggcctaaagcgatccacccacctcagcctcccaaagtgttgggttacaggtgtgagccttcgcaccctgcctaaacagcattctttacaggcaaatacaatctgaccagaccatctctgcttcttattttggaaccccccctcaaagaactaccacaagttcaaatgtcacctaatcccctacctaataccctggttggaatgaattggttttccttcagtactaagcctataggaattacagcacacctttcatgtcctaggccaagtcccactaaggaaggagaaaggtctctgccccctgggaactcatggtctggatggaaaaatcaagcctgggcaccaggaatggtgagaattaccaatggttctgatgctataagagagggacgaatgggggactggaagaagccaatctataaaatgagggaccacagacattctcccactggggtaacatctgagctacaccttgaaggatggtaaggcttgtctatgcagaaacagaacaagagaattccaggaaaacataaaggaagcacacatctacaagattattaatggggtgggcacaagaaacagcccagctgagccactgaaggggaagtagtgataaatcaggttggcaaagcagacctaaaccagcttgtgaaggagtctgcatgtctggccaaagcatttaagcctgtgattctcaagctggggtaagacacactttccccttagtggctttatcagcaccacctagtcttaaaaacgaattcatggatacatgtatatgtatgtctcacacattcacacacacatgcacaagtactcactacacctcccacccaaccaaagttgagaacaacggatccagtgaacattgttattcatggggtgccctgtattccttgagggtgctgaggcagaaaccaggtgaagaacctggttctccgatttagcctttttgtggcctttccatacatctttaggagactacataatggccaggagagaacctgtgagtgcaaagttccaggtgaatgagtgagcaggaggggagggcgtgccaaggccagtctaaaagagcacattcaggatcaagaggcacccacatccagagccaggatggggataaggtcagagaggtggccaaggtgccacccctcaggaggggttcacactcaagatcatccaagtccagggagtgcagcgcctccttaagtggagcctcctgggcatctcacgggcctccccacagccctgccatcttgcaagttctgggatctgcctaggttgggcacttattttttaaaaagacagaaagacagagagagaggaaggggtcggctcaaactaactttccaatgtgttaagacagcacacacctccacccctcacaagaggcacagtcacccagctacaacaaagagacaaggtggtgtgtaccccgcctactcaacacactcacctggacagttggcttcgtcgctctcatcctcgcaagtcgcccagccgtcacactgccaggggagggggatgcactggatggtgccgctgcgacacgcaaactgcccagggttgcaccgcagctctgtgggaccaaagggtgagaggccattgaggaagtggcagtaggccagcaaaccatagcccatgggctggatcaatctcttcccatttgtttgtttgtttgtttttgagacagagtctcattctgtcacccaggctggagtgccagtggtgcagtctcagctcactgcaaccttcaccttccgtgttcaagcaattcttgtccctcagcctcctgagtagctggaattacaagcatgtgtcatcatgcctagctaatttttatatttttagtagagacggggttttgccatgttggccaggctggtcttgaactcctggcctcaagtgatctgcctgcctcggcctcccgaagtgccaggattacaggcatgtaccactgtgcctggcccccatctgtttttaaaatcaggttttatcagaacacagccacaaatatgtattgtctatggctgctttcaagctacagcagccgagctgagtagctgcagaaaagactatatggcctgcaaagctgaaaacatttaatgcctggccctttacgaacctattacctagagataaaaactgtaacacttaagatgaaaagtacgctgcagaacattaacaggttagattttgtagtagaaaagattagtgacttgaagatataataatagaaacactctgaactaaaacacagaatgaaaaaataccaggaaaaaatgtgcaaatcatcagtaagctgtggaacaacctcacacaccctaatacatgggggaacagacacaacatctgaagaaacaatggggaaaatttcccaatttgatgaaaactataaacccacaaatccaggtagctcaatgaaccacaagcaccagaaatacaaacaatacaattccaagtcacattggaattgatttgcttaaaatcagcgataaaatcctaaaagcaggcagaaaaagaagacatgcacagaaaaacaaagatctagatgacagcagatttctcattagaaacgatacagcctagaagacagtgatgtgacatgttaaagttctgaaagaaaaagctgttgacctacaattatttaaagcaaacacacagatactgtattgtgcagtttatagcatacacagaagtaaaattttgacaatagtagcaccaaaggtgggaagagagaaacagaagcacactgttttaaggctctcaaactacaggtaaagtggtccatcacttgaaggtagtctatgataagttaatgatgaacccgactaaaataacacaagagttgtggcaagtaagccaacatagaagagaataaaaaataatccaaaagaaggaaaaaaaaaagacaaacagatggtacaaatgaaaacaaagggtaatatggtagattttaattaaacttgcctaatcaataaatacgcagaacgatctaaacactccaactgaaaggcagaatttgtcatgtagggaaaaaatcaagatacaactacatattacctaaaacaaactcactttatataggcataaataagagaaaataaaagaataaaaaagatataccatgttaacactaatcaaaggatagctggaagggcaggtacatggctcattcctgtcatctccataatcccagcattttgggaggctgatgcagaaggatcacttgagcccaggagttcaggaccagcctgagcaacatggcaaaatgccatctctctaaaaatacaaaaaattagccgggtattgggacaaacgcctatagtcccagctactcgagaggctgaggtgggaggatcacctgagcctggaaagttaaggctgcagtgagctataatcgtgctactgcactacagcctgggcaacaggagtgagactctgtctcaaaaaaaggctagctggagtgtattaatatcacacaaagtagacttcagtgcaaatattaccaggaataaagaaggtcatttaataatgataaagggattgattcaagaggacataatcctaaatgtttatgtatctattaaaatttacaaaagaaacttcaaaattcatgaaacagaaactactgtaactgctaatagacgaatccacaattaaagtcagagcttttaataaccctcttgatagaccaagcagatagaaaaccagcaagggctgggcgtggtggctcatgcctgtaatcccagcattctgggaggctgaggcaggcagatcacttgaggtcaggagttcgagaccagcctggccaacatggtgaatggacaggagttcgagaccagcctggccaacatggtgaatactaaaatacaaaaattagttgggtgtggtgatgcacgcctgtaatcccagcaacgtgggaggctgaggcaggagaatcgcttgaacctgaaaaaaaaggaaattacaaaagaagagcaaatgaaacccagcagtaagaaataataaagatgagagtggacattactgaaattgaaaacagaaaaatagagaaaataagaaaaacaaaagttgtttttttgagatcagtaatattaataaacctctagacagtctgatcagcaaaaaaaaataaagaatacaaaataccaggccaggcatggtggctcacacctgtaatcccaacactttgggagatgatccagcagatcatctgaggtcaggagttcgagaccagcctggccaacatggcgaaaccctgtctactaaaaatacaaaaattagccaggtgtggtggcacatgcctgtggtcccagctactcaggaggctaaggcaggagaatcgcttgaacctgggaggcagaggttacaggaagccaagattacacaactgcactgcagcctgggcgacagaacgagactccatcttaaaaaaaaaaaaatactactatcagaagagagatgtcatcactgtggattccagagaaagtataaaggctaacagaggagtgaagaataaggtaatagtatgaaaaactttatgtcaataaatctgacaatttggatgaaatacacaaattctttgaaagatgaaatgcaaagttcactccaaaataaataaacaatctgaacagccctaaaaggaattgaatttttagttaaaaatcttcaaaggaaactccaggcacaaatagcttcaatggaaaattcctccaaatatttaaggaagaattgatgtcaattctatacaaactctactgtaagttcaggtatttaaaaattaccattaacaatagtatcaaaaaataagaaatacttaggtataaatctaacaaaagatgtgaagtcctgtacactgaaaaattttcaacattgctgagaaaaaacattttttaaagacctaggtgcaaaggcagctccctgaagaaagaacaggcctttcaacagaatggtactgcgaaacacggaagaaagaaaaatgaagaggaggaggaggaggaaagaaaggaagaaggaaggaaggagttcatctacaaaatgaagttaaaaaaaggaggaggaagaggaggaagaaagaagagaagaaggaggaggaggaggaagaaagaggaacaaagaacaactactttgatccattccttgaaccgcataaaaaattcagaatagccaggcccagtggctcatgcctgtaatcccagcactttcggagcctgaggcgggtagatcacctgaggtcgggagctccgaaccagcctgaccaacaaggtgaaaccctgtctctactaaaaatacaaaattagccaggcatggtggtgcatgcctgtaatcccagctactcgggaggctgaggcaggagaatcgcttgaatctgggaggcggaggttgtggtgagccgagatagtgccattgcactccagcctgggcaacaagagtgaaactccacctcgaaaaaaaaaaaaaaaaatcaaaatcgatcataggcctacaggtgaagcctaaaactataaaactcaagagaagaaaacacaagaagaaaatcttcgcacccttggtttaagcaaatacctttaatatatctaccaaaaacacaatctataaaaaaaattgataaattggacttcatcaaaattgagaacttttgtttttcaaaagacatgttaagataatgcatagacaaaccacacacagagagaaaacatttgcaaatcatgtatctgataaagggcttgcttgtaaccagaatatataaagcatgctcaaatttcaataagaaaacaacccaattttttaaatgggcatgggccaagtgcaatggcttatacctgtaatcccaacactttaggaggccaaggtgggagcaacacttgagcccaggagttcaaaaccagcctgtgcaacataacaagacctcatctctacattacaaaaaaaaaacaaaaaaattagctgggcttggtgacacatgcctgtagtcccagctactcaggaggctgaggcaagaggactgcctaagcctaggagttggaggctgtggtgaactaggattgcaatgctgcactccagcttaggcaacagcaagacctccccaactctaaaaaaaaataataaataaaataggcaaaagatcttaatggtcacttaaccaaggaagatatatacagatggctagcaagcacatgaaaagatgctcaacgtctagtcattaaggaaatgcaaattaaagcatgaaaaggtggggcacggcggcccatgcctgtgatcccaacactttgggaggctgaggtgggtggatcacctgaggttaagagtttgagaccagcctggccaacatgatgaaaccccatctctaccaaaaacgcaaaaattagatgggtgcggtggcgggcgcctgtaatcccagctattcaggaggctgaggcagaattgcttgaacccaggagacagaggttgcagtgagccaagattgcaccactgcactccagtctgggcgacagaatgagactccgtctcaacaaacaaaaacaaaaacaaaaaaccatgaagagaaaccacttactagaatggctaaaatgaaaaagaatgaccataccaagtggtggcaagtgtgtgaagcaactggaactctcccagtgaaaatgtaaatggtacaacttctttggaaaacaatttgacagtttctttaaaaactgaatgtatacctaccatataatctgaccattccattcctaggtatttaaccaagagaaatgaaagcatatgtccacacaaagacttgttcatagtacttttatttgtaatatccaaaagctggaaacaaacagtgtctatcaagaagcaaattggtaagttgtgtacagccatacaatggaatactactcagcaataaaaaggaataagctattaacacattccgcagcatggatgaatctcaaaataattatattgagtgaagaagccagtatgtactcaaaagaatacctactgtatgacaacatttatataaaaatctaaaaaatgcacttgcagctatcaagacagaaagggatgggggtgggagggattacaaaggagcacgagaaaatgtttggggtgacgatacgctgtgtttgttatcttgactgtggtgacggtttcacagatttatacatatatgaaaactcaaatttggccgtgtgcagaggctcacgcctataatcccagcactttgggaggctgaggtgaatggatcacctgaggtcgggagttcgagaccagcctgaccaacatggaaaaaccccatctctactaaaaatacaaaattagccaggcgtggtggtgcatgcctataatcccagctattcaggaggctgaggcaggagaatcgcttgaacttgggaggcagaggttgcagtgagtcgaaatcacgccactgctcttcagcctaggcaacaagagcaaaattctgtctcaaaaaaacaaaaaacttggccaggcgcggtggctcacacctgtaatcccagcactttgggagaccgaggcaggcaaatcatgaagtcaggagatgaagaccatcctggctaacacggtgaaaccccgtctctactgaaaatacaaaaaattagccgggcgtggtggcgggcgcctgtagtcccagctactcgggaggctgaggcagaagaatggcgtgaacccaggaagcagagctggcagtgagcccagatcgcgccactgccctccagcctgggcaacagcgcaagactccgtctcaaaaaaaaaaaaaaaaacaactcaaattttacactttatgtatcatttattataagtcaattatacctcaataaggctttttttaactatcatgaaatagatttctgtttaaaaaatcaggaaacaattttgagatcaaaagatactgaccacaaggctaaaaatccaggcaccctgtgttctaggactagatatgcctggaactgaagaactaaattgaatcatggcccacctaacgtgcttgcttctctggaaaagacagccttggcctaccagatctcacccccgccatccatacaggagctaggtccttttcataattataaatccagggcttgccccatgactggtactgaagcactatttgatgagtaaatcagcaattgggacatgctcttctggcctaatgtctgtcttcctcagccacaattaaccattagaccaagaacctggaaccctccattcctcctcagtgtattctaggtcttcagttttattaaaaatttctaacttcttattattttgccataaaaatggaacatgaatggaactggaggacattatgttaagtgaaataagccaggcacagaaagacaaacttcacatgttctcattcatatgtgggagcttaaaaaaagttaaactcatggagctagagagtggagtagtggttaccagaggctgggaaaggcagaggtgagaaaaagaggttggttaataggtacaaaaacacagttaactatagttaataatggtttattctatacttcaaaataactaaatgagtagaatcagaatgttcctaacacaagaaaagttacaaatgcttgaagtgacagataccccaattaccatgatttgatcattacacattctatgcttgtatcaaaatatcatatataccccacacatgtaactactgtgtccataaagttaacaaaaaatttttttaaagactaatgcaggaaaaaggaaaaaaaaagccttctaatttcccaaactatactgagaaagagttcattcactgaatagagatttagcaacagaacattcttttttattttttagagatggggtcttactatgttgcccaggccagagtgcagtggtggctattcacaggcacaatcatggtgcctcaaagtcaaatgactctcccacctcagactacaggcctgagctaccccgcccagcagaatattttaacagtgtccattctattaaaaaaaaaaacaaaaaaaaaaaacaccctatggtgttgttcaaagtaaattcatagctcatgtcacagccctccaaatctacgccctaacatatcataccctaggcccagaaaaacttcaatgcactaccttaaattatttttggaaatagttgagtaagaagtaataagtaacaacactgggggttttctttctccatacccctatatcctccaaaagcaaacgtcagccaagtcttctctggcaaacaaggccccttcccccatgcaccacatccaccttgccttgccttggctgcttctaagtagtacttgtcactcctggcttcctatatatcagtatatagtaaacctatatatatatatacatatatagatatgtaagtgaaacagccaggtgcagtggctcacgcctgtaatcccagcactttgggaagccgaggcgggtggatcacaaggtcaggagttcaagaccagcctggccaagatgttgaaacctcgtctctactaaaaacacaaaaattagccaggtgtggtgcgggtgcctgtaatcccagctactctggaggctgaggcagagaactgctcgaatccgggaggcggaagctgcagtaagctgagattgcaccactgcactccagcctgggcgacagagcaaggctctgtctcgaaaaaaaaagtaaagcttcctgagggcacaggtcatgtctgcactgttcactcctgtgttcccagggcatagccgaccacacttagtgtccataactcaaacacacttgaagaatacttcttctctccatactctatgcatgtctgggaaaggctccaaaggcccaaacagccttcctctttgagaagtgcccatctggccactccatgagtgccacctgccctgccccaggctgggccaatgagaagagtctgtaaggtgatgggagtgggaagatccaggctagccagactgagacagtcacttgaagttctgtgcaccctgaggcagaaagaggtaagggctaagaccagaagggctgagaaaggggagcaacacccttcacagtcccatgaccccaaggatggctgtgcttcctccctgggctcagggaaaagttcctcctacagctactccttacaaccagacagctctggctaaaatagcccccacacggattttctgtccttttctttctttctccagacttttaaaaaaaaaatagttatcaaaagaggaaaaataagctatcagcagaatgactgtcttgctacatcctgaacacagctgggctccccactgctgggccttagtccatggcatcccctctccccaggtctcaagacacaccactctccaggaacccctccccaaactcccctaactgagtcggccttcttggcctagccctgttttcctaagcagcccttctctgttcttttcttcacaccctgagtagggtcagcacacttttccttcaagggccagatgataagtatttccaggtggccagcttcacaggccaccctctctctgccacagctgctcaaccctgctgccgtggagctaaagcagctgcagataatatgggaatgcgtgggcataggcatgtccaataaagctttagcgaaaaacaaaaaaaaacagtggccagttgcaggtatagtttgccaaaccctgttctcgagtatacatatagggacattttacatacatgtaaatgttttgttttttgagacagggtctcgctctgtcacccaggctggaatgcagcggcatgaccacagattactgcagcgtagacaccctgggctccagtgatcctcttgccccagactcccaagtagctgggactacaggcacataccaccatactcagctaattttttattttttatttttagtaaagacaaggtcttgctatgttgcccaggctggtctcgaactcctgagctcaagcaatcttctcaccttatgctctcaaagttttgggattacaggcatgagccactgtgtctggctgagggacacatctttattgctgccccatactccatgtcaccaacaccccacacatggaggcatgcactaaatgcctaatgaactgcacagctcaaaatcttcccatattctgctagcagacaatgaagtgtcagaagttctccaatagggaaggtttttctcccttcttgatccatctgtcaagccgggtctattctggaagcaactgaagatgtggatcactcattaacactggcacctactctgtgccaggcagttctccaggtgacagggctgtggtaatgaacaaagaaagtcaattccaggacatgacagagcttgcatccagcacagcacaccagatggtgactccaacaggtcaaactggcattgctttagctggacatcaacactgcgtttccactgactacgcgtggtgactcacgcctgttaccccaacactttgggaggccaaggcaggtagattacttaagcccaggagttcgagaccagcctggccaacatggtgaaatcccagctctactaaaaatacaaaacataagccagatgtggtggtgtgcatgcctgtagtcccagctactcaggaggctgaggtgggagaatcacctcagcctgagaagtcaagactgcagtgagtcacgatcacaccactgtactccaacctgtctcaaaaaaacaaaacaccaccaccaacaaaaaattgcctgtcctttctcaatatcctccacagtctctctgtaaagcagtaagtgcaacttctgccacatacaaagttgcttaaaaacagtcacccttggccaggcgtggtggctcacgcctgtaatcccagcactttgggaggccaaggcacgtggatcacaaggtcaggagttcaagaccagcctggccaagatggtgaaaccttgactctactaaaaatacaaaaaaattagctgggcatggtggcacatgtctgtaatcccagctactctggaggctgaggcagagaatttcttaaacccaggaggcagaggttgcagtgagccgagattgtaccactgcactccagcctggacgacagagcaagattctgtctttaaaaaaaaaaaagtcacccttgacccagtatggtggctcatgcctataatcccagcactttgggaggccaaggtaggaggatcacttgaggctaggagtttgagaccagcctggacaaggcgaaaccctgtccctactaaaatacaaacattagctggacgtggtggcacacacctgtaatcccagctactcggaaggctgagacacaagaatcgcttgaaccggggaggcgaggttgcagtgagccaagatcacgctactgcactccagcctgtacaacagaacaagactctgtctcaaaaaaaagaaaaagaaagtcaccccttttcactgatggctttacaaggtcctgtcccaggccttctggtgatgactgtcaccttgctgtagcatggcagaggcaggccagctcctcttagccaatggattgttgacactttatgaaacaatccatgcccacaacataccagccacagtaccaacataaggacagccccatcctggctaacatggtgaaaccccgtctctactaaaaacacaaaaaaattagccggacgtggtggtgggtgcctgtggtcccagctactcgggaggctgaggcaggagaatcgcttgaatccgggagacggaggttgcagtgagccaagatcgtgccactgcactccagcctgggcgacagagcgagactccgtttaaaaaaaaaaaaaaacctgccacatcagcagttcctagacttcttcattctaagacaccttaatacacttaaaattattgaagaccccaaagagcttttatttatgtgggttatatctgtcaatatttactgtatcagaaattaaaactgagaaatttggccagacatagtggttcacgtctgtaaccccagcactttgggaggccaaggtggtcggaacacttgaggtcaggagttcaagaccagcctggccaacatgatgaaaccctgtatctaccaaaaaatacaaaaatcagccgggcgtggtggcacgctcctgtagtcccagctactcgggaggctgaagtgggagaaccacttgaacctcggaggtggatggtcctttgcagtgagccgagactgcgccattgtactccagcctgggcatcacagcgaaaccctgtctcaaaaaaaacacttgagaattttttgaacacaagaatctgaagcacctgctcaaaggttttaaccttttaatagaattatcaaatgctcacgattccactcataggcatgtactcaagagaattaaaagcagagactcaaacagatgctggcacaccactgttcccaacagcattattcatactagccaagaggcagagacaacccaagtggccatgacagatgggaggataaataaatgtggtatagctctacaaaagaatattattccaccataaaaacaggaggcatgtagtaccccatgggcaaccaagtaatggtgtattgtgtcgcttcaaaagtaaatgtggggcctggcatggtggctcatgcctgtaatcccagcactttgggaggccgaggtgggcggatcacctgaggtcaagagttcaagaccaccctggccaacacggtgaaaccccgtctctaccaaaagtacaaaagttagctgggcgtggtggcgcacacctgtagttccaactacttgggaggctgaggcacaagaatcacttgaaccagggagatggaggttgcagtgagccaaggtcacgccattgcactccagcctgggcaacaggagcaaaactgttaaaaaaaaaaaaaaaaaaagtgaatgtgggccaggcatggtggctcaccacactcgtcagtaatcctagaactttgggaggccgaggcaggtggattacttgaggccaggagctcaaggtcagcctagccaacatagtgaaactccgtgtctactaaaaatacaaaaattagctgggtatggtggcacacgcctgtaatcccagctacttgggaggctgaggcacaagaattgtttgaacctgggaagcagaggttgcagtgagccgagatcgcatcactatactccagcctgggtgaaagagtgagacaaaaaataaaaaacaaaagtgaatgtgatcagccatcagccataaaaaggaagaaaattctgacacatgctacaacatgaatgaacctggacaacattatgctaagtgaaagaagacagacacaaaagaggcaaatagtatatgatttcactcataagaagtacctacagtagtcaatttaataaggatggaaagtagaatggtggttgccaaggactaggggtgaggagaatagggagtattgtctaatgggtatagtttctgtttggattgacaaaaaagttctggaagtgggtaatggtgctcgttccataacattctgcatgttcttagcactgctgaattaaccgtacacttaaaaatggttaaaatggggccgggcgtggtggctcacgcctgtaatcccagcactttgggaggctgaggtgggtggatcatgaggtcaggcgatcaagaccatcctggctaacacggtgaaatcccatctctactaaaaatacaaaaaattagccgggcatggtggcgggcacctgtagtcccagctactcaggaggctgaggcaggagaatggcgtgaacctgggaggtggagcttgcagtgagccaagactgcaccactgtactccagcctgggtgacagagcgagactccgtctcaaaaaaaaaaaggttaaaatggggctgggcatggtggctaatgcctgtaatcgcagaactttgggaggctgagacaggaagatcgcttgaagccaggagtttgagaccaccccagacaacatagtgagacctcatctccacaaaaaatagaaaaatttgccagacacggtggcatgcacctatggtcctagctactccggaggctgagataggaggatcacttgagcccaggaggtcagggctgcagtgagttatgatttgattgcaccactgcactctagccttgacaacagagtgagaccctgtctctaaaaaagataatatggtaaattttatgttacatatatcttaccacaatttaaaaaagaaatgaaatactaacacatgctataacatggatgaactgcgaaaacataatgctaagtgaaagaagccagacacaaaggacaacatattgtatgattccattagtatgaaatatctagaatgggcaaatctatacagacagaaattgccaaaggctgtgggcaggggaattggggagttactgtttaaaaagtatagagttaccgtttgggatgataaaaaaaaaaaaaagttctggaaatgggtagtggtgctggctgcacaacattctgaatgttcttaatgccactgaattgtgtacttaaaactggtaaattgtatgtgtattttaccacaataaaaaaagttcttttttttttttttttttttttttttttttttgagccggagtctcgctctgtcacccaggctggagtgcagtggcaagatctcggcttactgcaagctccgcctcccgggttcatgcccttctcctgcctcagcctcccgagtagctgagattaggcgcgcaccatcacgcccggctaattttttgtatttttagtggagacagggtttcactgtgttagccaggatggtcttgatctcctgacctcgtgatccacctgcctcggcctcctaaagtgttgggattacaggcgtgagccaccgtgcccggccaaaaaaattcttaaaaaaaaaaaaaaaaaaaaaaaaggccaggtgcggtggctcatgcctataatcccagcactttgagaagccaaggtgggagggtcacttgagtccaagaattcaagaccagcctgggcaacatagccagaccctgactctacaaataaaataaaataaaaattttattttttattttattatgaggtgagagtacctcttgaacccaggagttcaaggttacagtgagctatgacccagccactgcaatccatcctgggcaacacagtgaggcactgttctttcaaaagagagagagaaaaaaagagagaatcccaagcatacatcccattagctgtcagagcaatgatgtcatcacatatcaaatagtgtctggaaatgctaccttatgcttgtgaggatgagagaaaggcaaatgacacctcagtattatcatgaaaacagttttgacctcacggagcccctagaagggtcagggaacccccagagacccctgggcacacttggagagctactgctttgggctatgcaacgcccaggaattagtggattcatgccctgtagaaacccacgagtctctgcaatacaaattctttctctagattcaatttctcctttgtcagcaagccttagccttgtttcaaggctgtctcaaactgagctgtctcaaattactgtgtgaaatttagtatgctgcataaattgtttagaattgatttctcttcaacatttgcccacaaagaacaagagggagacagagtactagcagaagcacacatgtccacagttacatcactaagaaaatcaaaacatttccagcaaagaaatgcaggagaaattccagcccatctgctcgcactactcacagcccactaagataggtctccaccagagcagtctgagacccatcagacacagactcccacacccggggtaggggacacccatgccctgctggagtgcccagaacagaaggttccagcatccctggcaggcctgctcacacctggcagtaaagccttactgcacattctgtcttggaaagagctggcagctgcttcccagtggggctttcccacaggtcatttcaccttccatacaagttgctactaggaaagggagatttgtccagcacacttcaaagcagcagcagcagcagaggggagaaggtttggaagccaagggctggctgggctattgtaacaggcgaccacgcatctccaggagaccagaggtgtggatgctgggttctgccctgggccagccatctcttctccagatgccctcaagaagggacagagggccgggcacggtggctcatgcctgtaatcccagcactttgagaggctaaggcgggtggatcaccggaggccaggaattcaagaccagcctggacagcatggcaaagccccatctctactaaaaatacaaaaattagctgggcgtggtggcgcacacctgtagtctcagctacttgggaggctgaggtggggagaattgcttgaacctgggaggcagaggttgcagtgagccaagatcatacaactgcactccagcctgggtgacagcatgagactccatctcaaaaactaaaaaaatagggaggacagagaccactgttgatagcacaactaaaagacaaaacagagggcatattgctcggtgaccttctaaatggaggggtcacctctgtcctgaggcaagagtgaataataagggccttgaatggggcctcagagatggccagcatctgagccaccaggggccatgggcaggcctctggcaagcacccattctgaacaggtgctgcccagtggggaagggagcgatgcacgctctggaaggcacactgtactccggggccccagagggacttcgggaccagatagcttcatgggatgtgctataactccagaaagggacgcggctggcgatggaggagtgcatcatcagaacaccaacctgcgtcagacagagagcagacctgggagggcagagctaggaagtgaggaaaggcaggacctggcattccaaacagtgcacagaccatcccagaaccaactgtgatcacatcacaaactccctgccttctctacagtgctcaaatgccatctgcccttttatggagtccaagggccacctctaaccttcccgcaaagccccacatccaggttcttgggggtcccggctcaccagtccctgcagctctcccctgaagcccgtctagccccttccccatcgctgccactgccccgtagcaccagcaggccagcacacaacctccccacccctgtagcttcctggaaccacgcagggagactggcttggaaagacgccccagagatccgttgcgagacaaacagcaggcttcagctcctggcccgtgcaaccctgctcagcctcgccaggctgcttcctccatctgtaaagcatggaggtgaccatcctgccctgcctatccctcctgacttccacggaggtgatgaggcccaaaagagaaaattactccaacaatgctcagctgctgaagtttcacatatgccacccttaggaacaatcctgggaggtcctctgcagagataaatgctctgagagggacccacaagggcaaagagaggatgggaggcaggaaccatggccaggggttctgtgcagtttgacctgccactgcgtctcagcagcagggggcagtgaagactgctgatacctggaggcctgagcatcctctgtactggcagccaccaggctacagcaccaacgatgccagcatctgaacctcaagccacaaggagcccagaggccagccggctcctcacccatgagggcccagagttcaaacgggaacaagacatgtgtggctcatggaaaatgatgagattggaagtttcattagcaaaatgtgaaggaaggcccgaagctgttctatgtattgaaacccccaactagtccagccagctagcttctcagaggggctgacccgcctactcagtgtcccacatcaagttggcagcagcagaatgggcatcagaggtcaggctgtgggctctttgacccaaatccccatccctgaagccagcagagcccctgggtggggctctgcattctgactccctagaggaccaggtccaaactttccagttctgagccatttccttcaccgagacagcagtcagcagagcctctgggggctcactgcacaaagcccagggataccagagccccaccaccagtctggtgcagagccaaggatgtaccaacatattgtactttttttccctaccagtggccagttactagaacaaaatattttacacctgcaaacactcctgctgtggttttgaaatatgcctgcaacttctttgatatggctccctaaatggcagtagctccccaaacacataaccaccaaacccatttccaaacagcccccggggcaagtggaatctctgagtgaaggctccaccctcagtcactcctcccctggaccctggagctcctgactccccatcaccaccactggagacaggtggccagctctcctgcaacagtggagagggagtagggttgccaagcgctaggggagtgccagccactttctcccacagcccaaggggtcacaacactgacactggggaacaccacacaagaacaaagggacaaggcctatgcttcagcatttatttctcataaataacaagcattttctacctccaggagaagaagtgatcaccacctgctaccatctatctgtagatgctgtccaaccaaaacactggctcagctgctctgccctgtggcttctccttaggcagatgtttgggaaagaaggccctgtttaaaataagttatcctagaaaagaagggaaggtcctaagaaaaaggaagggatcatataagatgaaagaagagaaaggcaggtccaccaagcatacctattccatgagtgacactttcaagaaaagaacagcaacttgcaatcagtccttatttcatgggggttcgggcaggaggggctacatacttgggaataagaccagggcaggagggtgggacagaactggagcgagagctatctcgcatctgatgtaaacatcagccagcagtttcatccaacactcgcaccacatttcgatcatagccacaggatagcgcagccaatttctctaagagaaagaacagctgtagtcaaatcagattcctgaatgctcattttgcatgtgccaggcagtatatcaagtgcttagaatacattattatgaatccttaagacaactcatttgctccttccatgaacaccgccgtgtacctcctaggggccaggtgttgtacaggacacaagtgagaagagcaggaggagaaccataaggtgtctgcccccacgaagctcagattttactagggaaggagaagaacttcgtaaccttggggtaggcaaggatttattagacaaaaacagaaagcatgaccataacaagaaaaaatgataaatcagacttctttaaaattaaaaaagtctttgatcaaaagcttagtaaagatacacagaccacactgagcacagtagctctcacttgtaatcccaacactttggaaagctgagacaggaggatcacttgagcccaggagttggagaccagcttgggcaacacagggatccagtctctacaaaaattaaaataaaaatattagccacatatgatggtgaacacctgtggtcccagctactcggtgagggtgaggtggcaggatcacttgagccagggaggtcaaggctgcagtgagctgtgatcccaccactgtactccagcctgggcaacagagaatttatctaaaaaaaaaaaaaaaaaaaaaaaaaaaaaaaaaaagatgcacaggccaacagaacagaatagaatacagatctcagaaatagacctacacaaatgtagtcaatggattctgacaaaggtacaaagacaattcaatggagaaggtataacctttcaacaaatggtactagacagttggactccacatatcagaaaatgaacctcacactttgggaggcggaggtgggaggattgcttgagcccaggagctcaagaccagcctgagcaacaaagtgagatctcatctttacaaaaaaaaaaaaaaatcaaaaaattagctgggtgtggtggcatgcatttgtagtgccaactacatgggaggctgaggcaggaggatcacttgaacccaggaggtcaaggtttcagggagttacgattacaccactgcacctcagcctggatgacagagcgaaactgtctcaaaaggaaaagaaaaaaaaaacctccttaatcatcagggaaatgtaagccaaaaccacaataggctatcacctcacccattaggatagccactgtcaaaaacaaacaaacaaacaagtgttggcaatgatgtgaagaaatcagaactcatgtacatcgttggtaggaatgtaaaatggtacagtcactatggaagacagcatggagtttccttaaaaaattaaaaatagaattaccatatgatccagcaattccaattccacttctgggtacatacccaaaattaattgaaggcaaggtctcaaagatatattcatatacctatgctcacagaagtactactcacaataactaagaggtggaagcgacccaggtgtacactaaataaacaaaatgcagtatatgcatacagtggaatacaactcagccttaaaaagaagttctgacacatgctacaacatggatgaaccttgaggtaaaataagccaaacataaaaagacaaatactgcatgattctacttatatggagtatctaaagcagtcaaactcttagaaacaggaagtaggacggtggttgccaggctggagagagagataaaagggaggggtagttactcaataggtactgagtttcagttttgcaagatgaaaacattctagagatctgttgcataacaaggtacatactctggcactactgaacactgaatgaactgaacactgaattgagtggttatgatggcatattttacgttattaaaaaaaaactgcggtagcagtggagccgcctaaccctgaaaagcacatataaaatacggagggatttaaagtcctaaggataatattacaactgaatgaagtaactcctgcaagaaagcaagactagaaatctgacgcatctaaaaggagactgagcctacagcccagccatgggcaggcagttctgcccagttcctcccttgtctaacagagtgggtccaaactttagtgtgatcaccacagggagttacactcacaaaaagcacatgtcctatcatatggggtctttaaagaacattcaaaggaaacatttgcagtctgaaagcttcatttcctgctcttatttcaaaacctaagttgaacacaagatttaacacacgaaaaactctatccaaaaaacggggttacagttaaggttaatggagctattacatgccaagtgctgatgagggtgcctgatgctcagaaatggggatggggtggcagtgataagacagcatcagctaagaaccaaggcagggactgcaggaacaggctgcggggaagtgtcagcttcctgggggcatttgtgtggacacagcaggggtgggccctgaggagtcagggctgcggcacctggagcctgctgaagctatgggaagaagacaagaaaagcagggtgggtgggaaggttcacattgaaaaggcgggaggagagcattaggacaaatacctaatgcatgcggggcttaaaacctagatgacaggttgttaggtgcagcaaaccaccatggcacatgtatgcctatgtaacaaacctgcatgttctgcacatgcatcctggaacttaaagtaaaataaaattaaattaaaaaaaaaaagaaaaggcagaaggagaaagacaaggagtagatggaaaaagagccagagacttctcttgaagctgtgcaatatcacagcatgaactctatgctgcccatgtttcaaatacccactccatgactttaaaagctgtgtgactttggctaagtcacttagtctcccaagctctgtttctctatctgtaaaatgaggttaatatgagtaaacctacttcctataaaaagacatcacatctcatgctgcaattataaagcagaaatatgcaacagcattaagctaaaatttcatttaacttttttgtgggttctaagcattttagatctattttttctgttaagtagtatgttttatattcagttatacacatttttttccttttaaaataccttttcctcatcttttactttcatgaatgtttgttaagaagtaatacatccacacggttgaaaacccacaaagtccgtccatacaaaagaaggtgacactctaataagcctcccaagcttctggaaacacacaggtagatttgattgcaatcactgtgtggtgagatcacagagggtggtcaccagctggcctgaattgatcacccaagcccaaagagacatcacagcatcagtgtccacacaagatgctggtgcagtcagaactgtgaacactagcgatgcccaactcagtgaaaaggtgcccggttcttaggcaggaggccccaggtggtggcgctccacttagctccctctgccatacagctctttcatcagcttttggaatcatggtgcaggaggcaaagcatgtggctcaggatagcagtcctgagtttcctgttcttgcttctacttaaaagctaagtgatgccaccaagcaagctaattaacctctctgggtcttagcatcctaatctccaaaacagacctaccacctgcctcactgatcacccctccacaatgagtcttgtcaggtaaagggtgtgtagaactatacccaaactcccaggccaacctcagcccctgcttcagacagctcccccataccactgcatacccaaagactatcagagcacgaacccaagctatcggatggagaggaaacacaaagggtgatggctggtggaatgagaccctgttaaaccaacaagctcacaatgtcagcacttgggcccaaatagcccttgaacatctaaactcttttttgtttttattttttatttatttatttttttttgtctccaggaagaaactgaaacttaaaaagtgatttaccaagagttttgacaaaagtacatcaacgaaggctcaggactgtcagaaatgaaaaataattatttttaaaatatctatttattggctgagcatgatggctcatgcctataatcccagcactttcagagatgcaggcgggtggatcacctgaggtcaggagttcaagaccagcctggccatcatggcgaaaccccatctccactaaaaatacaaaaattatctgggcgtggtggcacgcacctgtagtcccagctactggggaggctgaggcaggagaatcgcttgaacccgggaggcagaggttacagtgagccgaggtcgcaccactgcactccagcctaggtgacacagcaagactccatcttttaaaaaaaaaaaaaaaaaacctaggaaaataataaaaccgttcaaaattgagatgcttccttaccaattagtgtaatgaaagaggggcttgttataaatactgaggttacagtaaataccactctcaatattatttaataaacatggtttcaaatcaaaacaggttttttttttggttttggtttttgaggcaggtcttgctctgttgcctaggctggagtgcagaggcatgatctcagctcaccataacctctgctcactgggctcaaacgatcctcccacctcagtcccctccaagtagctgggactacaggcgtgtgccatcatgcccagctaatttttgtagtttttgcagagatgccatattgcccaggctggtttagaacttctgggctcaagcaatccacccacctcagcctcccaaagtgctggaatttcaggtgtgaaccacccggccctgcctcaacacagttttgaacctaactgtgtaacaatcacatggaagagagaagagaattaatccaagtagcttttgaacccaagaaccttgagtatacaccatcaatctgaaaacacaaagagctaaaaaaaattaaattaaattaaattctacttaataggtctgctgttactagtggtgcgaatgcagtacttctgaaactattctgggtgcagtgtaagactaagcaaatgagtaaacctactgatgctgttgggagccagggttctcactgtagaaaaagagagaaacaaacatgcaacagagaaagcaagcaagaacctggaacgctggattagaactaaagaaacagtatgggccaggcacagtggctcacggctgtaataccagcactttgggaggtggaggtaggcagatcatgaggtcaagagatcgagaccatcctggccaacatggtgaaaccccatctttactaaaaatacaaaaattagccaggtgtggtggcgcatgcctgtagttccagctacttgggaggctgaggcagaagaatcgcttgaacccgggaggcggaggttgcagtgagccgagatcaccccactgcactccagcctggcaacagagcgagactccgtctcaaaaaaataaaaataaaaaaaaaaaaataacagtatgaacttacacaggcacagacacatgcacgtatgcacacacctcttgggctagactgaaaagatggagtcgcagcatactctagtagctagcaataaacacatctaccaccaaaatcctgctttctaaataccatctcccaccaaaaggaaccagcgctctgtgggaaaatgccccattccagtgtggggcaggtaaggtacaagatgtgcctggtaaaaaggaatttcaagttgatggaaacatgtcagaaggcgacacgctcccatcctgaaaaggccaggtgaaggggtttccacttgccaagtcaacctactgttatgtaggtttgaaatatttccaaagtaaaaagatttctaaaaaagaatgagttaggccaggcacagtggctcatgcctgtaatctcagcactttgggaggccaaggcagacggatcacctgaggttgggagtttgagaccagcccagccaacatggcaaaatcccatctctactaaaaatacaaaaattagccgggcatggtggcagacgcctgtcatcccagctacttgggaggttgaggcagcataatcacttgaacccaggaagtggaggttgcagtgagctgagattgcaccactgcactccagcctgggcaacaaaagcaagattccatttgaggaaaaaaaaaaaaaaaaaaaaaaagaacgagttaagacaatcttgccccgacccattcccacctttcctctccatcttttgttaccaaaggaaaaaaaaaaaaaagaatgaagttatatatgcactgatctacaaagatctcaaaataagttaaatacaaaaattaaataaaaaatataattccatttatgtaaaatattctatgtatgaatgttagcaaatgtgaagaaatatcaactttattttttctagattgtccagacaagatcttctacacccttgggctctctccatgccccatggcttaccatgctggtctagcaggcatccttcgcaaatagggtagatggggaaatccgaagagctgctcccactgtcaggagtggccaagaaacctccaagaactgcagcaaaggcctgccatggcccccaacaagcctctaactcttccaggtcctcttattctaagaccatagacagagttctgtaggtaaactaatctacctggaggccctaagaagcagccagtggcaccggagagacctctgcatcagcagacctagtttcaatggagcatctggcccggtcctgtggtcagtctcctgctgatcatccctgtgttgaccttctgggtccctctgctgtgactcctgcccctcatccagtgccctggccagccacaaacaatcctctccacaactatgaactcctaaggaaggtttcccagaaaatgagacttcccaggcaaggaagagggcagggtctacctgggggacccttagtccaccatacccaccagaatactgtcctcagtactgtcctgtccaacagtagcagccaacagctgaaggatgacagactaaccaaggaagacaagctaaccaaactgatagctgtctgccattttgccagaggtcagccagaagtcagcctacagggagggacctgtaggggacaagggcactaagaacaatgaccagctcagagtgactgaagcaacagctaccgcaggcagaggaggaggagaaggccaagaggcaagcatgtgcagcccatgcagcccatgcacccagccagctcttgaccagaaacaagccctgcactgtgcaaacaacccagggaaggtccagccacatcctcacacagggcagtccagttctcaaagccaggtgccagcaagtccatcagagaggcagctccctcagcaccggcttgctggggtccctccctctgggagcccctcaaccctccaccccaggctgggcagctggtgagcttcagtgaggatccacattaatgagaagccacacttgctctcacctctcagctcagctcccatcacagaagcaagctcctaccagggtggggcccaggccagctggctccacagccatgtcccctacccccggatcccatcctcccaaggcatttttgcaggactgccacaaggctctcatcctcctcgccacccccaccagaggcagctgcaaggcctgctggctaaagtagctgttgctctttatgtcaaaatataaataggcatttgtgcatttgttcaataactgatttctgagtgcccagtctgtgcctgaccaggcccaggtgacagagcatgaatgtgacaaagagcaaaacgtgtatgaacaatcccagccctgtccaaagcaccatggctgtttcgggggctctcagcaagtcatacgcagtccctctgatcccatcataacagcaaagagcactctctgtgtggcagacactcctcagagccactgtactctgccacctcctgagggagctctctcccgaccaataagccctgtgcacaaaccacctcacatttcacatttcagttcagggttcctgaactctatctgtgattaacactaacattttgcctgatgaagagtttgctttatgtcagacactttttagaattttatacttacccattttaatcctcacaacatctctataaagctctgttacgatgtccatgttccaaatgaggaaactgaagagtgagcagtagaacagattgagcctaggcagtgtggctctagagcccatgctcttaagccaccatacccaactgcctgccatgggccaggatgagaaggcttgatctaatcccagctgctacttttacagacagctcatttgaggcaaaaccagacctgagcttccccatctcccaggaggatgcccagaaggtccagggcatctgggtccacaggctattcaccctccaacctagacttgccctgccaagcccgccatgtccacactgacaggacacacagcttggaatggcaggatgagatggactggctttgactaaacttcccaggacaactggtaaatcatgtcagaaacacaaatacaggtgttacacagctatcacataataaccatacccaagcccatgcatcactctgctcaatgaactgttggcccaaaactggtctctcgggattaccgagcccactctgcagactggcagtgaaagaaaggaaagaggacggtcatcaaaacctcagcacccaaacataacagcacataagagaaaatctaatagcataccaaggaaaagacatctaatcagtcaagagctatctacggggtccttaaatgttgtcactgatgcattccacttagagtcaagaaactactaaatgccaatcgggtcgtccttatgccaacaaccaagagaggcagaggaactccctgcctgtcaaaggctcaggtccagcaggagagagtcaataactagatcacctgccatcagtgttgagaggatgcatgcactactagatcacctgtcatcactgctgagaggacatgcacacaaccggatcacctgccactactgctaagaggaaacatgcataatgagatcacctcccatcacctcccatcactgctaagaggacacctgcacaaccagatcacctcccaccatggctaagaggacacgtgcacagctagatcacctgcccttactgctaagaggacacacacagatcactcacctcccattactgctaagaggatctgtgcgtaacaagattacctgccgtcactgctagaaggacacctgcacaaacaaatcaccggccaccgctgctaagaggatataatcactcagtactctgggaagtgggaaggaaggggtggggaaagtgcccacaagctagcttgggaagtggagcagcgaaggcgcagcctaacacagcacaaatcttccacaacagcagtcttcattcctaaacccagaaccgccaactaaaacaataaccctgacatgcagtgatgccagcttgcctccacctgggccaacctgggctttaactacagggcttcctgcacccatgagaccttcccacgtgacacagggcttggcacatagcaggtgttagtgagaacgatggggtggggttaagtgggagcagcctctactctctgcaatggttaacatgtacaaggataaacggccatggcgcatacaacttattctcaaatggttcagaaaaaagcaatgtgtgtgagtacacagatatgcacatacacatggaagatgagggataaggcaaataaggtaaaatgccaacagtagggaagcctcagcaaaggatatgcaggtgttctctgcactcactttactcttgcaacttttccgggagtttgaaattatttccaaataaaagttttctttttgtcaagaaaaaaaaggaaaattcattagctagtgaaggtagaaagtatattacatcactttccaactaaaaaaaatgaacctgttaacccaaaagccaaatctaccagtggacaaactctacaaagtgtcacagtactggctacagaggaaagcactccaaactcaggaggatttggcaaggctaggtgcaagctcacctctccagctacttctgaacctcggtcacttttccttgtgatgaaaatatgcactctctccctatgcaccaaacccctgtgctacttcacatgaaagaaaactctggactccagccggggagaggtggctcacacctgcaatcccgtaactttgggaggccaaagcaggtggatcacttgagcccaggagtttgagaccagcctacatggccaacatggtgaaaccccgtctctactaaaaatacaaaattatcccagcatggtggcgtgcgccgtaatcaaagttactctggaggctgacacaggagaattacttgaacccaggaggtggaggttacagtgagctgagatcccgcaactgcactccagcctgggtgacagacagaaactccatcgcaaacaaaaaaaaaaaaaaaaaaaaaaaacaactctggactccagagccaaggtgctgtgttcacttctcagctccctgagatgtgatcagctcagcacagctgcctactgaaagcaaaagagaaagaaccctgagctagcagccagctccacctgggtctgaacccacgctctgctgctcaccagctgtgtgaccttagacaagtcacttgcctctcccagctagctgtaccaacaatagaaggaagacgaccttctagtcctctaccttaccaaggggcctagctgagcacaggccctgtacaggaccaacaaccagcaggaagggaccagggtgcaccagcattcagaaggcaattttttctcagctatgtatggtgggttcaacctggatagagctgtggctcatgatataattttgtttcacaattaaagctagaaagaaaaacagttttagaatcagcagtcgatgctgccttctctacacagatggagaaagggccaatgagacagtatcacaatcagtggtccccaaatccccccaccatctcgctgtcagttacctcagcagtagtctccaaccgttcttcctcatcacacccccagtgatcataacacacatcatcagtggtcacatggccaaacacagaagggatttggcagagggtgagtggttctgtccctcagactggagtatccacatggaaaaagattctgcaccctcacctagaggaccctgggacctaacaggggacagaggcagtctgtggctccacctggggttaaggaagctgttcagagcataatatgaggtactcctgtggctgggctggagacacacagttggagtgcacagaccccagtcacgggtgcatgatggggggaaggccagactcctacgatgaaatctcatctcagccttagcttcatgagtgctctggatttcagcttccccatctttaaatgaggctaaaaacagcatctagcagggacctcttgagagttaacatatgttagtgcttagaacagtgtccggcacatgacacatcttaaatcaagttcaaatgtgcacttaaaaaaaaattgctgggcatggtacctcaggcctgtaattccagcactttgggaggccaaggcaggtggctcaccagaggtcaggagttccagaccagcccggccaacatggcaaaaccccatctctactaaaaatacaaaaattagccgagcgtggaggcgtatgcctgtaatcccagctactcgggaggctgaggcaggagaatcgcttgaaccaaggaggtggaggttgcagtgggccaagatcacgctactgcactccagcctgagcaacagagcaggactctgtctcaaaaaaaaaaaaaaaaaaaaaattggtgaaaggtcaagtacagcaagcacttgctgccccataactccatgaaaggccttccaccctgccctgtaccagagaggaagcccaggtggcttggcatcatcttcagggaccccaccaggcaggagtcagaaaacaccctcctgagaagtgggctctgactgataccttcctcatactcaagtatgcttttaaggccggaatccccacagaaagaacgcagactaagaccagagaagccccagcctcttgcaagcaccagccaggcagatccctgcagcactctcaggaaggacacatggtgaatgtgtgaagaggcacacacgggcatacaaggaacacatcaggcccagaggcctgccctccctgcccagccaaagccaggaagccagctgcagctcccgggttctgcagggcaactcaagacgcctccaggggtagctgcaatgttctcatctggagagtcatggaatcgaaagaataagtttgctccctctaccagatccaccccacccatgccctactccgacctcagtgtgaggtctcctgtgacgccctcactgcttcacaggtacaaaaagatggccacctccacccacctctgggaccccacactccagggtattcaacacacaggagtgtgacaagtgacttacacctggcctctgttccacatcaggcactcctaaaaggaggggcttgttcttgtcacttggattccctagggatgggcagggggcaagcacccacaggcactttctcagttgctgctggccagttggcaggctatgtgaaaaggctggcaaggaaaaaggagtcggggacgtcagtcacctctatcacccaggcaggagatgctgggcctggaaccagaggcaccccaaagaagccaggcataatatggcctcacctgagcccggtgacctcatctgcaaaactgggactcaagaatcagaaaacggtgaccttctacctctctacacgtacatatatgttttctaaagaagttaatcacaagaatccacaaacccattggttctgacctccaagagcctatatgataccctcctccacaggtagcccttttcctggcttctgttcttaccaaggccaccccacaactagtcatcccgctgcccagagagcagccaaaagcagtgagcaactagctctacatggggagaccagagaagcatcactgaatctgtccaggttgagcaccggtcagggccttggccaccaggcaggcactagggaggaggcagacattccacatagatgacacaagcgcagagccaagaggtgcggtgtatctgggctgggagcctggctagggcacaggagagggccacacaccccgtgctcccacacccaggtcatcagagaagatggccctggcacttctgccttcatgggacctttcctccattaagaaatattaagagtcatgctttttcactgtattagtataaagatgactgtattaatatacatacgaaaacattttatttgacctaaaagttcattttttttctgctgactttaaaaaaaaataaaataacattcgaaggctactaaaagtaccgtgggcaagtgataccaggattcctgtgcctgatggatacatcggccctgcatttagggagtttgattttttggtgcagttcaaggggaggtacaccgaaataggtagaaaagggtctcctggttgccacggttctgattccccaccacagacttaagaacacactagctccgaggggagttccaaagcacggactcattcatcacatacacgcagcacggctaagggccccgcacagtggcgaggtctctgctcccgggacgctcgcgccggccacacaacgctaggctgactcctggtgcctcctctaggcccggtgggacctgaggacttccttagcgcaacgtctcactgaatgacagccacaaccaccgctgtccaggcgaggagtttccaggactgagaggctggcactaggccactgctgggaggacgtctgtgaaaccaggtgcccctgagagccactgtccccagcccgactccgacgctggactggcgagagggtgcgcccgtggcgtagctcctggccgccgccgctcccgggaagggcccagaggcaacatcctggacagcagagctgcacgaagtccgaggcgccgcgagcccaggtaagctccagcaggcgtccgcagagagtgccaggcggcccgcgagccaggccccgcccgcccctgccccaggcgcggcccctgcaggagggcgccgcgggtgaaaggaggtcccggggcgaccccggccccgctcgccgcccagcccccacaccgcccccatcgcgcggcgcacctggccgcagcggctcggtgacagtgagcacgagcaggaagagcagcaggaaggcgccgctgtctgccttgggcaccatttatcctccgttcatcgtccccggggcggctggaaggccggaccaggccggactgagggtcaggggaccgtgccaagcggagggtcaggcggagctgaacctgggcgaggcgcggagaggcggcgggaaagagcttcggctgggccgcgggctggcgcacactctcggctgcaacctcaggcaccgactccagctgcgcgcaagatggcggccgtcctgctcggctccgcgccgcgccgccccgccccgcctcccgcccgcgacgcaggcgcgggccaatgaccgtcaagatggggggcggggccagagccaaagccctccgaagagggtgaggcctaaggtcgcgacggcggagggcggggacctaagggcggggactgaggggcgggctctaagggaagggcgggaccatacggagtgaggcgtgccattggttaagcagagaggcagggccggggccggggcctgagcggcggggccaccgaagggagtagggtctctggacgccggttagggacggcgggcgcgggacggcaaggatggacatcgaaaggcgcggggcatggggcggggcgccgaggggtcgcgcgggtggggagcggagagaacgaagtgggaacctggctgggactccaagggtcttcacacctgcaagctcaggtcccgtgagcagcccaaaagtgcgccccaaaggggtctttttaaggccgaaccgctgtggaggagggagggcctgccggttctgagggtggggaaagaggaacaggaatggcctaagagagtgtcaggcaaagagagaccgggaaggccaggtcctggagactgcagcgaagccggctccctggaggacctgcctacacaatggctaggggaaggccacatgtgcaggaaagaaagctaggcagagaggaggctcagcgcccctgcgaacagtgctccaagtgccacttctcccgtcatcaccaacagggtgaaccttggagggcagtgtcggcgaagagtccaactctgtaaaatatttgaagacatttcttctgagccaatatgtgaccaatagcctgggacacagccccaggagatcctgacaagtgcccaagggggtagggccacagcttggttttatacattttagggagacaagacatcaatcagcacatgtaagatatacattggttcagtcggaaaaggcgggacaacttgaaagtggggggtggaggggggcttctaggtcatgcggattggcagttggttcaaagagtttatctaaagacctggaatcaataaaagggactgtctacattaaggggttgtggagaccaagtttcttaggcaaatgaagcctccaggtatcaggcttcacagagaaaagactgttaatgtttcttattaaaaagtgccagactctgccgggtgtggtggctcacgcctgtcatcccagcactttgggaggccaaggcgggcggatcacctgaggtcaggagttcaagatcagcctggccaacatggtgaaaccacatctctactaaaaatacaaaagttacccaggcgtggtggcacacgcctgtaatcccagctactcaggaggctgatggcaggagaatcgcttgaaccggggaggcagaggttgcagtgagccaagatcatgccactgcactccagcctgggcaacagagtaagactctgtctcaaaaaaaaaaaaaaaaaaaaggaaaaaaaaaaggaaaaataaataaaaggtgccagactctagttaattctctcaggagaaaagaccttgaaagggatagggattctctacagaatgtagattttccccacaaaaaacagctttgcagagcgacttcaaaatatgtgaaagaaacctgttttgcagtaaaatatgtgtttccttccgggcctgctgtcatgctggtatcttactgccacagagtctgttgtcagtcttcaagtctctgtgtcgatgttacactgcttagctgtgcctgaaacctgaagggaggagggataatgaggcctgactcccacttcctatcacggcctgaaatagtttttcaggttaagtttggaatgcccttggtggagaggaggggtccattcagatggctggggggttagagttttatttttggtttccaggagacagtagttggggtgtccccagcgggaaggagaaggaggctgtctggaaggaggagaaccaagaatgcacaaaggcctggcagtgggcagtcagcgttagggaagaaggtgaaggagcagagaaaagggggaagggccacggcaggtggggacccaacccaacatgagtgacaaccagcccgccctaccaagtcatcctgaggggcccagggttccacttggctcctgtgagaaaggggtgctcactccctctaggtggatgaggccaaagtcaaatccaaggctaggatagtcatgtgactcctactcccctagggcatagcccggaacaagtgctggacacagagcctggcacagcagaggggctccactgccagaaaaaacaatggccacactctccagtgctgcccctgctgcttgtactgtcctcagagcagccaccagtgctcagggtggcatccagtccccgcctttagcccccagccccagatctgccctgggagcccagccaggggcagaaaaaaaactagttcattgagtgccagggagccctgcccaaggacatggcgtgcaagatgttccaccaactctcctcagccattaaatactgccacgacctggacatcatgcaccagaacctcaagtgttagaaccttctcctcgacaaggacttcaacatcaagctgttctacttcaggttctccaagctctgcctgcgggatgacagtggccaacagagattaagcaagaacttctgcgggttggtggcatatgcagcccccgagctgctgcagggcatcccctaccagcccatggtgtatgacatctggagcctgggcatgatcctctacatcatggtctgcagctccatgccttacgactccaacatcaggaagatgctgcgtatccagaaggagcaccgcgtggacttcccacactccaagaacctgacagacgagtgcaaggacctcatctactgcatgctgcagcccgacgtcagccagcggctgcacatccatgacaccctcagccaatgctgggtgcagcccaaggcacagggactgccctctatggtcttcaacaaggagggggaaagctcccagggaactgaactcttgtggacccctgaacctggctctgccaagaggtctgccaccaagctggagcctggggaacagacacagcccgagggacagcctgagacaaaacctgaggggttggcaatgcaaatgtccaggcagtcggacatcctaggcttccccagcaagccgtcgaccagggagaaagaggaagggccccccagcagcctccagagatgcgcacctagtgagccgtttgtggcccagtgtgccagcggcgaatgagatggagctcacgccttcaggcccaagctctgaagaagtcaaggcacaaaccagagaaggaagacggtcccggatgagccgctgttttcatcaatttcttctctctccccttgaacttcataaccgacattgctaaaggagcaataaatcactatattaatgcagatgccaaagtgaatgtctttgcctcaactgactagtcctgggctcccctccactggtttcccactcagattgtgcaatgattcctcgtttgcttgggaaaacacatcccaacgtgcccagtccagaccatgacctcaggcccaggctggggctggggcttgggctggggctgggagagacctggaggggcaggggccagagctgaaaggtgagtgaggaagccgctgcctcagaagggacgcccccaagtgcggtgctggggtcgggaaagggcagggagaggacaggaccaagaagcatgccgaggtacccctgtagaggagcgcaggctttatctgcagttgggactgagggtctgggcagacctctccagccccacaaggctgccagtgggggttgtgggaggctgcagagggcaggtggccagcctctcagccactcctgagctccctaccctgctgggcaactcgttcattgtgctctgtccatcagaggccccctgtgtccagccagcacccagctttcaacagtgccggggtcgccgcaccctgtggtcattctctagcccgggagaaataggaggctctgctggatggcccagccacactccagcctgagcatgtcccacagtcttgtgtggtcttgaccacatcttgttgtccccgtcccagcctgtcccaagggacgacacccctgcattagaagttgacactggcaagtaggatacgacaggcaaccacaaaggacaagcgctttcagaattacctctcccatggcctctaagtggatggggccaaagtcaaacccaaggctaggactgtcatgcgactcccactcccccagggcggggcctgaagcaggtgctggacacagagaatgtcagagcagaggagctccactgccagcaacatcgatgatcactgtccacagtctacctatggtcacttctctacctcgggaagaccccaacctcagtccccttggagaagtagggtctagtgagagcctggactggccctccttgcgctcttccccaagtccacctgcctcctcatgttctcacagcccccttccacgtggtttaatttcaggcctccaccccaaccctcccaccacctccgacagtgtccagagccatcccccaccagcctggctcccactgcccagtggggaggaacctaccctggcctctggggtcctcctgtggcccagtgcatcctcccctggcctctgggcaccaggcctcaccactgcgcccccatcacacacacggcccataatcatacagggaactcgcccctgcagactctgtccagctctccaggctcagctgagaggctgaggcctccataaagccttctaggggttctcagcagcctgccactgtgtactctgccaacaggcctcaaggagccaccctatttttcccaccaagaaactcatggtggagagggagcccagagtgctgggatgggggcccgggtgggacatcctgagaaatggctcttggggcctcctcctcaattatccccacggacctgcgctggtcctcagggcagtggctggcaagcaggtctgggagcctcactgtagctcagccaggtaagcccgggtgggaggggctgcaggaggagttcctgctctgagctttacagctggaaacagctcagagggagtgggccacctgtctgagatcacactgcccagggcaggagtcccaggtgacgcctccacaggtggcctcgccatgccgggcgactcctgtaggtggctcagccctggctcagaccccttcaaggattctcaaaggtgctaggaccaggacctcaacagggccctccatggcctgtccgtgctcctgccaagccacatcccttcaaaccgtcacatgtaatagctatcctcatccctctccacctggctagttcctcagacctcagccttccccagcttcccaaagtccaatccccagttccctgtcctcacagcaccatggttctgatgcgtggcacagccaccatcgcgcacacacacttggtgtgattgagcctccctcgcctctgggctccaggacggcatgggtggtctagctcatcagtgtacctcggcatccagggcagaccctcagtgcttgggggacaaataggtaaaaaggtgtctactttataaaggataggaaggttcagagagaagtggatttctcagagtgtgcaggtaccttgctcacaggactgcaaccctaggagcaacgctggaggtctccaagtcgaatccaaagctctctgtcaaacataccaggagtgccggccctgtgtgtgcatcctggatgaagcggcccgctccatgcccgggcagttctgcctctgcaatgttgacacctgcctcttctggcatgtcccccaagaaccagagagaccctcaggaggtgaagaagtagaatgcacaaaaagagggagaaggcattggtagagtctgggaagaaggcagatatgcagccagggcacggtggctcatgcctgtaatcccagcactttgggaggccgaagcaggcagatcacttgaggccaggagttcgagaccaacctgggcaacatggtgaaatcccatctctcctaaaaatacaaaaattagctgggcgttgtggtgcttgcctgtaattccagctgctcgagaggctgaggcatgagaattgcttgaacctgggaggtggaggttgcagtgagccgacatggtgccagagcatgactccatcgaaaaggaaggggaggggaggggaggggaggggaggggaggggaggaagcagatatgcagagaagtgtcccagatagggcatttgggggagcaaaggaaagggtcagggggtggtaagtgggaggtctcatgctcctgggtcctggcctgcaaattttcatagccagccccttctaggacaaaaaggagtgaagtgttggtcatttcagccgtagaggctcccaggaaaaaggaaagcatcaaactaaagctattaaccaccgatgctataaagagcttcgggtgggactctgggaggctgtcactgctggaaggcagtcactgtaggcacgtcggcccaccctgcccatctgagcctctcagcttagcatcctgactttggctgccctgtttctgcaatcctccctagtgacctccaaacacagggtgctccctgtgtactccagatggagtgggtccacacagccatgccagggccaagatgtcacatctgtctgacatgtcctgcccctcttgtcaaccctgtggagtctgctgatccccagcaccccagctccaacatcacttcctctttgaaaccttccaggactaaaccccacctgggaacaggccttcctccctctcccctaaacactgaacacacagctcatctgtcccagctgctccctgtgaatccaggatgcctgtgatggatgacaaatgaacatcagtccaacgcacctgaggagacatgtacaggatgccacatttcccaaagcacaaatccacacaccagcactgaaacaggatgttcacactgcaggtgcaaaaggcagcccgagacgtaaatgctacccaatgtcagggttccaacaggcgactgctgctcactccacacaaaggcccaaactgatgtgattcagaaccccctcctcacccaggtgcctggtctttgcagtgcatggcctgggcgctctcagccccaggattccccagcaccaaggcccatccactcacagtctagcaaacaagactaagacctgaccttctctgtctcctgctgatcctgaggcccaccctggcccagcctcttctcatttggtcaaaggcactggcccccactctcacctcaaagccaattctactctttctgtctctctctctctgccactgaccatcttaaaacacaactgggacggccctcctcctgtcttgcacctgcaggggcaggctgccgcttagagaaaaagccgagactccttcacttccctcctacttccagtcactttcagaaaaagccctctcttctcccaggctctctgctgcctgggtgccttcctgccgcctctacccaagggaggccctgccccacccctcagacatgcagccacctgccctggaccctgggcacccagctggcatgcactgcagccccgacccacccatacacaggcccttgctcgctggagcagcagcgactcacctgcccggctctctaccctgaggggcctgccgcctctgctcccaaacacagagctgctttcgtctaccaggcttggcaccactgccagcctgactggtccagggcagtccctcccaggtaccactgttcccagaaccaagccaggtccagctgcattttcttgaggcccaataacgagaagcagacaaactaggaaagaagggagtttatcactgtaactggatacagggagaaggctggagataattccagcagaccaactcaaagtgctacaattttcttactgtttatataggttggggttatgtgcctacatgcagtacagcaatcacctaagtctactggtaactaattttgttccaaggagaaggtcagaggcaaaaaaaatgcttgctaagtccgattaaaaggggcccagtgccttcaaggcctgtctactgtggtaccggagtgattatttcgattgtatctcctttacagcttggtccagagagctgccttagactatccaattgatctattcaaacagctgcctgttcccttaacttgtcttcagattttgtcgacccgagatgggtcctggcactaggaatgtaaaaccgttcctattattttggcttgctccagcaaaagagaagcccatgcaaggctcctgctgaccatgtttcatttctagctttgatgtctgggcactgatttccctagatttaactatgtgctcaatggtaaggcagtgctgtggaaatctgtctgtgtaactggggtgctatgcaggcctgtctgggtgactgtcagggacaactgtcctaccacaccaaggacacagccctgggggtgcttttcttcatagccaaagaagctgcaggaaacccaccctagtgggacaaagaccaatgcagggtcagtccccacagccaggtgatgcaaacaggctggacgtgggccgcctcccctccagcttgacttgtgacagggaaaccaatgcagcagcagcagggccaccagagtcctgtcctggggacaggcttccttccagcgggcggggagtgggtgctcctgccagaccagcctggcttccacggttccagagaccctgttctccctcagcccagtccccgcccccactccttggctttatgagttcattggctgaagtcacccggagacaatgctgagtgttccacccctgagtcgaagcccagcccagggcagcccagccagacgcctccggtagtgtaaatgaggacaatgcctgctggcccacatgacggggggatgtagacggcagcggcgccagtcgctcctggcaccatggacgatgccacagtcctaaggaagaagggttacatcgtaggcatcaatcttggcaagggttcctacgcaaaagtcaaatctgcctactctgagcgcctcaagttcaatgtggctgtcaagatcatcgaccgcaagaaaacacctactgactttgtggagagattccttcctcgggagatggacatcctggcaactgtcaaccacggctccatcatcaagacttacgagatctttgagacctctgacggacggatctacatcatcatggagcttggcgtccagggcgacctcctcgagttcatcaagtgccagggagccctgcatgaggacgtggcacgcaagatgttccgacagctctcctccgccgtcaagtactgccacgacctggacatcgtccaccgggacctcaagtgcgagaaccttctcctcgacaaggacttcaacatcaagctgtctgactttggcttctccaagcgctgcctgcgggacagcaatgggcgcatcatcctcagcaagaccttctgcgggtcggcagcatatgcagcccccgaggtgctgcagagcatcccctaccagcccaaggtgtatgacatctggagcctgggcgtgatcctgtacatcatggtctgcggctccatgccctatgacgactccgacatcaggaagatgctgcgtatccagaaggagcaccgtgtggacttcccgcgctccaagaacctgacctgcgagtgcaaggacctcatctaccgcatgctgcagcccgacgtcagccagcggctccacatcgatgagatcctcagccactcgtggctgcagccccccaagcccaaagccacgtcttctgcctccttcaagagggagggggagggcaagtaccgcgctgagtgcaaactggacaccaagacaggcttgaggcccgaccaccggcccgaccacaagcttggagccaaaacccagcaccggctgctggtggtgcccgagaacgagaacaggatggaggacaggctggccgagacctccagggccaaagaccatcacatctccggagctgaggtggggaaagcaagcacctagcatgacaatggccccgttgtgtgtggtgggggtcggggttggggggcatggtgcagtcggccttcacgtaaactaagtaggcaggtaggatctgaagaaggcacaggtgcaagtaaaattcgtcaattaaaccactattttgattacgttccattagctttcttccacttagcagcaaagacgttccttactgaccaccaaataaaccacagggtgtgtgcaagcatcaagagtgcccagtgaggagtgtttttctctgggactcagccaaccgccccacctgacacacagtggtctccggcctaggagcacaggacagatgctcaggtacaggcagaatcacagtgtggcctggccttgtgggggacaagagggcctctgccagggtccacccaccaggcccacactgtctccctctgacctggccttgtccccaatgccctggggctggccagctccagtggtccacgactccccctggcttcctgcagttcagccccctctgacctacccccactccctcacaatccctcgctcagcatcctcctcttcctctatttcctggagtcatgtgagatttctgtcctcagccctcaagttccctgccctgtcctccaggggcagccccagctgagacctccccgtgtgccctccccacccagtggctcttcaagctgctcagcagcccttgatgatggcacactggccggtcttttgtgcttcctgctgggtcacccattgctcccaaagcatgcggcccacttgctggccaagtgctccaggtggtcagcacctagacatgctcctcccccctccctccccacttcctgggggctcccttgggataacgtgcaccctttcctaggggataaagcactgaaggccccacgtcccccaccccttaagagtcccagcctgatctgtccagcaacccactgttatctgggagctcctgttggtggaagtgaccaggtgaggccagggccagcagcataagatgggcagtgcctatagcagaggggtgagtgggatagtcccaccccatgagctggaagccaggtgctgggagaaggtgatagctgagatcacctgatatgcagcccccacacagtcctataaccagcgcacctcacagccggcaagcccagagtggaggctgcagacctgggcccagaaccgcaggggaacctaagggtacaacttccaagggctccgtttctccttcatatccccccagagaagcagaaagcactgcaggatgtgagctcaactcagaacacaggttccgagtgccgcagaaagcaacgccagtcacccggtgctcccacagccgccccacctgcagcttcctcacctggggggcccctcgcttcaagccccgcagtcctgagacgtgatgcaggccccagggcaaggctagggctcgtgtggggagcaagatggagaggcaaccccccagactgtacctaggtgttctttaatgacagttcaaggggccaattaaacagcaaacagcttggcaaggccctggggtgtggtgtgggcacgagtgccttgtgccagtctggccccagcacagcccctttctccagtgactcctggtatggtcaacagcttctggcccaggcctgggccccgagaaggctggagtcctctgctgggtgtacagctgccctgcaggctctgtgaagcgtctatgagcccagcccaggcctggctctaaaagaagtccgaagctttgcgccgggcagggagctgcagcaggttgtccgtgatggaggccgggtcctgtgtgagaggggtgcgtgtggcagagccaggcgccggtgtgcttgtgggggtctgcagcccactggccggggtcttgaggtgggtggagcgtgctggggatggtgtgtagctggcccgcagggcccggtctgtgtacttgctggccgtcctgctcacaaggcgctgtagggctggcgacatggctgggctcaggcctttgggggtgaggctggggtggaggaatgggtgagagaggcagggttaggtgggctgagagctgccggcagcagggcctcccttggctcccaggaagagcctgggcagagacacagtcactctgagctgaggaggatggtactgccagcatggcagcaaatgcgggggatccctgaggtcaaacagcagcgctcaggtcaaacctgaggtcaaacagcagcaccgcccttggctgtgggggctggggtgcacccccaggcctctgagagttggagtccccacccctctccaaggggaacgatgactctctccacagggctgatgaaagctcccagcaggaccacacgcctaaagatgcctcttagggacgggtcaaagaggacgtggaggaaagagaagatggagggggcctctcatcctgtccatgtgcggccatgctctggatagaggagctgccacagtacccactgcagaaccccgcggacctgccctggactctgccgcgtgggccatgcctccacacggtcagggcaggggccgaacaggagcaggccagagccaccctcgcacttccccaccagccaggcggcccctcacctggccagattctccgtcactctccgcaaggcttcctgcttcttggcccggttcttggcagcggcctcgttggccatcttcagacccagccgctccctgcggcctggctccaggatctacaaggtagcaggtgtgtgggtagctgcgccaggcctgccacacgccaggcagcccctcacacagaaagccactgtggtgggtgccagcctctctttgttgcctacaaaacccccacaacccatcacctcccactaaaagcccctggaaagccccaaaccccacctgacctgcccaaggcgcagcactcctcacctgtcttcgtgttcctcccaaaaccatgacctctgacaatctctcaggaaaaagcagtctgttttagtgtttccctgattatcagagtgaacatctctgtctttatcggcgctctgtatttcgggcgcttccccgtgtgcctgtggcctattttgctctcaaggggctcattttccttttctgctgctgttactcagaagacccttgccaagaccttgtgtcaagtcaactgtgctacgctgtgcacatgttttttcactcatttacatttgtttcatttataacattttctgctgtatttgttattttcatttgtgatttcttcctttgcttttatgtttagaaagtccctcctaacttaagattagactacaggctgggagtggtggctcacacctggaacctcagcactttgggaggccaaggtgggaggatcacttgagctcaggcattggagaccagcctgagcaaaatgacaagacctcatttctacacacacacacacaaaattagctgggcatggtggtgtatgctgttagtcccagctacacaggaggctgaggctggaaggtcatttgagcccaggagctcaatgttacaatcagctatgattgcaccactgttctccagcctgggcaacagagtgaaaccctatctgttaaaaaaaaaaaaaaaaaaaaaaaagaggcgaggcacagtggctcacgcctgtaatcccagcactttgggaggctgaggtgggtggatcacgaggtcaggagttcgaaaccagtctggccaaggagttcgagaccagtctggccaacatggtgaaaccccatctctactaaaaatacaaaaataagccgggcgtggtggcacgcgcctgtagtcccagttacttgggaggttgaggcaggagaatcacttgaacccaaaaatcaaactaaatattcgccactattttctagtcccagttacttgggaggttgaggcaggagaatcacttgaacccaaaaatcaaactaaatattcgccactattttcttctggttgttttatggttattgtttttacatgtaaccttttcacctttccacaatgtatgctgctacacatcctgaggacccagctcccttcatttctaaatactctgctattcagtgcaatctgagttgccatctttatcgggccccaaattctgacttggatcatggtttgtttcagaatttatctgtttactgttggcctggagactcgggaagcagtggcaggcatacctcagaagcacctcagcccttgccttgcgctctcacattggacagcacggcatcctcttcattatccctctcgcacgtttgccttggttatccttgtgtcccagacaatttagaaccaaggtaaccagaacctctccccatgttttgtctggacatgggttacctgtactaagtattctggggaaaggcccgcagtggtatggggaggcctgttgtatctgacccagcccacgaagagcctcccctggtctgtgccgggcctcacacactccaccctgaccactcctacaacaccaggcttgagccgtgtaatccagcgtgtcccaatcgtgttctgtaaccaggggccttctctacaagcacacagcctcgtcctatggccctcaggcctgcagagctcctcacgtgtctgtgaccatcctgcctcattcatgaacagcacccggcctccaggatccagagggcccaagccactccctgccttggtgtctcagcccttacacccccaaatccctctgtgacaggtccacccacccacacctgccttcagcaccctggcattcagaaaagccagcactctgcccgtcagcagctgggggccgatcccagtgctcagtcctgagccacaggcactcagggctccagaggtgtccaccccggtcgcacacagttcccccatcaccacaacccaccttaaaagctgggccgggtgtcctgtccacgtagggcgtttccgacccttcaactctcaagggtgtgttctcaacctccccccaggtcatcatcggggactcgttcacacctgcagacaaagagcccaaaaccacctcaggccagaggactccccaccaccctcccctccagtcacagcttgttcacccaatgtgcatcccagctaatacgaaggcaggcagctagccctctctccttccccaggactctggaaccctggcacctccatcctccgaaagggaaatgccaagctcccagcaggcccgaggcaggctcaaggccctacagccatgtgcttagcctacaagcctctgggaggtctcccccagccacgcaggaggagacactcaggccttccagggctcccaaacctcctagaaccccaggcaaacctgtggtgccttcacatgccctggcgtgtgacacagcaccagcacccaagagcacagaggccagagtgcagagggacacccacgcatgccacaagaccacctgagtttcacctccactgaggtgctgggcctccctccctgcagtgctaggtagacttagactcataagcactgtgcacacacccccacccactgacatcacagtaaggaccaggacaggacacgtcatcccaggatgtctcaggccaggtctgcctgagagtccagcccacccacggccccaagcagcctggacacctggcctctagggccttgtacagacaggagaccaggtccctgagttacacaaggtgtggggcaggccaggtagaggccaggagtggccagggccgactgagaagcccacctcccccagggagtcccagcagtagacccacttgccagtgggcacttttctcaccaggggcaggggaaggagtggcaacaaatccaaatccacccactcgaggggactcctgggggatcagctccttgccatcggggcccaccttgccctgtttgtgctggaacaagcagagaggctggcatcagggggaccgcagcccacgctcgacagctggccggtgggcaaacacgtgggaacatgctggaaacacttcctctcctcagggcaaggctggggctctggggttggcagccttcttggagaaagagagggagggcccctgccccaaccccccaaaagaccttgagggcctgtcaaagtgggtacccaagcaaggaaagccccctcctcccatccagggaggtgccagggcctccactcgagctgcgcctatcccagcaactccagaggatgctgacgccaggcccctgcagggggcaatgctgatgacaggcaatgctgatgacaggcaatgcttatgctctagtctcttcctgccttccccacttcaaccctgtgactgccacagtcaccatcagagagtatctactcgtcttgctcccagactcagaaagcctctgctctctgccaacccagggcctgtcccaccccagccaccccctggggctgggctccctctgcggctctctggcttccctgcccggtgtgtgggcgtgcagctgccagcctgggctcactcccagcagtcccttttctctcctgcccctgccatcaagggagctggcacagatctggacctacagaacgtgtgtgaccaaggcagtgttcaatggaagcccactggggccaaggaaagactcaggatcctgccgcacagggccccagatggttccactcactgagctctgccaagctcaaagagatgggagagatcatgcctgcccccaggcagccctgtccaacctggcccatgcggccctgctgacccgcctgctcacctgggcattgagggcggctgcctgctggagctggcacctgctcagggcttggctgaaggggtccctaaggaagcgcgtgttcttatgtaccacctgccggggcttcttaaacagctgctcctcgtcagggacacctggcagacgaagcaaaggtagcagcaggtgtcagaagggcagcagcctaaggagcatgaggagctcgcttctcggccaagtcactcccagatgaacaaaagcattgagcagaacgcaggccccagtgccgctggagagggtctcactcactgctgacctcacacagacctgtccacccttagacagaccagtacccatcagaagcccaaactgcaagggggcacggccatacacacctggaaggctgctccaaacacagccagacacacacagctctacccaacacctccccatttggctgcgaggcccgccacttaccctctggatagtacatgagggaattcttggccttgtacttccaggtctccacactggcctggctgctctcgatggcctggtgctctgctgacgggagttcgagattatctttctgcctctgcaatcacatggggaaaagtgatggtcagagatgcccctgggcattgtacccatggccctggggctccccaaccaccacagagggtgcctacgcctatgtgacaccccagaccccagagacaccttctcaaactcttcctcagcctggtagagccaagcgtggcgtgcccggcttctctccttggccacctccatgatctcctggaaggaggcattgtcctcactcgtgtagcggctcaggaagacatctaggctgggcagcggctccttctcctcctcctctccagcctctcctgcttaggggttgcgggaggaggaacacagcaccctttgcagtcaggaaagaggaggacacccaggcccaggaatcatagcccccaacatgcagggctggaatcctctcccctggtcctggcttctgcccatgaaagcccacactgccaaggactccccacgggggcagaatccacccaccctgactgcccagagagccctcaggtggtaccctacagattcagggccagctctgctcatgtgctggatgccaagggaattacgtggtctgattcagactggagaaagcaatacaggtgttagagcaagagctcgtgatcacaggcaggctcctcccccaccaaagtggtgccaggcctgtgggtgccaggcctccaaatccctggggctctccctcactccctaggatttccttaccttacccactcttctcttcctggtacctgtactacaggtgggtggtcatcgcctaatcatcctgacctgagagcgagccccaattccagggatctcatatgacttagtcctctggatggggcctcacaggtgctaagccacaaccccaaacacccccccctccgaccaaccctgccaccatggaaagtggtactcccactgaggtggtgccctggtgctgcgtgtggtggtgcaaacttcggtggggccacctggagagctctgccttcaagtctagtgacagtcctgaccacctgctacacgtgaggctatgcacaaggcacagtggctacaagctcaagacccacgggatgaggacaggggtcagaaactctattcatctcagagagataagaagtgaaaccctgaccatctctgagacctgcagaagtgactgcctttctgagcctcagtttcctcacctgtaaacatgatgatggttcctaccacttaggttctgaaaaggattcctatatttactggcatgtaggtgtacaggtattgaaaatctgcaaactggctaggcatgatggctcacacttgtaatcctagcacttcgggaggccaaggtgggaggatcacttgagctcagaagtttaaaaccagcctgggcaacataatgaaacctcatctctataggaaaaaaaaaaaaaaggagaagaaaaaaatctacaaattgccctgtgatgcacaagctacatttcaacagataatcaagcttcaaggacaacaaggactgtgttaatggccgaaaaagctggattgtaaagcaaaaagtatcatgtttgcatgtttgtgcaaacacacaacacatctgtgctactccagcacagtggagtctacaaactgataagaaagagtgtctcgtttgtctatacatgcactgacattctactactgatgaaaagagggcctgacaacgcagaagtcccatggcgtgcagaacacttgcattcaacaggactcggagtgccctttcctaaaccgactcccccatcaagtcacgatgttaccatatagagctgtgtgtcccagcaaacatgctgaagatgacaactctttcatctgttccatgtgtatctgtgcaaggcccacaacaccacatgtgctgttcccaacacggagcatacagatgaaagcaaaacaaagcttctgctcttgtgcaagggatgccaattagggaaagagaccataaacagaaatgcctttaaaacgttatgtcttggccaggcgcggtggctcacacctgtaataccagcactttggggggccgaggcagacagatcacctgaggtcaggagttcaagactagccgggacaacatggcaaaacctcgtctctactacaaaatacaaaaattagccaggagtggtggcaggcgcctgtaatcccagctatttgggaggctaaggcagggagaattgcttgaacctgggaggtggaggttgcagtgagccgggatcacaccattttactccagcctgggtgacagagcgagactctgtgtcaaaaaattaaaaataaaatgaaattaaataaaataaaatgtcttgtgatgaaaaaccaaagccaggctggaagccacagagcaccagtggtgttgtgacttcacactggcaggtcaagaaaagtttctctgaacaggtaacacctatgcagagatctacaggaagaaacacagtgagccatgcagttatctgggaagtgaccaacatgaaggaaacaaatggagaggccctgaggcatcttcaggatagtaacaaaaggggccttccaacatccatgaagcccacagggcagggctggaacacagcagaaaagccagcaagagctggtgagagtcccatttcacagaggcgagccatgtgtgggagctggacccagatgttctaccacctagaccaatgtcctttgacttcacaggctgctatttacgcaagacccctcaggaacaagatgtggcctgcagccctctggaccaccccctcagggcctcacaggctaagattcccaggcaatcctgaccatgtgacttaaagagggcaccctcactcaccatcctccaggcctcggccgcggggcctgggcttgttgcccaccactccagtgcctgcatgcacctcaggggtttcaaatgtggctggagtcacatctaggggaagagagggggataagaattagagtgagcctgaagcgacagttcagcaggctttcccctctccgccacccacagggtcctcatacagggtggcgggggctcccgggacatcttgcccaaggcagagccaaacttgatggcaatctggcgcatccgttccaagtctccattctcctcggcttccaggtactccttctgtgcctggagcttctccacatcaggaaagaaatccctttggatgaccgtctggaggccctgcaaggagagatcagaatgaaagtcagaggccaggcgcggtggctcacacctgtaatcccaacactttgggaggccaagggaggtggatcatgaggtcagaagttcaagaccagcctggccaacatggtgaaacccagtctctactagaaatacaaaaattagccgggcgtggtggcaggcacctgtaattccagctacgtgggaggctgaagcagaagaatcgcttaaactcgggaggcggaggttgcagtgagccaagatcacacccctgcactccagcctgggcgacagagcgagaccgtctcaaaaaaaaaaaaaaaaaagaaaaaagaaagtcggagctgcagtctgggtgctcctgcctcacaggtccactgctgtacatgctaaggaacttgctgaacctccttcaaattctacttccccaatgactggggctggattgagggagcttgagggcactttctagtggggttgagcatcccatatggtagccatgctgcaacctctaacattactaaacactcttctgaagtccgtgaaacccttctctctcgcccttgctaactggtcattctcattctccattgctggctccccacaagccagaccaatgtgggtgttgtcactttcattccacacatgactttctatttccaatctaaacctttctcctggcggggcatggtagctcacgcctgtaatcccagcactttgagaggccaaggcgggcggatcacctgaggtcaggagttcgagaccagcctggccaacatggtgaaaccccaccactactaaaaatacaaaaattagccgggcgtggtggcgggcacctgtagtcacagctactcggcaggctgaggcaggagaatggcttgaacccaggaggcagaggttggttacagtaagccgagatcgcgccactgcactccagcctggacgacgagcgagactccgtctcaaaaaataaaataaaaataaacctttttcctgagtaacttcagccagtcactaccacaagttgagattcccaagtctgcacctccagccagaccttgctcccgagctgcatatctgggcacccaaccgtccgttaaagccatccatctacatatcccaaaaggtgtcccgaattaaacaggtctaaaaccaaactgacttccgccaatccccgtttcagctcctccttctgtgtgcgtgtggtggggcgacgcaggtccactcactcgagatgctgtcacaactgcggtctctttccaggaaccccagcattcacacttgctgccaccgctctttagaaagccctctttgccaccatccttccagtttgtcaaactcctactcacactttaacagaaaatcttctttccctgacccccgtcccatacaaagagagccgctctctcttttccctgacaacactactacagcctcttccaccacagacgtcttcctctgccctgtttacttgactcgtgggaccgtccacacccggctcctccacttccacgaggagacggagtgtcaacacccgagagagggaacctgagaggagcttgaagcagaggatgggcccagaagtcgccggcgtccgcaccgaggtcgtacctcgatatactcttcctcgtccaggacccgctgcttgctcgtcgcagccccagcctctcccgcctcgcgcttcctcgggggcctggacgcggcgggaagcaacaaggacgacgctgatgcgcccggcgtctccatcgctatcccaggaaaaagctcgggcccagcaggcgcgtcacagggtggagggggcgggactgcaccatttgcgcaggcgcctccaatagttggccaatggaaaagctgtggctctagaaagccagcccgcgctccgttctgacgtcactataaatgctagactttattggaaatgtagtccttgtcctgccccgcgctattcatgcttgtcaatgctgtgaacacgagggggtgctgtggaggtggcggggaggatgctatagggcgtgttcttcacgcgagaaattctggctttgcagcgtccaaaggccttagaattctaatttcccacaaataagaactatgtatgcttcgagattattctacaaaaatacaaaccaggaaatttacttatataggagtttcaagctttatgcaagaaaagggccttaaaacaattttttttttgagacggagtttcggtcttgttgcccaggctggagtgcaatggcatgatctcggctcaccggagttcccgggttcaagggattctcctgcctcagcctcccgagtagctgggattacaggcatgggccaccacgcccggctaattttgcatttttagtagagacagggtttctctatgttggtcaggctggtctctggattacaggcgtgagccaccgcacccggccaaaacaatcttttttttttttttatagttatctaacaaaaggtgaaagaacaagacagtggttcgattaagaaatgtctaaagattattctgtaatcccagaactttgagaggccaagacaggcggatcacctgaggtcaggagttctagaccagcctggccaacaagatgaaaccccatctctactaaaaacacacaaaaaaattagctgggcatggtggtggacgcctgtaatcccagctactcggaaggctgaggctggagaattgcttgaacccaggaggcggaggttgcagtgagctgagattgcaccattgcactccagcctgggtaacaagagcaaaactctgtcaaaaaaaaaaaaaagattattgggcccccaaatgccagagtgggcttcccagaagagggatcattctcattcaagaccaggcacggtggctcacgcctgtaacctcagcactttgggagacccaggcaggtggatcacttgaagtcaggagattgagaccagcctggccaacatggtgaaaccccaactctactaaaaaaaaaaaaaaatacaaagtggtggtaggtgcctgtagtcccagctacttgggaggctgaggcaggaaaatcactcaaacccaggaggtggaaactgcagtgagcagagattgtgccactgcactacagcctgggtgacagagtgaaactctgtcaagaaaaaaaaaaattaatattcaagtgaaccagaaaattgcctcggcatttttaaggaatttcttcccaaacgaaagatgtgaattgtgttggacaaataaattccgccctggaacaatttaatacaattttgcttttgcaacatacagggataccttcattcactgaagtgcagcgtgctgctgctgcccttgtagaagtgacagtgcaatggggaagacagagacacttgttagatcatcacacaaacaggtgtaaaattgcagctgtgtccgtgcaagaaaagagtttgtacttggggaatcttgacctagttcgggaggtcagagaagcttccccaggcagaaagtgattgcagattcaaaagacgaacaaaccggcaacagtcaggtggaaagagcatgtgcaaaggcctagtggtgggagggagcaaggcaagttctaaagaagtcctttggaaatgcagagtgcagtgaggtgtgagatgatgccagagaggcagggccaggctgcacagggccttgtagggtatggtgaggtggtttgtcttcattctgaattgaaggggcaggccaggcacagtggctcatgcctataatcccagcactttggaaggcctaggccggcggatagtttgaggtcagaagtttgagaccagcctggccaacatggcaagacctcatctctacaaaaaacttttcaagttagtcgggtgtggtggtgcccacctgtggtcctagctactcagaaggctgatgggggaggatcgcttgagcccaggagctggaggctatagtgagccatgattgcaccactacactccagcttgggtgatggagcgagaccttgtctcaaaccaaccgacaaacaaaaaagcagagccagtgtggtgcaggtggacaagattagagacagttgcagtggtcaaggtgagaggtgacggtggcttacatcagactggtgcagttagagctggagagattctgggatttattgatttattgataaacagtaaaactgacttcctgtcagcctgggtatagtggatgatcaggagagggaggggtccagggaccagtttcgggtgggcggctagctctctggctcatgtgcctggtttgcacagaagagctcactgtggacaaggtgaccttaaggagtctgtgggcttcaaggggacagctggagataaatacctggctcaggggaagtgcctggcttgagatgtaaatgtggcagaaagatgggaattggagtctgagggtaaaagataaaccgggaagagggtgaagatgagaagcgagcgcctgggtgtgagcgtgaaggatgcctatgttaatagcctgctgtggggggtcagcctgccaaggagcagctagagctcaagaagcaaattcaggagagcaacacagccactgagccctggaaggtggcgctccacaagctctgatcggggctcccaaaacaatgacagatggccattcaaccaaggaactcaaggggcctggagcctgtgagatgcgagtgtccccagctgcaagggagctgactgggacacgggcatgtccacaggtagtctgttcagtccccaagggcaagaccagggttcagggagaagggctttgtgtgcatgctaggggtggaggcggggatgctagggacacccagcagtgtcagggcagttctgactggggacaccatgcttgcttggtgttatccaagctggccagccttggggtgtctggggagctgcagccctggcttctgcagtcctgcttttagagatggacttcatctcttgcaggtagaatggccccattccctgcagggcctgtaaggagacagaacgaggtgctcaagccagctgggggtggggatgtgagatgctttggacccactgtagggcctacttggggaatctaaggcttctttccactgtgccttttgccatgggccaggataaagaaggggagggcaggcatcttcccaggcagcaggggcggggtctccccagtccaacctcctcttgccctaccctaggatggcacagattgctgtgagggagtccgagcccacagcatgaaaaccccaggaggaagcaggggaccctcacccatgggcaggttcacagtagcctagaggccagggctggaccccaggggtccaaggccaccatccgtggagcagtcccctctgctggggagcaccctggtgcagagactgaggatcgctgagctgtgctcctctcaaagacagctgtaccctaaataccccctcgctgggaaggaagaagaagggacagctccttgttgggtgtgggagtggagccaaggtggacttgagactctgggcggcttctgtggtatttgaagttgctagtttctcagtatcagcgcgaggctcgaaggtgaagggactgtggaggggctcctggaatcgctcctgcgaccttcttattctacaggtccagataccaagacccagcccagggcctgggaagcctgcaacgccaggactgcacagacacgaaccccatcccctctcccgctgggggaggacgagccaggtcaagttaggtcaatgtccacattgagaagagggtggccagcatgtcccagggtgcggagagacgctccactgcgtaggattctgggtcccgtgttgatacggggtggttcccctcctgcggtggagttagtgtctctcggggggtagggagctgaggaaactgctctatgccccagcccacccccaagggactcgccactcccactgccgtggaacaccaagcaccgggggcccgtccccagcgccacggcagcacgagctgcaggaggcaagggctgtggagacgggtggaggcggccggtgtactctcccagctccttttcgggtagacctgtcttctctcagcgccaactccaaagatcccaaaaagggtggccgagcccaggggcagctcctagagtcatcagcagctccccttcggggacttcttgacgccgggcaggagcctcgcggaagccgacgcgcgcttctggtgtcgccatttggcccggcggttcttgaaccagacctggggatggggggaatgctcagccctagccccaggtcctgcgtcccaccggctcccgagggtcccacagggaccgagaggggagcttcgcaacagggatgtgggcggacggcgctgtagagccgacacccgggccgcggctgcgcgccacctgcccttattcgctgcggacagactcggtgggtctggacgcgagatgggaacccccttagtacccgccccagcctccagctggcggcgaccaggacgccccttcttgggttgcgggctcttctgaatttcccaaattctggacgtgaacgcgggcctctttcgtcaccagaggaaagtgtaaaacaaaagaaaagaaaagtagccctccggttcctttcccgcggcacctccctgctctcacccgctcctcatacccccggacgcccagcgccgtccagggacctcctccctccggcgcgccagggcggggcttgggccgaggccgtctttgcaaagggcgcccgcccgccaggaccccagtccagtgtagccgcggcccgcgcgctccggggaaaggctgggcggggcactcacctccacgcgctcctcgcgaaggcggatgcggccggccaggcgctcgcgcgtactcacgtcaggatactggttctgcacgaaaagcgcctcgagcgcctgcagctgctcttcgctgaagatggtgcggtggcgcctcgtgcgccgctgcgaacccgggccgaccgcgcccgggagcgccccggaacctccggctggcgcacccagagacaagggcaccgccggtcccagcctcagcggccacgccagacgagcgcctgcggagcgagggcgcggtgaggcgcggggctggggccaagctcggcacccactgcgccgcgccccgggctccgccgggccccgcgccccgctccgcgcccactcacccagcccggcggccgcctctgggggcccgcagggcgccgcgcgggggccgcagcagcagcagcaggcgcagggcgcagcctcgggcgccccgggctcctctggcttcgcggggctctggcgaccggcgggctgcggtgggcaggcggcccgggccgggaggctccgctcgggcaggctggagaggatgtgctcgatggagaaggggcagggccgcccggcaccccggcggctcgccgcgcccccagccgctgccgccatgcccggcccggccggggcgccgccgccgcgggaatatatacgtcggggagggagcgcgcagtaatccccgggccgggcgtccagtccacgcgggttaatcccgcagcgccggccgcgaacgcgctaatcctcgactgcggcggccctgcctccgcgcgcgggggccgggggcgctgcagagagggccccctgtgccccccaccccgccccgcgtcctcctgccccacccgcgcccgccgctcaagctggcagggcgacctgcggggaaggggcggagggccgcctcgccgccgcccgcggggcctggcagccgctcggagggcgccccgaccctggcagctccccagagcgcggcggtgcctcccggcccagcctctggtggctccccctcgttcggctgggcctaattcctcgtcccctctggggccctactgcggcggctcagcacgcctgcagaagctcggcctagccgcccacccgaaactcctggaccgcagcctccatggggcccagcaccaccggcaaccgcacgatcccgccgcgctcgggtcccgaacctgcccgccacctcggagccagggtctcatggccctggagggcgtgagagcgcggcaggaagcctgggctgccgggtgcccccagttctccgtctcctcacctgtgtcaaggagacctccccgccccttccgaggcccctcctcggtgcttcagagccgcctgtcctccagctttcccactggtcccagaatccccgcgaaaacatccaacactgcacctcgcccttccccgcactgtcactgccccccagaagctgtgggctccccctcctcgctctccgcccaggccagtcctctggccacaccgtcctcggtcccttctgccacagcgcaggtgacccgcacttggctacattgtttcaccctcagtgaagcggctcctggcagcgggaccgtcacttcagcttaagaccctttcctcttgacctttgaaaatacagtatgggactcatagcacagagaaacagacggcctggctcatactccgttgtcaatttctggccgtgtgacctccataggcgtcttcagcctctgggcttggctttcccaatctgtaaagtgtagtgactaggtgtgagacggttagaacctggccgcctccccagggcaatgcgtattcctgcgctcctcccgccgccagcccctctgcaagactctgccatccccactctgctatcagtgaaagtgctgtggacatcactgtgaccgaacctgctgatttaatttctgtcacaagagctcccacataggtttcccaggggtagtctggaggctcagtgatgagctgccacctccatgagtggctctgtcaacccctcctccacccacctcttggtggtagaatggctgccacagccccacacttttcatctcctcccatggccctttggatggccatggatccctcctccctcagcagacctccctcacagaactgcatctggaccatcctccaaaatcagagtgctgctatgatgggggaggcagggtcattggtcaggagagccagcccaacatttgctgagccctcttcctcctagccctggccattccttcatcctttcccattctcaccctcaatacctattccagccttggagctccagacaccatctttgtgacagtgactcacaagtgcacctccagcctggcctctctctctgctccacgctcttgtttctggagcctgctccacatctccatctccactaccaataaagttctcccagtcaccatgccagaaaggaactcaaggtcttctcaaaatccctttcttaccctatgttctccacttttacaaatgggccactgcccacctgtccatctctagtgctcattctcttctacctatttgcctctgcgtgtgccctgcctctttaccagtccaccttggtaaatggcccactgtggcactttttcaaaaagtttattttctattttgcattattttttgagacagggtcttgctctgtcacccaggctggagtgcagtggtgtgatcatggctcactgcagccttggcatcctgagctcaagtgatcctcctgcctcagcctcccaagtagctgggactacaggtgcaccaccatgctcagctaatgtttctgttttgggggggttttgccacgttgcctaggctggtctcaaactgccgagctcaagcaatccgcctgccttagcctcccaaagtgttgggattacaggcatgagccaccgtgcctgcctggcctgcccccctcccttttttttttttttttttttttttgagacggagtctcgctctgtcgtccaggctggagtgcagtggcatgatctcagctcactgcaagctccacctcccgggttcacgccattctcctgcctcagcctcccgagtagctgggactacaggcgcctgccaccatgcccagctattttttttttttgtatttttattagagacggggtttcaccatgttagccaggatggtctcgatctcctgaccttgtgatctgcccgcctcggcctcccaaagtgctgggattacacgcccggccttttttgtttgtttttttacttttgagacagggtctcgctctttcacccaggctggagtgcagtgggtgaccatagctcactgcagcctctgaacacctgggcttaagaggttctcccacctcggcctcccaagtagttgggagcacaggcacacgccaccatgcctggctaatttaaaaaaaattatagatagggtctcactatgttgcccaggctggtctagaacttctgacctcaagcaatccacctgcctcagcctcccaaagctctgaggttacaggtgtgagccaccgtgcctggccactctggcgcctctgaaacatgctggcaggttctctgatgctgctccctttgggagtttaattgggtttcttcctgaaacatgggctggccttcacgacttgcttgtaatccatagaatgcagcagaactgacatcgtgtggtttctgaggccaagtcacacacagagtcacacagatcagatcagcaacccaactccttctctctctctcacacatcttgggatgcttgatctttacacccagccaccatgctgtgaggggcacaggcagcctcgggagaggataggcgtgttcctgccagcagcaccagctgaaggacccatccaccccctgcacgggtcacctacaagtgagtgaggaagccttccagatggctctggccccggccaccattggactgcaaccacaggagacaccaaaactgagaatcccctccctgagcccagtcaagccccatgactatgaaatataataaaatagatgatgctgggtgtttttactgcaccaagtttgatgtggtttgttatataactatagataagcagaacgggatctggtactggaagtggggtgggtgctgctgatacaaaacctaaatcatgtgacattggctttgggatggggcagtgtccaggagctgggaggaccttgcagaggctgacagtggggacttagaggaaagtgaagaaattgttactggaagatggaggaaagaagaccattgttatgcagtggcaggaagtttagcaacattgtcacctgtagccaaataggaaatagaagctagatagtattcccaagaataaaatgatctaaggacatacccagagagaaagttcaaggtgctacttggcttcttctagctaccaataataaaaagaaagaagatatgattcaaaaagcaagatttagggccgggcatggaggcttactcctgttatcccaatgctttgggaagctgaggtgggagaatcacttgaggccaggagttcaagaccagcctgggcaacatagcaagaccctcatctctataaagaaaagttttttctttaagatggagtcttgctctgttgcccaggctggagtgcagtggtgtaatctctgctcactgcaacctccgcctcctgggttcaagcaattttcgtgcctcagcctcccgagtagctgggattacaggtgtgtgccaccatgcccaactaatttttttgtatttttagtagagacggagtttctccctgttggccaggctggtcttgaactcgtgacctcaggtgatccgaccgcctcagcctcccaaagtgctgggattacaggcgtgagccaccttgactcatcaccctggagcttcaggtacttctcttgatgtcctcatctcctaacatccttcctcttcctccccctcccctcccccttcccctccccctcccctccccctcacctccccctcaccctccccctccccttcccctccccctcctcctccttcttcttctccttcttcttttcttttcttttcttttctttttttttttattttccaagacagagtctcactctgtcacccaggctggagtgcagcagtgtgatcttggctcactgcagcctgcctctgccttccaggttcaagcaattcttgtgcctcagccacctgagtagctggattccaggcatgcactgacatacccggctaattttttgtatttttaatagagatggggtttcaccatgttgcccagcctggtctcgaactcctgacctcaggtgatctgcccatctcagcctcccaaagtgctgggattacaggagtgagctactgcaccaggccctcatctcttaacttctaatcttgctctgtccaggtccctgaaccaaccagctcaactatttgctacagctggtgggtcttgcaggttctgcctttgcagagtggatggcacagtgctcacagaaactctgccgtttgggagtctttgccctcatgctccactgccgttcagggctgcctgagtgagctgtggggcagatgtcataagtgaggccacatgggatggcagtcacctgctttcacagcttacgtgtgtcctctggacttgctgagagctgatcctcgtaatgccacttctgttgtgtggatggttggtaccttgagacctggtggcttggccaagcacagtggctcacgcctgtaatcccagcactttgggaggccgaggcaggaggattgcttgagctcaggagttggagaccagcctgggcaacatagcaagaccttgtctctacaataaataaaaaaattagctgggcgtggtggcatgtgcttggggtcccagctactcagaaggctaaagcgagaggatcgcctgaaagatcgcctgaacgagttcgaggctgcagtgagccgagatcaaaccactgcacttcagcctgagtaacagaacaagaccctgtctcaaaaaataaaataaataaagcctggcatggtggctcatgcctgtaatcccagcactctgggaggacaaggtgggtggattacctgaggtcaggagtaccagaccagcctggccaacatggtgaaaccccgtctctactaaaaatacaaaaattagctgggcgtggtggcaggcatctataatccgagctactcgggaggctgaggctggagaatcgctttaacccaggaggctaagttgcagtgagccaagatcacaccagtgcactccagcctaggtaacagagcgagactgtgtctcaaaataaaataaaataataaaataaaataaataaaagacccagtgggtgtctctgacaatacccagctctaatgagccttctggtcactcagtagcccatcgtcagatgcccagttcctgccagggcccagaaacgtggaaggagctgttttgttttgttttgttttttgagatggagtctcgctctgtctcccaggctggagtgcagtggcgcaatctcagctcactgcaacctccgcgtcccaggttcaagtgattctcctgcctcagcttcccgagtagctgggactacagacacctgccaccacgcccggctattttgtgaatggtatgtggcatggccttgctccagaaccctaggagtgggcactgccacccttccactgcagcctgctgaaggcgccacatgaaacctttctctgccaagcgttggccatggctctgtcaggtcacagggtcaggctcagggctgctggtaccacagcctggacctgcagcaaatcccatactgccctaggctctactaaaagctggcatcctccatatcacccacaaatttcttgggcagtattcccaagttttttccgcctccaaatcgcaaagaagcctcaccctgttgtgttctttcatagtggtgagaggagctgggcgctcgcccttcgccttggaggagttgctctggcatcccaggccgctgggctcccagaggctgcttttttttttgtctcttcttcattaccggtttgtgagagttctttgtatatttaagatactagtcccttatcagatatatgatttgcaaatattttctctcattctgtgggcagtttttactttttccttttctttcttttttttttttccagagacagagtctcgctctgtcgcccaggctggagtgcagtggcgcgatctcggctcactgcaagctccgcctcccaggttcacgccatactcctgcctcagcctccccagttgctgggactacaggtgcccgccaccatgcccggctaacttttgtgtttttagtagggatgaggttttgccatgttggccaggctggtctgaccttaggtgatccgcccacctcggcctcccaaagtgctgggattataggagtgagccactgcacccagcctttacctttttttttttgaaacaaggtctcactctgtcgcccaggctggagtgcagtggcatgatcatagctcactgcagccttgacctccttggctcaagccatctttccatctcagcctcttgagtagctgggaatacagccaaatgccaccatgcctggctaattgtaaaaaatatatatatacgtatacacacacacacacacacacacatatatatatttgtagagacaaggtcttgctggcctggcacagtggctcatgcctgtaatcccagcactttgtgaagctgagatgggcggatcacctgaggtcaggagttcgagagcagccaagccaacatggtgaaaccccgtttctactaaaaatacaaaaattagctgggcgtggtggcgtaggcctgtgtcccagctactagggagtcaaaaaaaaaattgagacaaggtctggctatgttgcccaggctggtctcgaactcctggggtcaagcagtccttccacttcagccacccacagtgctgagattacaggtgtgagccattgcgcctgcccgttttttgcctttttatttttagagacaaggtctcactatattgcccagactggtctcaatctcctgggctcaagtgatcctccagccacaggctcccgaatagctggaagtccagacgctcaccagcatgcctggcttcagctggcattttaataggagttatattgaatctgtagattagttttcggagcaatgccatctcaacaatatttaactcttccaagccatgaacattagatgtcttccatttatttagtgctttgatctctttcaacaatgttttgtagttttcagagtttaagttttcattttgtttacatttgttccctaatattttgttcttttttttttttttttttttttttgacagagtctcactctgttaccaggctggagtgcagtggtgtgatcttggcccactgcaatctccgcctcctgggtttgattcccctgcctcagcctcccgaatagctggcactgtaggcgtgcaccaccacacccagctaatttttttttttttttttgtattttagtagagatggggtttcaccatgttggccaagatggtcttgatctcctgacctcgtgatccgccctccttggcctcccaaagtgctgggcttacaggcgtgagccaccgtgcccggccaatactgatgcattttatttctttttcctacctaattgtagagctttcttttcttttttctttttctttttcttttttttttgagacagagtctcactctgttgcccagctggagtgcagtggcatgatcttggcctactgcaacctctgcctcctaggttcaagtgattctcctgcctcagcctcctgggtagctgggattacaggcacgcaccaccacgcctggctaatttttgtatatttttagtagagacggggtttcgctatgttggccaagcttgtcttgaactcgtgatctcaggtgatccacctgcctcgttctcccaaaatgctaggatcataggcgtgagccactgtgcccagcttagagctttcaatacaatgttgaattgaagtggcgagagtgtacatccttgtgttgttcctgatcttagaggaaaatgattcggtcttcaccattgagtgtgatggtagctgaggatttttcataggtgccctttatcaagttgtggaagtgtccttctttttttttttgagacaaagtctcactctgtcgcccaggctggagtgtagtgacgcaatctcctctcactgcaaccttgcaatctccgcctcccgggttcaagcagttctcctgcctcagcatcccgagtagctgggattgcaggtgcgtgccatcaagcccggctaatttttgtattttcagtagagatgggttttcaccatgttagtcaggctggtcttgaactcctgacctcatgatcttcccgcctcggcttcccaaagtgctaggattataggcgtgagccaccgcgcccagcgtgtccttctagttttgggattaaacaacatgatccactggtttttgcaggagccagataatgtattaaactgggatttgctaaagaccacattgcaacctcctttcaatctttatttatttattttttgagacagggtcttgatctgtcactcaggctggagtgcagtggtgtgatcaacactcactgcaacctcaccatcctgggccctggtgattctcttgcctcagcctcctgggtagctggcactgcaggcatgcaccatcgtgccgggctaaattttgtgtttttttatagagacagggtctcactatgttgcctaggctggtctcaaactactaggctcaagcgagccccctgcctcagcctcccaaagtgctgggattacaaggcatgaccagccactcccggccatcctttcaattttcaactgagacctctaagctctgctatccttcctgggacgcagcactgtatttttttcttttgagacggagtcttgctctgtcgcccaggctggagtgcagtggcgcaatctcggctcactgcaagctccgcctcctgggttcacgccattctcctgcctcagcctcctgagtagctgggactacaggcgcccgccaccacacccagctgatttttttgtatttttaatagagacgaggtttcaccatgttagccaggatggtctcgatctcctgacctcgtgatctgcccgcctcagcctcccaaagtgctaggattacaggcatgagccaccgcgcccggccagcactgttttttttatcttggtaggggcagttcaggaactttcatgtagcctttattgcaaaacaggtctcacttttgagaactgaaagtaaaatcctaagcactcccaccaactgaaaagatcccccttgaccaaaggaccccagagaaaccttaaaaactgagttaacagccatgacaggacagaaggtcagacatgcctcgctgtaccctgtcccttttgtggtttaggcacaactgaccaacattaatgttaaaatagagatcataagactgacagaagagactctggcaaaacgataccaaattataaacaggaccaaaggccatgctaggcaaggattaagtcatgcacccctatacttaaagaagaaactatattctgtcacaggtggtttttttttcctctaacagttaaacaagcactagcctcaagataaacaatattaaaacaattacaactcaaccactgccagacactcactgaccctcctgttgtacaagccacaactacagctttgataggacatgagactggatttagtaactttcttctgataaaaagaccatccaccctagactggttctggctggttacagaggctgcacacttgcgtgccttcacgtccgtccctacttcaccttctgacgtgtagggcctaattgtaatgcatttaaatgtgaagtctccgccccaaagtaaacatggctgcatgggacatgcgtatttgcttctcacatatgcacatgttcccccttcatgaatattcacagctcctcctagatcctgttaaatatgtatacttggctggcctggtgcggtggctcacgcctgtaatcccagcactttgggaggctgaggcaggtggatcatgaggtcaggagatcaagaccatcctggctaacacggtgaaaccctatctctactaaaaatacaaaaaaattagctgggcgtggtggcgggcacctgtagtcccagctactcaggagaccgaggcaggagaatggtgtgaatctgggaggtggagcttgcattgagccaagatcgtgccactggactgcagcctgggagacaaagtgagactccatctcaaaaaatatatatatacacacacacacacacacacacacacatatatatacatatatatatacgtacacatatatatacacatatatatacgtacacatatatatacacacatatatatatacacatatatacacacatatatacacatatatatacacatatatatacacatatatatacacatatatacacatatatatacacatatatacacatatatatacacatatatatatatgtatacttggctctcctattcagcataaattcctgtttcaccgctctcatcctaaacatgcctgtcttttgatctctgcgagaggctacacttcccagcctggccgccttgcaggctataaccctttataagaaataaagttggcagagcacagggctcatgcctgtaaccccatagtcccagcactttggaaggctgaggtgggaggatcacttgaggccaggagttggagaccagtctgggcaacatagtgagaccccatctctacaaaaaataaaaaaattagcaggtatggtagcgtgcacctgtggcctcagctacttgggaagctgagaggggaggatctcttgagccccagaatttgagactgcagtgagctatgattgtgccactgctctgcagcctgggtgacagagtgagactgtctctagagaaaagaaaataaataaagtctcctttctaaatttataaattgtgtgatttttcagttggcactctacaggttagaaatcactgtgaaagttctgccaaatactaaatatgtctattccaattatgcattcagaaactgcagaaataacctgtgagtagctcatgaattgctgggcccactgtgggatggaattgggccaggactttgcgtactgcccggctgtctgtgctcctgctctagcagggaggccatgagggcactttgggtcccaggaatcagtgctgacttggagccagtatccaacagcactaaaaagatctgggttttccctttccccagcgcacagctacctgagtaagcggaaacaggccccttcgtgaaaggatgaggggaatcactactagaagtacctttcatggtgttcctggctccttcctcatgggaaggagacttcagcagaggaggtctgggcctgagaactggctggacactgggcgacactgagacatttcagtgggcaggtgacctgacctcagccttttgcccttctattatttttacttatgtttttaaatgtaaaataaagacagcatagcatttaccattttaacctttttgtttgtttgtttgtttttggtagaggggatcttgctctgtcacccaggctggagtacagtggtgcagtcatggctcactgcagcctcgatctcctgggctcaagcgattctcccacctcagcctctggttgctggaaccataggcatccaccatgtgtacctaatttttgtatatttgtagagactgggtctcacttatttgcccagattcattttaaccttttctacgtgtgcaatacaagtgtgcattaaggatatccacaaggctgtgtaaccctctccgcgaccattcccagagctttcctaatcagaaaactgtaaccattgcacagtaattgcccttccctgaactcccagcccccggcgagcggggctcatggctgaataacactgcactgcatgtgcagactacattttgtttatccacttatccctccagggtccttgggttgtttccaccctctggctgctgtgaatagcgctgctgtgaacatgggtgtaatgcgcttgcttcagttcctgcattcagcccttctgggtatatactgaggagaggaattgctggggcgcatggtaattctatgtttagggttttgaggatccactgaacttttccacagctgcatcttacattcccaccaggttcccataaaagttctactttatccacgtcctcaacaacatttgttattttctggttttaaaatgtatagacatcctagtggggatgaagtatttttctcattctgacttttttttttttttttttttttgagatggagtcttgctctgtcacccaggctggagtgaaagtggtgcgatcttggctcatcgcaacctccatctcctggttcaagtgattctcgtgcctcagcctcctgagtagctgggattacaggcgcccgccactacactcagcaaatttttgtatttttaatagagatgggtttcgctaggttggccaggctggtctcgaactcctggcctcaagtgattggccagccttggcctcccaaagtactgggatcacaggtgtgagctattgtgcccagcctctttgcttatttatttatttatttatttatttttatttatttttttgagactgagtttcgctcttggcccccaggctagagtgcagtggcacaatctcagctcactgcaacctccgcctcctgggttcaagcaattctcctgcctcagcctcccgagtagctgggattacaggtggctgccaccacacccagctaattttgtatttttagtggagacagggtttcactacgttggccaggctgatcgtgaactcctgacctcaggtgatctgcccaccttggcctcccaaagtgctgggattacagatatgagccaccgtgctcgtcctctttgctcatttttaatgtttttttcttttttcttcttcttcttttttttttttgagagagtctcgctctgtggcctaggctggagtgcagtggctattcacggctcactgcagccttgaaatcctaggctcaggtgattgcgtgagccaccatgcccagccagttgtttgttgttgttgttgtgttgacttacattattttttccaatatttcatcatgaaaattttgatgaaattttcatcaaaatattcagataatttgaagggatattcactgtctagattattcaattattagtattttgctatagttgatttatcactatgtatgcattcgtcttttatttttacaaatggggtcttggtatgttgcccaggcttgtcttgaactcctggactcaagtgatcttcccgcctcagcctcccaaattgctgagattataggcgggagccacagcagcaggccaggattgttttttattaattttccagtggcctgccaatggtatatataaatccagtccatgtttgtgtagtcatctggtaactgttttagcatcccagcacacagtcaagaaaaataaactttaaaaataactaaaataactaaataactaaatggcccaggcacggtggcttacgcttgtaatcccagaactttgggaggccaaggcgggtggattgcctgaggtcaggagttggagaccatcctggccaacatagtgaaaccctgtctctactaaaaatacaaaaaattaaccaggcatggtggcgggtgcctgtaatcccagctacttgggaggctgaggcaggagagtcacttgaacccgggaggaggaggttgcaatgagccgagattgcgccattgcactccagcttgggtaacaagagtgaaactctgtctcaaataaataaataaaataactaaatggaaattctagaactgaaaaatgcaacatgagaaataaaaaattccctaaataggcttaacagcagaagaaagataacagtataacagaagagtcagtttgagactagccggataatagaaattatccaatctggggtgggatggtggctcgcacttgtaatctcagcactttgggaagccaaggcaagcaggtcacttgagctcaggagttagagaccagcctgggcaacatggcaaaaccccacttgaatttctacgaaaaatacaaaagttagccgggcatggtggcacatgcctgtagtgccagatactcggaggtggaggcgggaggattgcttgagcccaggaggttgaggatacagtgagccaagatcacaccactgcactccaacctgggtgacagagcgagactccatcttaaaaaaaaaaaaaatcctggcactttgggaggctgaggagggcagatcgcttgagcccaggagttcaagaccagcctgggcaacatagagagacccccatctctataaaaaatacaaaaaattagccaggggtggtggtgcacacctggagtcccagctactcaggaagctgaggtgggaggatcacctgagcctggggaggtcaagactgcattgagccatgatcctgccactgcactccagcctgggtgacagagcaagactccatctcaaaaaaaacaaaagcaagtaaaagaagattttttttgtatagagtcaataatatataaaagggcaaaaataggccgggtgcggtggctcacgctgtaatcccagcactttgggaggccaaggtgggcaaatcacgaggtcaggagatcgagaccatcctggctaacacggtgaaaccccgtctctactaaaaaatacaaaaaattagctgggcctggtggcggccacctgtagtcccagctacttgggaggctgaggcaggagaatggcgtgaacctgggaggcggagctggcagtaagccgagatcacgccactgcactccagcctgggcgacagagcaagactccatctcagaaaaaaaaaaaaaaaaaaaaaaggcaaaaatagagaaaataatgaagccaaagataaacaaaattaataaactaaactgaatcagaaaaaaggaacactaattactaatatcaggactgagggaagggatgtaactatagattctgcagaatttaaaagaataataagggaatataatgaacaactttattaataatctatagttaacctgcagttaatatcatactttctggcaaaacgttggttattttctccctaaaattaagagtaaagtaaggatatccatgacacttctattcaacgttgtcctggaggttttagtcagtgcaataaagcaagaaaaatatagaaaaggtataaagggcttggcatggtggctcatgcctataatcccagcattttgggaggccgaggctggaggatcacttgaggccaggagtttgaaaacagcctaggcaacatagtgagaccttgtctctaaaaaatattttttaaaaattagcagggcatggtggtgcacacctgtagtcccaactacttgggaggctgaggtgggacgatcacttgagcctgggagttggaggctgcagtaagctatgatcatgccactgcactcctgcctgggcaccagagcaagactccatgtcaaataaacccctcaaggccgggcgcggtggctcacgcctgtaatcccagcactttgggagaccaaggcgggtggatcacgaggtcagcagttcgagaccagcctgaccagcatggtgaaaccccatctctactaaaaatacaaaaaaaattagctgggcatggcggtgggcacctgtaatcccagctacttgggaggctgaggcagaattgcttgaaaccagaaggcagaggttgcagtgagcctagattgcaacactgcagtgtagcctgggcaatgagagcaaaactctgtctcaaaaaaaaaaaaaaactctcaaaataaaaaacctaagtgcgcaaggccatccactcagatacaccgccccacacatcagcgtcccaccccttcactatcaggctgtcactttgctgtgagagccttgtttaggttgagatcccctgcttctcctggagttcggctgtgctccactaacccccggggcctcatcttcatttctgtccacccgccggccagtctctgcatgtgccagctgggctctgatgcggggcactctgcttcatgctgttgatcggtgtgtctggatctgtcatgttctctcctcaaggaatcaacagtgcttagcaacagcctctcagtcccatggctcttggagttcctccccacctctcaggtgcccagggcactgcaccagtgacactgcctccaaatgtctcccatcccagttccccctggtgacagttcttactgtcacactgtgacccaggccgggggctgtcagttctccacctgacaccttggcatctacgaggatggaacaccacaaaatgctggaaacacgagaagagtgacagctcctcgttgccaccctgccggcgcaggagccaatttcagagtgctgtccttcaggtgggcttcccagggccacccaccagacacccactgttgaggtcgagttccctagaagcaaagcctgaagcaaggattcttgttctcgggctgttgctgagcgtgtgcccaggagagtgaggaagtctgtgctgccttccggtggtgctgagccctgaacggtttccaacaggagcttacttgttcatacttccagaggtcaggaacccagatcagggtgtcagcagtgtcgtgctctcggaaggctccaggggacagtctacccggtgcccttctcccagcatctggccttgctggacccactgggcattccttggctcacaaatgccccctcccatctccaccttggtcaccacatggtcttctcctgtatgtggctcttctcttctgaggacttcatcagtcttactgggttaaggacataccctactccggtatgacttcatcttcatttgcatggttcttgttgttgtctggtttacaggcagggtcttgctctcttggccaggctgaagtgcagtgatgtggtcacagctcagtgcagcctcaaccttctgggctcaagcaatcttctcacctcagcctccaaagtagctggtaccacagatgtgtaccaacatgcccagctagttaatttaagtgtaattacatctgcaaagatcttatttctaaataagttcacattcacagataggatgagcgaggactttggcatctctttgggagacacaacagaaacctagagggactccccatcctgatttgcctgtgactttcccaggttttggtgctgacagccctgctttccgggaaattccttagtcttgggaaaactgagatgcctggtcaccgtggaagtaggacagggctgggtggtagagtgcagactgctgagcagaaagctgtctctgttacaggtcagttttcatcattccacatggaaccgctgtggcagacactgagaacttcacagatctgaaccacctttcggcaaagcagggatgcccaggtatcagccattgtcagggttctgcctctgggtctggagggctgctgtgtgggtggctctcattccccaggacaattctccaagaccaaggtggccatgagccaccaggaggcaacagtcagcagctggggaccagtaggctgacccctaaaggggatctgaatagagccatctatgcacacccatccccttgtcttcccagtaaatggcccgcggccccacctactcacctgggtaaacacacacctcgactcctgtgcaccttggtaaacacacacctgtccgtccaggtaaatgccccactcactcacctgtgcaccttggtaaacacacacctgtccgtccaggtagatgccccactcactcacctgtgcagcgctcacctgactctagagctgctcaaggctcagctggtgggcaatgcttagcactccctactcccacctcggatctcatcgtccacctccagctccatctggtattgcccacgcctgtccctctgcactgcctccaccttggcgccagtcgtagatgtctgccaccggcacccccacagtggctggcttttgaacccactcccagcaacttttctctcctgtcctcctccccaaagtgagcctccccgagaggcgtcaatgcttgccacaaacagaagtcccatcatggcaccctcacttcagatgcccggagtgagtggtcctcagtccctggaagccctggactctgccacctctcccatctgtcccctccctcctcactctcagctgcccaggtccctggtcagctccttcaatgcatccaccctggctccttgacgccctatcctggggctcctggcacctctgcaagggggccttccctactgtccccacctgcacctctctagacaatcccagtgctcccggctgccaccatttctttccccgactaaagaacagacctgactgtttccaggactggatgaaactgaggcagatgaagagggcagggatctggaggggctgggggagaattagaggccacagaggaatggagctttgggtgggcacggacagaccactggatttggacagtcagggccgggacgcaggagcagctagggcccagggagccgggggttaggtccctcagatcccgcacatgcaaaagtgaggctgaggtaggggggtggtccctcggcatgtgagcccagggggttcccgagccaagtggcagccggaacagtggggagggacagccaaggaggtggggaggggtcgctggccccgctcagggctggttggggtggaggaagcccgggcccaggccgccccccgctgggtcgaggccaccccgcctcgagggcgcggccgtccggatctcctgattgctttctttcatctctgttcctttctcagccacaaacgcccgctaatgcctcttttatcacggaattaggggatttagggccggtcgcacaaaggggccctcgatagcggccataatcaaaccccaatcggccgaccttggacgggccggggaagaaaggagcgccggggattagcgcggtaccgcggccgggcaggcagagatagcatcggcgccgctgcggggctgaagccgcggagggctcggccgcgctcggagaaaggacggcttagctcctggagccggggattctgaagccattaggtggggattaacacccaagttaatctgctttggtcgctcaattgtcagcagcgaacgcgcgggactgaggaagcctggctcccagcgaccacagggccttgccacccagcagtccagagctacgagctggtatcagtttccccagctgtcacccggccaaggcgggccttggagccaaaagggagatgcacaccttggtgggctggccaacgggtctggatgagtggaccccctgccccgccagccttcctgggtaatcagggaactcagagaaggatgttcctgccccatcctgacccagaccacttgtggaccctgacagccagtgcagccctgggtgccacccacacactgagcttgggttgcacggcaacatgcatgacacacctgtccccatcaagcagggtcagggggcagcctgcagactgggtggacgctgacagcagctagcagcccccttgcagaccctccatcttccctttggggtccctgtccaggtatagccccctaaagacctctgttgaccaactcactgacagggcagatgtgacaccacctgctctcaattcatcctcactcttcatcttcagtcctctctcactaggcggcagagggagggactggacctatacaggtcccaggtaggtcctttgtctctgtctgggttttcctatctgaggaatggagccggctaaggaaaggcccaaccagaatgtgccagtgtcgtgtgtggcctgtgctcactgctatcttctgtggggacgcaaccccaaccctgactccttctcctgttcctgccagcaggcccccagagtaggtggctcagaggggtgtgcttacacctgcctcctcctccatggagatgtggcaaggtcactgtgccttacatgagcctacaggcagcaacaagtggctggactggagctgaccaggcaggcaggatggggtgggcagtagcagaggagaggccagtggagcgctctgggtccccatcttctttcccatggctgagactagggacattggaacaaaaagtcccaagtggaggaaaagacgcagtcataagtacatttgtctttccttccctctcatctcccttcctccctttcttccttcagcagtgaccaacgattctcccatccaggccctgtggaggggacacaggcgtgagccacagacccaggctctgccctctgggagcttgggtccgaggacacagttagacaaccggatgggagggcgcccttcgggaaggggaaacaggcaccccacatgcacagggccaggcagggcctgaagggcagtgtgaattacagggaaaatgcggagggagaggaagagtgctccagggcgaggaagccgcgcccgcagcgatctggagtgcggtggggagcaggtgaggcgggagaagcccagttctgggacacgcaggccagctctaggcaggggaaaggaggggcgggaggccagggaatgttccctcaggctggtgcgtcagaatggcccaggcagcctccagcgtgggcccccgctggtcccgggaggcgccgccagaggctcggggagggtggacgatgtggctgggccggcgagaatccaggggctgcaggcaaggacggggactcgcgatgaaacccgaagatcaggggctggtggcagtgaccgcgaggggcctccaagcagcccaatcaatctcggacgaggggtcgagtcagtggcggtgcaggcggcaaaggcagccagggtctgagcagcgcggctccagccccagcagcaacgggagagcgcgtgcgccgccccagacgactggacgcgccctcgtgacgccatcagcgcgcgccgccccaacttccgagcgcaagcgtggtcgcccccacagcctgtgggctacgggaacgcgatccgactcggcggccctccctgcctggatggccggtccccgaggctgaggaagtccattcctctttcggaaatggtccccaggaagcttctccgtgtccccctatggccgggtactgagcggggcccgggtggtctgcggccgtggcccccgcccctcagcgcaggcgaccctcctggccctggcgggcacagcgcctctcccgtgacctgggccggcccgcaggatgagcccccggatcacgatcgctggcattttatttaccttcttccattacaaccccaggcgagtctcccgggccccgagaggagggggtgactggtcagggtcatcggtagcggcggcaggggcctgcatagggctgcctcggggcgactagcagaatggccgccagcctcggctgccccagcccccagcgcatggaatgtgccccgggccccaggagctccaggaaccgcgcttgtgagacggagcttcggctgcttggagctagtgagccaccggccacggcagggatttgagcagaacttgggggcagagggatgagatggtgcatcccttgaggtcacttcaggagatgacactcctgtggctaagtgtagcttcccaggtcatggctcccaggtcaggcctggtcaatggagaattaagtgggcgttgggtggtggatggatgtgatttggcagaggggacaaatgtgacaacagtgtaataagggccatgttggggagggtcaggggtcagggtccggcccaacctgagcagaagggaggctgctctcagggatatttgtcaggtaggaatgggtggagtggaactacagggccaccatgtttcccatgggtcacccatggtggccttgtcatgtttatccgtgatcctcagtgttctctgtggtcctcccgtcacccctttcagactgtcctttcagttctccactgtccctgcatcacctctgcccctgtcccgtttgtctgtgttcagtccatgttcccaggtcttgaggtggcccctggttctatgccccttacctaagaccctgtgcagggaatctgtgaaaacacagaggaaataaaaagtgaggaaaatagtactcttgcatcctcgaccaagatagtgtttgttgtgagtgctgagacggaccagcattctctttgttggtgaagaggagacagacccatccacaggagtcattggcttttttgaatactaagctctgactgccattcatcatctacacagggacagaaaacccggtctgggggacgtggcacgcagcagtgtgtgaggggaatgccaaggaatctggggagcgtcaaggaatctggggagcgggaagatggagcggggtagctgcctggaggcctcagtcccacagcagtgaggacaaggctggaggttagccaagccctgccctaggtgtggtcacgacctcaccagctcccttttccttttctctgaggccattgtctctcctgggcacagtccgtaaggttcagattccagactgtgactttaactggtcaccgtggctctggctggagcaggacatggtgacctggagtctccatccactcctccgatgtgcacttagccacctcctggggctctccccagcactggccgagcatcctggttagtggggaaacgtggagcaccaggctagaaatcaagacccttctgcctgcagactagcttggagacccatccacgtgtctctgctcctctgccccttaagggcaggtgcgccccagtgttcttagtctgtgctactccctgctgcgggcctcctctctgcagtctggttaaatgcaacttggctccctccaggcccctgcctgcctctccagcctccagctctttcctgcacagacacctttccccttgggtctcagctccaagactggaggctgcttgcttcttgagggaatgtgtgaagcagcctacagtgtgggttctatctaccagagtacgtggctcctccatgctcgtggccccaagggactcagacccagctcaatcaacatttctggctgggctatctgatgtctgccgtgtgattcaaaggtgattcgaggtgaccctgaggatggcaggggtccagggagggtggagacccatgccatcctacaccctgctctcacctagtgcagcctcggccccttcctgtggagagggacagggacaggactcggtgcaggtgtgcagtgagtggctggcatctctggaggtcagtatgtgagggtgggggtcccctccaggcagctgcgagggcttggctgctcccagaactgcctggaacctggggagactgtaaacaacctcttgcaaccccaagaataaagctgccatgtgtgagggcttgctctgagctaagcatgattctgagcaccggcagggagtacagcaagtggatgctgaggcctggagggcaggccccagagagctgagtgcccctccaggtttcatggctggcactgtggaccagtgtggcccactgcctgcttgccaccccacaacaaagcttcagaggtgcagaaccagtggcctgagctccagggacaggaagcatcttggcgtggggttctcatggtggcacttgcatgccctagtgcacaggggcggaaggggaagctctgttgcctgggccctttctctgtggcaacagatggggaagtctgccgtgaggatagagagtgcatggccatcccatcacagcacaggttgagtgctgagccaccccgagccctccccagcccagcggctctccccaaggaggcttcaaaaccccgtgctccctttgtacccccaagcccatgcttggctctcagatccacctcgggccctttgcaccccagactcctccccagctgcacattcccgggattccaggcatctggtgctgtgtgaggtcactaggacagggcagtctccccagggacgggacctgttcacatggagtttctggctggcaaaagcttgttctccagtctgagccaaacgcttgcatgactcttcccccacggaggcacttggacaggaagctggcttctctgcacagccaggggcactaagtgatcccatcctgcctgagcgtcctccacgtggctcataggctgtggaaagaggggcttggccccatggggacatgccagttcagagctctggcctccagccagagggacacctttctctgaggctcatggctgtggcatgaggtgcccagagagccctggtcaggcagccccacctcctgctgccccagggcagctgcctcccagcccaggtgaaggaacaagggagggcccctgcccagagcctttgggtagcagatgccagacacccacccccacctggagttcagaggcctcaacgtgcccccatctcctcctccccacgagcagcccatttcactcactgaggagctgggcataccccagaggggccctgggcaacccaacccttccctaagcttccctgtgggtgaggggcaggcagtcgtcctgggggctccatctcctgggcccagccccctgctctgaacactctgccaggccacccctaggccttgtcaacacacccttttacccatgccacgggatcttgcccagaggccacagggaaggccagggtgcacccagatccttcttggcctggcgctgggcttctcagggagccaacactgtggccacagctgctctgccctgggtggacactaggctttccctgtccccctactgcagtgtcctcagatgggggtggcctggtcccctgcagaggcacagccaccaatgcccatgcatagatgggtccatacagggacgaacacaggacaggaggctgcaacaggatccggtttattctgccttggcagggtggtcctgagagtggtgggtgccaccctgtccggggcggagagagggcccgagggccagttaaggccaatggcgggagaagcagggggctgcagcccctggaatgcggtgaagccaggccgaggcccggaggcagctgtggtaggccagggcagggtggaaggcaccggactgggaccgggccagggctacagggccgaggacccaggccacacgggcaccccgggaggcggggcacagggtcacgtgacacagaacatgaaacacaggcacagggtcataggccagatgcacatccagccatggctgggccagacactgggacacagtggtggtgtcacacacagaccacaggggggacacatggatttgacagccacaatgcacagaccaggctacagagctcgagggacgtgggaaggggccttttggcactactgcactggaatcgtgagacaaaggtagcaggacactctggcggtgcctggggcggtccccttgcggcctctctaggcttagtccgtcttccacactttgttgagcagcttcaccacttcatcatagatgacaaacactatggccacatccaggcagacccggcccaggcgggggacagtgcccttgtagaatctgggtgggaggaggggcggggagaggaaggcaggtcagcacagtgtccctgcacagggcaatccccagatactgaagtgagaggcacagaggcctgaaggggacagagtgggcaggccaggtaggccgggaaaggtttgaggtggggacaatagccctgcccctcccccactcacgccttgagcccctccttcttcaggatctgcaagccgcagtcccacgtgttccggtatttgtgcgcctccaggccctatgggggacatcagcaggcaggggctcagcagctagctctggcctggtccccccttcccctccccttcccggccccaccacctgcatccgggtcttaatcacatccagaggagtgtttccaaagacactggctgcgcctgcaatagctccgaagaccccagtgatcagagggttcatgggcttgttggggttgtcccctggatataggaggggtgaggtgggtcagagggtgccgggaggggcctggatcagcacttcaaaaggtgggtgcccgccacccaggggtggccccaaggagaggagaggagctggccatgtgcagagatggggccctgtgatgcagacacacctcggtaccagttgcgcagggaggtcatgacgaagaagcggatggcctggttcgagccctgcttcaggacagtggctgtgaggccctggtacgtccccttcagccctgcgggaaggcaggcacggggttaccctgcagcctctcaggccccggttgggaattggtgtgtgtggggggtgggtgttgcacaaagcccaaggcaggatgggaggtgcaggcccttcccaccctggcccaggtccctgagccctatcaggaaggtcgagtggctcaccttgttcccgcacaatctccctaaccccgtggaagaatcctctgtacttggggtttggggaggtctggtcgtggatgaacttcacctgagagagagaagcaaaggcgcaggttctcggctgccacctgggtgggtcctggctagctggcaggcccagggcccatccagggtggagggaactgggaactcttccccaggaagcagtgcagccaaggccgccctgggctgcccacacggaccatgccccgggacacagggcagcccacacggaccatgctctgggacacagggcagccctgtgagcagcctctccctttatgtttgctgctcttttccagttttggcagtgaaggtgtcattttgttttctgctttataaaagtattttttaaagactttaaggctgcctttagcatagactcagcctccacgggtggcccttcgtggcaggcgtcctgccccagggccccgcggtcaccccgccggccttccctggcgtccaggagaccctccccagcttgccggttgccccgggagcaccgggccagcggggccgcccgtctccgtactccctgcgtgtccggggtcctcgccaggaccttccccaccttgatggtctccatggggcacacgaccaccacggcctcggccacgccagcgcccaggccgcacagcagcccacgcgtgctgtccagccgtccctgggcatcccgcatgtggttgctgaggaactcgaacattccaaacctggaggcgggaggcgggtgagaggggctgccgcggccgagcccccctcccgcagcagccaccggccgggcctcacctgacggccgccttggggatggaaccgtagagcagggagctaaggccgcggtacaggcccaggacgccatggctgcgaaccgtctgccgcacgcagtcccctgggggagggggcggtcaggaccccacggccctcggtgccgccgccctgggtacccgccccccgcggcgccgcggcctccccctcctcaccgatgccccggtaccgcggcgggtgcgagcgctcgtccagctgcagctgcgtcttcacgtactcggtggggaaggtgatgcagatctcgatgccacccgccaggccgcctgcagggaccgggaacccgctcctgagactcccgcccggccgctggcgctcgggcccctcccccgtcccggacttcggtcggcgcggccgccgcgccagtgccgcggggaacataggctggggccccacgcccccatgccctcaccccgttgtcccggcgaggcgcagggggtgacagacgggaggcgggcgagtcccagcgcgccgggtggggaccaggaccgcgcctccacgactccccagcccacggcccaacccggaagtggggcggggcctcagcgtcccgggcccacccagaagcgcggcgggagaggggtccgcgtcccggaggggcccacctgccaggatcgccttccccgggtgcgtcagcttggccttcccggacgcgggcgcggcggccgccagagcgcgcggggcgcggggcgcgggcatggcgggcgggaggcggggcgccctgtggcggcttcgggtccgagactccagaactccgcgctcggtccgcggtggcggcggcggccggttatggtcccaggggcggggcggccgcgtcagctccaggtcccgccccgcgtggtccgagccaggccccgcccccagcccgccccgtgcgggccgggaaactgaggcctgggcggggcgcgccgaggcaggcgtaggggcggggccaaagcgcagccaatggccgaggccgagtccctgggcgaccgcgagcggcgggacgggggcggggctgcgggaggcggagccgtggcccagctccgagcagtgggtcaaggtgcactgtgtgccgcgccgcgggatagcgggcctcgggtctgcgcgactgtcgagagcggcgggatccccagggatcccggaggccaggggcacaccctccccgaaaacacgtggggctagcccagtcccagaggaactctaacgtttcaaacctggaggcgggaggcgggaggccggtgagaaggggctacgccgccgggcccccctcccgcagcagccacgggccgggcctcacctgccggttcccacccacacctttcccggttgtagtttctgcgctcagcgaacaaggtcaggaaagaccacaaatgcaagcggctgtattctcctaggcagcttgtctgggcaacggaggtcccacaccccaaagaggacccagcaaatctttaatggactgcggggcctaggaaactggcccgtccctcctacccataccagcaccaagcagagcacctttgcctggataaaccgactttaatatttatgattgccaagaggctgagagtccttttatgaggtccggtacctccaaacaagacgtgttcatgtagtcttcaaactggcctggagggggcagctccagccagtcggaggcgcccaggaggaaggcctggctccagcaggagggcccacagtccagtctctgttgtcggctaaagctggtcttgcgccgtcagcctctaccctggcctccccaggctctgggatggctcagaggttgccgtcattgggtttcagcaaaaataaatattgtccaggtgtccctgcctcccattgcgtcccctgtgctgctggagtgacatgctccttggagaagttagtaactctgcaggtagggtgggtggtgacaacgcccactacacgcggaagttgtacattggaggctggcgaagttgggagcagaggcatatccataggggaagctggcaggggctgggcccacggcagggcctgcagagggggaagcccacaatgagcagagctcttcctgcccatgggggtcctctcctggctgcccctgagtagcccggggcccagggagcagggtctataggaccagcccttaccacccagacgctgaggccccaagagagcaggcatccagaggcaaggagcgtggggtcagccagagaacctggcctggctagaggataagctagtctccaaatgggacacttacttagtgcaatcagctgggtctcattcatgcccatcaaaatctaaaaaaaccagaatgacattaatggtggaaggacacactcagccggacgctggagacccgccggcgtgctgcacactcacaccacaccctcaggcctgtgtttgccccacagtgtccaagcaccccacagcctctccagtctgctcgacagccaggctgccctgggcaggttctcaggtgcaaagcccctcccagcacacaccagcagcagccttgctgtccaggggccaggcccagcaggacacagcagtagttcacagctaggcaggcacccctatcagaaggcaggcatccttacagcagggaggacagcggccgtgccaacattcctgggcgtacacttctccacacccagtagccactgggatccttccagcccccacccatctattcccatccccatccaaagcccagccaggtaagggcagtgggactttgactccctccctgctccctccccagggggttgggggctacaggtgccacctaccaaacacgagaggggcaggctctgtcacatgctcctcttgcttgcgcagactctccaaggcatccagtttgtccacctgcaaggaggcaaaagcacgtgagcacccgcttgacagagtgcagtccggcctctaggtgaaagtggagtggaaggtcaggacacagggcctccaggagaatgacagtggaggaggtgcacatgggcagatgtggagtggctcagcccacaccccatgcacttttagaatgcagcaaggcatggagaggtgaagcctcggtagctgggctgagatggaacgccaggtggggcccccagagcttcccagtgggcactggggcagtcagttgttacaggctgtgcatgtggcctgcttatggggggccaagtcctcctctggatacagggacactgccacttaccgacctgcagggctggggccatgtgcagggaacactgtctgcttctggctctggccagtctagtttgcccgcccctccaaaccagcagagagatcatgtggctctcagagacaagtcacctggcacctagacacttcacctgagaagcactgaggacaaactgcctcctcactcttccctgaggcttcaccaggcactgaccccacccactgccagagagcgaggcggcagcactgcactagaggggcggcagcaactgtgcagctaggatcccctcacaaacacactgagtaagaaagagaaataagaatgtgccccccatgagctggggtctggggggggctgagaaatgaggaggaagcagggggcacacttgctgacacctagggtgagggctgagctaggcctgtaccctccctacaatgggagagcgctgggggcgtctcagagggatggccctcaagcttcccagatgagccacgaggccccaggcccagctgtccaccaggaaaggactgtgcttcttgtccgcgccctcattctcccagcactgctgtgtggtgtcagctgagcaccagctcaagctgacaatcagctcacacccccatgccactgactgggaaaccccttgccagccccctcctctccttgaactctccccatgacaggcgtctcatctgccccagcaggaataggtgggtggcagcagagaaggtgctccagcagccaccacctcccagggccagtggagtctgggaaccctgggccaaggctgtgcagccacagtgtggaccaacgtgatagtggctgctaactccatcatccgcaacagaaagggaatgtgcgcctcaaagtcctgggggatccccacaagcactttgacccccacagcaatgacactccctagggcctggtgagcctgagttcctctgacactaacccacgggcctctactgccaggaagagattcaagcactttctttccttgtgctggttctcagaacacagactactttcaggaaagacacccgagggatgggaaaacctgctcatcatggtgacagcagcttccacaggcacgcaccagacaccgcacaccacacactgcataccacaaaccacataccacacgtgccgcctgtagggagttgccatccactgtggtgggggaaccagggcccttgtcaatccaaccagtccatgtcccctggcagcccacgaatctcaggccacgtagccagggctgtcccttcctccccaacccttgagagtcatcagggagtctcactcaggcatgctatgcagatgggatggggtcacactgtcctacaggagggcaacggccttgaatggactctgggatggcctttatcaggggctgggcagccccctggaggctctgcaggcggcaggcagccctccaggctaaagctggcagcatgagcccgccttcctgtttccttcctacctcccactcacctgggaggcccctcccttccctcgctccactgagtgatgcttcagcatgagtgccttccgaggctctccatctggcttgaaggaggttagataggcaagtagatgctactggaagtagcttttccagtgttagaaacaacaaactgtaccagatgacactgctgacacaggtctctggacagtggctaaagctagatcccagcagggactcctaggacttcaacacccagggagagttttacaatcaagtactgtcacttcgatgaggcagagagtcatcctccctatagctgttagaaggattcagtggatctgtgaatactcctactatgtgttcagcaaaaggcagctaccaccaaccgtatgctaacagctgcacccccagacgccactgggagctcctcagggagctgggattgccagccacctcactgtcaccttgttgaagtccagggctggggatgagcacgcctgttgtgctcctagcagtgtgcacattgggacagctgcccagccagagtctacaggagggctgctgccagtgggcactccccatgatgattttctggaggggcttaacgttgggcagaaaaccacttcagcatgaaggaaagcagccactcctgaaggcagccagggctggctggggaatctgggttggcctcaaaggggcccacccttaagacctgcggccagagtcactgccagggttgggtcatgccacacaggggccggggagctgcagccggcccggcacctaccttgctcaggtactccctcatcacctggatgaagtagggcatggccaagtccacgaggttgtgcctccaggccagctcaagcaccatgtctgggcgaagcaggtcatagcaggtgaagagacaagctgcgaagcactccctcttgccttcctccaggaaccactgcagcaacttctgggccagctcagcatcccgcgactctgcagcatgctgcatggcatcctgcagccaaggcaaatgcttgcttgggcatcctgcaggcagaggctttgtgcctgcagcagctgggccggagggcagggagtggcactagactccaccaaggacttcctgcgctgtggagcaagcctggacccatggctgggccattccctatgccctgctgcccactggtgaaacggagatgccacctccggaggctctggaggggacaggtggctcacggaggcgcaggtgccctgggagacaggaactctagccccgagggcagagggcgtgcacaggctgctctgaggaaggcactgatgggagtttgggggttgtggggctgctgcagaggtgctgcactcaggtccatggagcgtgtgacaccaggggagcagttaggaggggtacggctactgctctagaaacagcaatgtgtttttctttcaagtggctcaaaaacccctaactgctattttcatccttgcaaatgtatttgtctaagacaatatcattgacaaaataacacctgcacctgaccagtcctgaagaagcctgcactttctgtggccattctctattttctagctccacagcaggcactggatcacctgattccttctatggcaggggctattagtaccccattcagagaccaggaacctgagacccagatgtagtcacttgcccagggccactccacctggagttggccatgatccactgactgtgacctgtgctctccagggataccctgtggcggtcccagctctgcatgcctgccatcgcctgcagcacacacctctgagttccgtttgggagacccctgaggacgcccagtgcccacatctgcatggacccgatgtgctgagctggctccggaaagaagtctcccccgctggcatgctgctcatcgatcgctgcctcctgacccacactgttcctacaaaggcaccaggattctgaccctcaggtgagagctccaggtgcctttgggtctccgctttgaggacctgtgacgcccgctcatctgtctccctgccgtgccctccaccggcccagcctacccttgctgacttgtcttccacatgtgcctaaagtgggccctgctctgttcctcctctgtgggccttggggactgtctcactgccttcccagaggacttccagtagaagcagcccccaggaagctcccagtcagtgtcccgctcctgcggcctggagcccagctcgagtcaggctctcccacaccctcctctctcatcacctccccggcccatgccactctcagggaggcttcatcctggtccccatccctgtgtccagctctccagtctacacctgtacttccgcagcccctgctcttcactggtgggtgtgggagggccccactgaccgaactttcatttaaatgctacttctgtcatctggaaatacagttttctgttgctagctggctttgccctgactggacacgctgtgacctggccactcctccaggaagactccaggaggcttcagctctggcctcagggcaggctcctccagtggcagtgctgaccttgggaggtctggggagccgcctgtgcactggggcttgtgggccccatccctgcctctacggcctatacacagcaccacgccctaagctgtgacaaccaaacattccctggggtcacagtcattcctggctgacagccactgttctgggggaagcgcgctcggccactttctttttttttttttttcttgagacggagtctcgctctgtcacccaggctggagtgcagtggcgtgatctctgctcactgcaagctctgcctcctgggttcacgccattctcctgcctcagcctcctgagtggctgggactacaggctcctgccaccacgcccagctacttttttgtatttttagtagagatggggtttcaccatgttagccaggatggtctcgatctcctgatcctgtgatccgcccgcctcggcctcccaaagtgctgggattacaggcatgagccaacgcgcccggccctgtgctcggccactttctatctgtggctttgtcctctggactctcttctgggcccacgtggctcggagtgggtggctggcaaggccagtaggcctctggcagcactgatggccctgctcactcatcactgcctgagtgttgaggaggctgtgtgtttaagcccctgacagggaccacatgggtaggacagaatggctgtgatcagccagccgagggcagccttccctcaggtgcgtctgagcccagctgtctcctcccagcagccaggtccagagacctccaggtgcggtctcagagcctcagcagcttttcctctccattccctctgcaggggccctgtgggcacctcaggaaggatcacaagcactgtcaccaagggctaggatatgtcacagaacagtccagaacactggaggtgacaacttagggtgaaactcaatgcaacactgatgcaggcatcagaggcctccacggagtctgagccaacagccgcagaccaggagccatgagaatgaggcccctgtgcgggacaggaagtggcaagtatccatgtgtcctgtgaagatactcaggaatgcctaaggccaactccgtaagtaacaccctcaggtcaagtccagagtctttgggcacaaggagcccttgggaattggctcagctgcatcacacagcacccacaagggccctcttgtacaactccacctcacccccgcggggagatgttcaggccaagcagaggatgttaatgccttcagggtcttgggggtccctccaggcagcccaacctgtctagctgatgcccagatcccggtctgagaatgatactaagaaacctctcaccagcagaaaaaacacagtttctttttcctctcaagtgatcctcccacttcagcctctaaagtagctgggactacaggtgcacacaaccgtacccagctttgaaacaaatgttttgaatgtgatttatttatttttttcctttttttttttccgagacagagtctcactctgtcacccgggatggaatggagtggcgtgatctccgctcactgcaacctccgcctcctgggttcaagcgattctcctgcctcagcctcccaagtagctgggattgcaggagtgcaccactacacccggctaacttttgtattttcagtagagatagggtttcaccatattggccaggctggtcttgaactcctgacctcaaatgatctgcccacctcagcctcccaaagtgctgggattacaggtgtgagccaccacgtccagcctttgaatgtgattttaatttaggtttttaaattcctcaaatctttttttttttttggagacagggtctcactctgttgcctagagcagtggtgtgatcatagctcactgcagcctctgactcctgagctcaagtgatcctcccttctcagcctcccgagtggctggtaccacagatgtccatcactacacttggctaattttttgtaaagatggggtcttgccatgtcgcctaggctggtctcaaactcctgggctcaagcactccacccacctcaacctcccaaagtgctgagattacagggaagttcccaaatcttgataggaagtaaagtaggtgccaagaagtgaatcttgccacactgtgttttggtagagtgaaactcacacaaaactgctgcgaaaagaatcaactccgtaaaactctacaagtctttcaatccaaacagtttttaaggggtgctagctcactcccaattcttactctatgttctaaatatggtctcccattaatactaatccccccacccaccacgaggatcccctggtgaagctcagagccaggtctcaggaacaagagggaagggatgtgacccccaaagccatcaggaaacacaccaaggcaggaaggtgggaggaaacgggcccaggccaccaaccttgtagagatgatccttcttgcagagctccacgctctgggcccaccagttattgcccttgtacagataggccgcaatgcacctgaactccatcagctgatgcttctccagctgctgagccaggctgatgttgtcaaagttgtcataggcatcgatagatgcccttaagccctaggaagacagcctttctgtgagggatgggacactgacatgggctgcctacacatggagcaggcaccttgtgttacttgatggctgttgctatcagcacagccttagaaaggcccctgcccatatatccactggtgtcctgtggggcctgcacaccctcctgtgcaaaggcagcctgctttgagaacagaatggcagttgcaggggaggagcccagcccacccaggacagggctccttcctgcacacccacctgatagtcctcctcctctgtcagcaggtggttgagtgcctcattcacactcttgttgttgtggctctggactgaccgcaggtaaggcttcaccaggggcagctgacctgcctgacaagttgagggaaccgtcaaggcacttggccaagcttgttatggggacactaggcaggggcacaggtgggcacgtgcgtgccatccacttgaatggtccagctctggagccaagggcaccttctggacacctagaaccaaaagacctacactcacacaaagaggactgtctgggcgattcagtggatgccaatgtcaccacagacattcacaccttagagagacacatgggtttgggtccagaccaccacaataaagtgaacattgcaataaagtgagtcatattaattcatgtttacactatgttgtagcctaagtgtgtaacagcattatgtctacaaaaacacagtacacaccttaattaaaaatattttagtgctaaagaatgctaacaatcatctgagccttcagtgactcgtaatctttttgctggggagggtcttgcctcaatgttgatggctgctgattcatacaagtggtggctgttgaaggctggagaggctgtggcaatttctttttcttttttttttttttttgagatggagtcttgctcgtcgcccacactggagtgcagtgccgtgatctcggctcactgcatcctctgcctcccaggttcaagcaatcaattctcctgcctcagcctcctgaatagctgggaccaggcgcttgccaccacgcctggctaatttttgtatttttagtagagacagggtttcaccatattggtcaggctaagtctcgaactcctgaactcaggtgatctgcccacctctgcctgccaaagtgctaggattacaggcatgagccactgcgcccagccggcaatttctttccttcttttttttggggcgggagacggagtgcagtggcgcgatcttggctcactgcaatctctgcctcctgggttcaagcgattctcctgcctcagcctcctgagtatctgggattacaggtgcgcgcccaccacacctggctaatttttgtatttttagtagagacagagtttcaccacgttggtcaggctggtctcgacctcctgacctcatgatccacacgccttggcctcccaaagtgctgggattacaggcgtgagccaccgcgctcggctggcaatttcttaaaataagacatcaatgaggtttgcctcactgactgactcttccctttatgtaagaccactctggacttgtgttgcataaaacaaaataaactaaacaaacaaaaagactctgtgcagcatgcaatgctctttgatagcactgtactcacagtagaacatttttcaaaattggtctcagtcctctccaaccttgctgccactttatcaaccaggtttatgcactattctaaatcccctgtagtcatttcaacaatgttcacagcatctgccccagcagtagattctatcttaagaaaccactttctttgctcatccctaagaagcagctcctcatctgttcaagttggatcctaagattgcagcaattcagccccttcttcaggctccacttctaattctagttctcctgctgtttcccccacatctgcagtgactttctccactgaagtcctgaacccccaaagttatccatgagggttggaatccacttcttccaaattcctgttaatatatggatattttccttatatactggtgtctttacttgtttccaacttcttattgatacatgatagttgtgcatattaattgggcatatgtaatattttgatacatatacacatgtgggatgatcaaatcagggtaattacgatatccgtcacctcaagcatttatcatttctttgtgttgggaacatttcaaatcttctcctttagctattttgaaatgcacaataatttattgttttttttgagatggagtctctctgttgcccaggctggagtgctgtggtgcaatctcggctcactgcaacctcccgggttcaagcgattctcctgcctcagcctcccaagtagctgggactacaggtgcctgtcaccacgtctggctaatttttgtatttttagtagagacggggtttcaccatgttggccaggctagtctcgaactcctgacctcgggtgatccgcctgccttggtcatccacccaccttggcctcccaaagtgttgggattacaggcataagccaccattcccggccattaattagcctaattccaatgctgttgtgtctcagggaatagggaggcccaaggaaaggaagagggaccagggcacggccagtcagcggagcagtcagaacacatacaacatttatccattaagtttcccttcttataggggcatggtttgtggcatcccaaaacaattacaatagtaacatcaaagattgctggttgtgtgcactggctcaagcctataatcccagcactggaggaggccaaggcgggaagattgcttgaggccaggagttcaaggttgcagtgaggtatgaccatgccactgcactcccacctgggcaacagagcaagactgtctcaaaaaaaaaaaaaaaaaaaaaaagatcactgntcacagatcaccataccatntnnngnncnaaaatttgaaatattgtgagaaatcctaaaatgtgccacagggacatgaggtgggcacatgctgttggaaaaatggtgctaatcgactttctcantgcngggttncaaacctccnatctttttttttttttttcttttgagncagngtctcacactgtcacccaggctggagtgcagtggcacgatcttggctcactgctagctgtgcctcccgggttcacgccattctcctgcctcagcctcccaagcagctgggactacaggtgcccaccaccacgcccagctaatttttgtatttttagtagagacggggtttcaccgtggtagccagggtggtctcgatctcctgacctcgtgatccgcccgcctcggcctcccaaagtgctgggattacaggcgtgagccaccgcacccggccacaaacggctaatctttaaaaaaacacagaatttgagaagcacaataaaatgaagcatgatacgggaggtattcctgtatctgaaacctaaaacactttgatacactggtgaatcttcaagtcagctgggggtcatttcaaaaactctttataaaggtgctatcattcagatgactttgttagagctagcccaatacactcttctacctggggttttggttgactcacctttgaaaagaaactgactgtccaggtgtggtccagccggggtgaaagcaccagcagcaggtcattgatgagcagtggtttgtaatccaaatagaactgcagggctctgtaacagagctcgacgttggcaacctgtggtgagcaaagctgagggtcagtccctgccgctgtctccagataccccagggctccttccagtttttgctcaaatgacactttactactgaggcctgccatgactaccccctataagactcaatggcctgtgaaggtgcctcctctcatccctgaggtattttgtcccccagcactgacacactgagcatttttcttaagaggccagcctcagggtttcctgcctcaacccagcacctagaccagtatctgatgcagggtccacgatcactcagtatcggctgaatgaatgaagtgtaatcagtcagaatgaagccccacagcaaaaccaaacaacagagtatgtttccatccaagcaagattactccagctttccttggaggcctcagcctgagccataaccaagtggacagcatgtcctgtgacatcaccagagcttttgagctgaaacactgtggtgctcagaccctgggtgagacctgaaggccagcccatgcagagagtggaccactctgggtggaccctgtgcctgtgctcctgggtctcgagatttggccaggctgctgtntctcttagcactttccccactggtctgccaccattctcttgctgggcgatgtcatcttttttttttttttttttttgagacggagtctcactctgtcgcccaggctggagtgcagtggtgcgatctctgctcactgcaagctctgcctcctgggttcatgccattctcctgcctcagcctcctgagtagctgggactacaggcagctgccaccatgcccggctaattttttgtatttttagtagagccggggtttcaccgtgttagccaggatggtctcgatctcctgacctcgtgatctccccacctcagcctcccaaagtgctgggattacaggcgtgagccaccgcgcccagccctggcgatgtcatttggtggcttgctgactgtggcatcgatgtccagggcctggacacagctctgttcagggagcatgcaagccagatgggcatgaaccaagacagtggtgatgaatgtgtctgcgtgagtgtgggggtcccgggatgtgcacagggcacagctggagctaaagtcatgctgggatcccagggtgatcaccactggagcctccagcactgctgggtttgggtgacctggcaaaaatgtggggcccgatggggtcttctgactaaaaggggtctaatggtcccactatggcttactggccacttcagggtgtcttctttctccttctcttttccttttgtgctagagcactcactgtcaccagagattctgacccagacaggcagcagggtccctagtacccgccaccatggattcagagcaaaacggtgaactggccgcatcacaaagcttcacctatggcactggtgggcccccagactctgccacaggccactgtgggtccactcctattggagctctagcacctgtcagccttctaggctggccctttactcagcagcagggccaggacatgggggcctcaactagacactgaagaagcagagagcagtcaggatgtgatgtggggctgaagagaagggtagggactcaagttcatcttctgtggcgaatcacctcctcaaagccccacctgcttccccaccaaccacaaggctcctcaggcctcccgtgaaggagaggaaccatccaaggacaagcccatttcagagactcttgcaggtatcacgcgagtggacagacttgaagtggggcaccagcagtcctagcttcccttgtgggacacctggtaccatgtgcactcttggccctttcaacaggtccatgcagcatggccggaatgccgtttaaggtggagtataactgccatgttcccacccagttcctctggtgttgaggcctgcagggacacacatctctgttgggctcagctgctgggatctggagccctctgcactacaggaggaatggagcggcggggcccctctggagcgtcctccagatccaagctgaaagacaggatggggtgagtccactagccacgcgccaggacatggagcactggcaggcccgtgcccactagcatggtcagcaaggacagccagcaccccagaagacatggtagtatccctgttttatacaagggaaaactgaaggctgggcgtggtggctcacgcctgtaatcccagcactttgggaggccaaggcaggcggattgtgtctgtaatttattccttccggtgggttcttggtctcactgacttcaagaatgaagccacagaccctcatggtgagtgttacagctcttaaagatgttgtgtccagagtttgttccttcagatgttgagaggtgtgagtttcttccttctggtgggttcgtgatctggctgacttcacaaatgaagctccagaccttcgcagtgagtgttacagcttttaaacctagtgcagactcaatgagtgagcagcagcaagactgattgtgaaaagcaaaagaacaaagctcccacaacatggaaaaagacccgaacaggttgcactgctggctcgcatggccagcttttattcccttatttggccccacccacatcctgctgattggcccattttacagagcgctaattggtccattctacagagtgctgattggcccattttacagagtgctgattggtacgttttttacagagtgctgattggtgcatttacaatcctttagctagatgcagagtgctgattggtgtacttacaatcctttagctggacacaaaatttctccaagtccccacccgacccaagaagtccaggtggcgtcacctctcaagatcacctgaggtcaggagtttgagaacagcctgcccaacatggtaaaaccctgtatctattaaaaatacaaaaatgagccgggcgtggtggcaggcacctgtaatcccagctactctggaggctgaggcaggagaatcgctcgaggctgggaggcggaggttgcagtgagccaagatcgcgccactgcactccagcctgagtgacagagtgagactccgtttcaagaaaaataataataaaacaaaaaaagaagagaaaactgaagctgagattccgccacaagctccaggatagctggttggcgtgctgtgctgcacaacctgaaagaagcgcccaccggatgccaggcacctgccatggaccacttggtcgggaggaaacatgatgtccattgtatggatgggataacgaggttcacagcggtgacacccctagcccacatggagagagacagtgaatggctgagctggggtgccccccgtgtgagttagcaagctcccctgctcaggctgctgctggcccagccctatggctaagtggattcctgctatcgtgtgccccaaatacagattggatgtcgtccatctgattggacccctgcactggcgagtatcctcctacccccttcacacctgagctgacagtgtctgtctcccacacggcagggtgtagtagaagcatcatgaatcacacaaggaactggactcagccatcagccctgcaggcaccagatgagagatgctgctctcccacacagtgagtctcagctgtcctgctattattttatatgccagtaagaaacaaaagcatggccacttccaccacggctcagcaatttttaaaaacaccctaatatcagaggagttacaatgtgaataaaatacacacaggattgatcaagtatggattttccagcacacagacaaatctacaaggcagcagccacgtgtgccaggccacagtaaggtatgacctggccgcactccctccagcaacctgcagactctgctcagggtgggacgccccatcaaaggcccccactttcacgtaccaccatgcccagtaacatggatgtcctccaacaagaagctcgggcttgtggcctggtgctcaatactgggttccttcaaatagttcccaggaaaggcagaggctgaaggctcacctggcagcacacgtgccactcgcgcccaccctcagtagccgcatgtggaaaagaggtgcatgagcgaggccacagctcactgctgtgccactccagtcacaagccgactgtgacaagttagttacccaaagaccatggcacaaagcgcagatacccaatgcaaagggatgggggctgaggataaagaattccagccccttcaccaaactcacatacagagctggagaggggtgggtcctgaggttgaactctctaagagaccggaaacaaaataacaaaggctcacttgaccatggcacccaaacccgacaccacccaacagtgtggctgctgacagagaaactcgggtcccggtttagcccagttaggctacaggatggaggcccactcccagacaggtaaggccgctggtgctggggagagacatgaactaaaaaaaaaaaaggtccgatggtgaacaataaccacaggaagtgggggtgggagccctgagctgacagggcagaaggaagaacgaactgaggcctggccacaagggcgtggtatggtgggaggggcgggcaggcagggccacagggccacggctgcatgctggcctgaccctgcccgcagctcagctgtgcatcgctagacgggtcacctgcccttcttaagtgtcagttcccttcaaagatggaattactaccatctgcccagagggtggtggactcatacaagtgaacgcacacacagcatgggggcatgctggtactcattccactcccacctgcccattcccctgcacccagaatagggcctggcagaggctggcaggagccagcgctctgtatcccctcttaccttggtaatgatgtccttgaactgaccctccttccaggcctcagtggggtggctcatcatggtgagcacagcattgtcatactcctcgtacttgtcatagaggaacaccagctcagcccacaggtgtgcctgctctgcagccctcagcacctggacaaggaggtcagggtcggcttgtgctgcacgtggccacggctgccagactgcaaggagtacacggtacctttgggatgttgacacgggaccagaaaagctccagatgctccagcatcttctgtggcttgaatttggagtagaggatggccagctcagtgaacatgcccatgtgggcccgctccaggcccagggccgcttccaacagcaagatcagctcctcaaagtagccacgatcctagcagaccaacagccacgcgtggggcagagtgattgcatgcctcctgcagccaccctccagcccatgcccacgccgcagggactgtgcttgtgactgggaatgatcccgaggaggcatgtgtgaagaaaacgtgtatacatactgtgctacagatcatgccatttacttagcaacttattggatcatctgacaattaccagtggcacactgcactacaattttcaagtttagtaagtgcaaattagtattgccaattttatttaaagaattagaaaaaaaaataggaagtgggtggtaacagggtctgggaatgatttgttttaatcccttgctacagctcattactgagatcctggctccaacaaaccttcaactccactcacgatgccacgtggctgttgtttcactgtgtccctaattatgatggccagccccttgcattcagccccacacgcctctgacactctccctggacaagaccagacgtctggttacagcctgctcagcatgcagaaagcctggagaaacacccagccatgtgaccctttccctttactctaacgaccacagccctgggagggtccgacctagaggactgcctcacacctcttgttttcccaaggaggacacccttctgtgccccctccactctcagactaacctcatttcccagtggcacacttgtctgctggcagcatctgcaccccccaatcagctacagacacgccgcctgtgctcctgtctggaacctgcccagcctgcagctccatcccacctgcttgcctaccaaggccacagctccggtgactcctcatttctcttctgccttattttcactctccacagctgggttcagcaagcatcccgctcatcctcctatcctaaacaccctcttgacccgatgtccctgctagctacctcccattttttctacttccttttgcagcaaaaactcctcacaacaaccattcccattcctctccctgttctctccagccaccatcaggctgagtctctcccaagctccaggtcacaagcagccccctggccctgccatcctgctgtctgctcagcagcaggccctgtccctgctgaccggcccctcctctccagtgcatccaggagccagcacactctctgggttttcttcccactgtactggctgctcctgctcccctcctcagcccacccctgttgggcagtctggtcttttcacctacactcatccccaggggactgcaggcaaacatagatggatgtggatcacctatatgtcagcaactccaggttcactgctctagctaggcccctcctctgtggagctccagatctgtctccagctgcctacatgatgcccccacctgaacatccagcgggcagctcaagacttagcaccatgtgtccaaaaagtaattcttgtccttccctcccgtgctgcaccttcagtcttcccctcatccactggtgataactccgttatttctacttattcaagccaaaaccaaatggagttatcctgggcttttctctctcactccacatcagtgcattagcatatcaaggtggctgctcattcaaagcacacacccaatcctgatggcctgatcacctctcaccctgtcaccaccaccctagtcagagtcactgtcccttctcgcctagaccactgcaacagcctccagctgctcttctggctcctgtccctactcctcaagtatgtgtctcagcacatgagccaccatgatccttttacccccgacagccctgcacccatcccaagtacagcccgtgaccttcctaacggcctgagatctggccctccgtcagcctctctgccccatctctggctccagccccttccttgaatacacagcacacttctgcctcaggactttgcctggccactgacccttccctcaaatgttcccatgaccaaatccttccatttcttcaggtctttgctcaaatgtcaccccctcaattgctgctaccttgaccgcccctttatgaaactccatccaggcactcctatgccctcaaaccggctccattttcctctataactgatcaccttcaaacacactatataattattcattaggtttgttgcttgcctgccaaccttgctgaatgccagttcaattaaatagaggcttttctgttttgttcactgacacaattattgagaataatgcctagcacacagtaagtactcaaagatttgctgactaaattgttcttttgtcagccctgtactgcttgatcaccctccctgttggctttccagttcatttctcaggcgcctctctgggggtgggaaagcatttctcattgaaaagccatcacacccagctaatatctggacactctggcgctggtgcgagcccctccagacaacgtctcacatagtgaggggtttggggctcaatttccatggccatggtgacactgctgagcagagtcagatcccatcttcgtctgccttgactaaccatacctggagttgtcatgtggctctaggaatcccacaggtggaagcccaggtccctaaacacacaaatcactgtctaccaaccactcaagagagcctacctacagcatgaacatacagggccccacccttccaaagggtccaggtggggttccctctcttgcctgtgctttgtccctaaggcacttgaaaaacagactactggggctgcacactgtggggaactaggctatggactagagctctgccaccaccagcccagtattctcagcaaccctccaagggttgttcccgtcatgcaagccactgactgggcttctgaaggcccaataacacaagaggatggagagaacttaaaaaacacaaaattccagccagccatgaggtcgaggatagctaacaaggcaattgaatttagttcataaatgactgtctaacacatgaatcttcccctcagggccatgcttcatatttgcagatgcaacactgtgatggtcacgagctaaggggatgaccgtgcctctctgtggagtgtttaggcatcacttgtcatctgcattaccagcagagatcatctggtcacctggtaatagcacatcagctcctccagctcatctgcatgaatgacgatgtgaagaccacacagctgtgcgaagcggaactcttgtccatccatgcaggcaaagcacacctaggggacggagggcaagcgtgagggtccccaagacaggacacagcaccacagcagctgacttacaaggcacacagttgcaaatgcagaaataccagcagtggggtattttaagttggattctgaacaagtagctaactctatgatgaattgtacaagactgggagaaaaaatatgacatttgtaatctgcaggccaagggggtgcttgagaccatggaaagaataaagtttgtgcattacttcgtaggccctgagttttgttcaggtggcgggaaagtcatgctggaatttcaggtttggggtttgaaaaggaaggctaaaaaataatgaccatcagaatgcatctcatctgagtgttgttttcacgggggagcttgttttaatagttttttagactacttttgttttctgcactgtacagtatgtatacttaatgataacaagccttgagaagtgcagaattcccctgtacaaaaataatcacataagccagtgtcattaacttgagatataatctttggcccactgtttcctatgtgtgatgcatacaccagcaccctgacaaatttcccacataaacacagtggaattacatcatacattctgcatgatgatatattcctcgcataatattggcaacatcttttcctgcaactctgcctattcatcttaaacagcagggtagagttgtaatgcatacattaacaaaggccttggccgggcgcagtggctcatgcctgtaatcccagcactttgggaggctgaggtgggtggatcatgaggtcaggagatagagaccatcctggctaacatggtgaaaccccgactctactaaaaaatacaaaaaaattagccgggcgtggtggcgggcgcctgtagtcccagctactgggggagctgaggcaggagaatggtgtgaacccgggaggcagagcttgcagtgagccgagatcgtgtcactgtactccagcctgggcgacagagctagactccatctcaaaaacaaaaacaaaacaaacaaacaaacaaaaggccttgacattagacctttaggctaattttaatctttcattaaacaatgctgttttggatatttcttcagttttttctacttgaagatggattctgatattatcagagagcctccagacaatttaccaatttgccacaaaggaccaataatgtaaatttacactgattatgcaaataaggtgacatgatttaaaagtgttatgaaaatacttataatactggtaattccatgctattaaggctacctctgggggccaactggttccacatcagattctctggggcctctgttccaactacaaacactagcctagagactctaagaatcccaagggttcagacccctgcctgggcaagagaccggcacccagaagagtaccgagcagaacgcaaaggacacggagagcgtgcctgtccagcacactctgccgtctgcagttgcccgcagctcacctccttccacgtccgggtgctgctggccttgcggctgttgtccactgctgcctgatactcaccgaggtgaaccaaggtggaagccaggcgggcaaagttagaaacattgctatagagcagcttggcagcctcgtacattccctcctcgtaacagcggtctccaactacggataatagggtagctcgactgagacactcttcaatgggaagatttctccagagttgcttttaagttcctagatggcagaggtatttttctgtttgctagggtggtaagcatctttctgatcgcaccagtgaccagatgaagttggccttggctttctagtccctggacaccctcctccacctcagggggcgcttctacctgcccgctcctatctaaccctgcgttctggcacctctcaggccctggctgtcacctaccacatctgcaccccactgggcctgggctgaggaggtgtgctccttgctgcttccaagccgttccccttcctcctcaataaaaaccgttcacaaccaatcttgtgtcaggtatcactcaccagccctagttcctgatgccatttacaaatctttctcattctctggcaatttatttgacttcctatgagctggggaccttgttcttctcacaagaacaagtcactgccatagccacaccttacacctcagaagagagatgccagccctgggaaccttccacaagtacctactctgcctagcactgcccagctcgccatcctgagcgcctcaactccaccagtccagtgactggactgaattcctgcagccctgtccatgcccaacttgcacttgccccagctggtggccccagatcatgctggacagctcctggcattcactcttgactctcctgattgttctcagtcctgctcagagctagttctctgcccattccatacctgtggctgcagagctaaacacagacagcagaaccccaaagtgctgatgggtctctctaaattcatgaaggctaacatcaaatgcactggcaacactacccatcctacttccgccatccacagcacctcccgcaccaaccctccttccgccatccacggcacctcccgcaccacccctccttccgccatccacggcacctcccgcaccacccctcctttgccatccacggtacctcccgcaccacccctccttccgccatcacggcacctcccccaccacccctccttctgtcatccatggcacctcccctccttccatcatccatggcacctcccctccttccgtcatccatggcatctactgcactaccctacttccgtcatccatggcacctcttgtaccacccctacacgcctgtcatccatagcacctctactgccacccctccttccatcacccatggcatctctcatgttaactctttcatatctccttctcttctcaaagctctaacgattcctcaagctgagtatttggcttcccttttcctgagaaaacaaactatcaggagagcctttcacagcacagtgtccgtggaatgtccttcctatgccaccaaggcctgctccatggatgtccctgaccccctctccacatgctccatgtcagggtttcagcaaatccctgcatcagcatccatcaccttctgcactcatccactctgacaagcttaaagaaccactgttcttttctctagtttaaaacaaaacaaaactggccaggcacagtggctcacacctgtaatcctagcattttgagaggctgaggcaggtggatcacctgaggtcaggagtttgagaccagcctggccaatatggtgaaaccctgtctctactacaaatagaaaaattagctgagcgtggtggcgggcgcctgtaatcccagctactcaggaggctgaggcaggagaatggcttgaacctgggaggcagaggttgcagtgagctgagatcgcaccactgcactctagcttgggagacaagagtgaaactccatctcaaaaataaataaaataaaactaatccaacttgctctgccctcaacttacctgggggctgtcagcctgtttccatgcttcccatcagagcacagttctcagggagtatctgtgtgtctgtaacagttgtcccctgtcttcctattctctctgcaatccactccaatcaggcttctgccagcctctctgccagggtcactgctcctccagacagacgcagacatggttttctggacacccctgcctgcttttctcccaccccgctggccagtctccatctccccctctccctgctgtggggctttggggtgctctggcttctttggtccatccccccccagccccacacccccactgccatgctctcccacacaggtggcggctgtgggtgctgcctgtccctggaggctgcccatgcacatctctagtctgggcttctcctctaaaacctaactcctacttccagctggacagatccacatggcatctactagaggtccgacttgtccgaatattagtcctgatgcccccaggcagtcctcacacactgtccccacactggtaagcatgactgcccacacccccaagcttgacccgccctcactgcttctctcctcacaccccacttggcagcacgccctgccggctctgccttcaacacacatccagaagctgactatgctttgcacttgccttgcccactttatctgctgtcgctgccccttgcgacatcactgcaccatcctcctctatgcactccctgctccacccttgtccttcactctgtttgtagcatagcagccagaggggttccgctgacccctagaccagatcattttcctcctctgctcaaaatgtccagtctcgcccagagcagaagccagagaagccagagtcctgatgacgacccctgaagtcctgacccgcagaggccaacagctgcctcttcctactgctccccaagcctctctcgctggatggctgtgctccagccaggggctcctgcaccccacaatgctcctcacaggatccttgcacttgccccgctgtcttgttctaagggctccttcccagaggtgtacagactcagcacttacccaggggccctttctaaaaccagaatgtccactgtcacacccacaccgttccaacgcttcttatccctgccccgcttcacttagctccttatattcaccatttaatagatcacagtatttttaagaatcttatgattcacggggcagaaatctgattaccattttccctgctacatccatagcccctactctggcacacagctagctgatgcttaataaaaggtgatgaatgcataaatgaagtattctatcaaaggggtaagcatgtaagacttgttactgccaatttacaggaaacgcagggaaaatgagttaaatgacattgtggagttgcagtcagcagatgccagactgtgggaaacatacacaaaccaggcgatgggctgggatctggcccccaggctgaaggttactggcccctatctcaggggagtgacagcagaaggcagagagcttgccaggcctggggccactatgaacataggtaaagagccaggtgtgcctctgccccacccagccggccctatgtgagggagcttctgctctggcccacagcgcctctgactcaggagaaccctgttactaacccagagggggattgggggcaaggctttgttttctattattttaactactttttggattataagggcaatttctaaagttacatgatcactgattaaaaaaaaaaaactttgcaaacacaggcaagtaaaagaaaagcaatatgatattgccaattccaaatcccagagttattcactgtcctcatcagtattatactccattgatggatgttgttatttaactatttcttggccgggcacagtggctcacccctgtaatcccagcactttgggaggctgaggcgggtggatggtttgagcacaggagttcgagaccagcctgggcaacatggtgaaaccccgtctctaccaaaaatacaaaaattagctgggagtggtggcgtgcacctgtggtcccagctactcgggaggctgaggtgggaggatggcttgagctcaggaggtcgaggatgcagtgagctgagatcgtgccactgcactgtagcctgggtgacagaggagaccctgtttcaaaacaaaacaaaagcactatttccttttgccagacattggcttttgatttttatttgcataatcatgctgcaatgattaaatatttataggtaaaactatgtggatcttttctactttcttgggatagatttttacatctagacttagaggtccatgtttagaaataataaaactctatagctatatttcaaatatttatgtattagctgaactgatattttcctttatgctttcttccactgcttacatgtttaaaaattcctttctcatgcaaaaattcaaatacatatttttaaaaaattttaaggaaaagctcaatttttacctttaattctttcatctggaattttacttggttacagaattacatgatgaacttttaacacctttcaaaactttaacttaatttccaaccattgttttttttttttttgacacaggcttctcactccgtcacccaggttggagtgcagtggcacaatcacagctcattacagtcttgacttcccagcctccagtgagtctcccacctcagcctcccaaatagctgggactacaggatgtgccacaatgcctggttaatttttgtatttttggtagagatggggtttctccattttgcctgggctggtcttgaactcctgacctcaagtgatccacctgccttggcctcccaaagtgctgagattacaggcccttcacccccttgttttctttttgtttgtttgttttttaaagacagggtctcgctctttgcctaggctggagtgcagtgccccgatcacagctcaccccgatcacagctcactgcagccttgacctcctgggctcaggtgatcttcccacttcagccttccaagtagctgtgattacaagtgcatgccacacactcggctaatatttttnagttttttgatagagatgggggtctcactatgttgtccaggctggtcttgaactcctgggctcaagtgatctttccacctctatctccagagttgggattagaggtgtgagccaccgtgcccagccccaacaactacttggaacttattttgaaataaaaagctcaaagttcattttggttattttttttctttttcctttttagagatgggggtctcattatgttgcccaggctggtcttgaactcctgtgcccaaacgattctcgcacttcggcctcccaaagtgctgggattacaggcatgagccactgtgcccggcccactttgttgttattcatttcaataaattgcatgcgttcctccaagaagtgcacttgtaactaatatagagttataatacattccattatctcttcatgtctctgcatcacattttccaagggtaacatcttatctacatggcggactccacaattatttagatcttttatttatggttaaggtttatttaaacattttggctttattcctattaaaaaaggaatgttttcttccccattatgttatctgatttttggtgacataaactactaatttttttttttttttttttttttgagacggagtctcgctctgtcacccaggctggagtgtagtggtgctatctcggctcactgcaacctccatctcccggattcaagcgattctcctgcctcagccttctgagtagctgagactacaggcgtgtgccaccaggcctggataattttgttatttttagtagagacggggttttgccatgttgaccaggttggtcgcaaattcctgacctcaggtgatccacccgcctcatcctcccaaagtgctgggattacaggcatgagccaccatgcccagcctattaattttcaatatatattttatgcatccagattattaactctgactcaattaattttgttttcttgtagtaaacagaacgcctggatgtaagtcttcacatctcttctaggagaattattctgatgtgtatagccaagagcatgtcaaaattccatgggtctcaatttccataccaataatagcaacaggttacttacttcctcgtgtggcttgcttctcatgatctttatctgcatcacactaaagcagcggtccccaacccccatgccacggaccgctgctggtctgtggcctgttaggaatcacgccccatagcagcaagtgagcagcaggcaagcgagtgaagcttcatctgtatttacagctgctcctcattgcttgcattactgcctgagctccgcctcctgttagatcagcagcagcattagattctcacagagcacaaaccctattgtgaacagcacacgcgaggatctgtgttgcatgcttcttatgaaaacctaatgcctgctgatctgtcactgtctccatcatccccagatgggaccatctagttgcaggaaaataaactcagggctcccactgagtctacattatggtgagttgtagaattatttcattatatattacaatatgataacagtagaaataaagtggacaataaatgtaatgcacttgaatcatccccaaaccacccccgacctgtctgtggaaaaactgtcttcgatgaaaccagtccctggtgccaaaacagctcgggactgctgctctgaggaacatccctggacctaaatctgactggcagtgcacagcccccagggggcatggcctacctgctggatgtgggcattgttgggtccattaataaaatcttctagctcagaaacacggctggttttagccaaggcaaaaataagttcagtctctatataggactcacggccctttttcctggccatctgcagaaatttaactagatcctcccagttgtctaaagacagaaaacaaagataggttaacccagagctgataattttaaacaagggctcaattcctcccattctgttctcagccagacacatttaccctccagttatgtctcactgggaactcagactccagataacgtctaggaggtcttgattatgctcactaagcagatccatagctcagaagggaggaggggaggggcagagccacactcaggccacctcccttagaaaagactttgccaggagacagaatgcttgttctggacatcagagaggtcggtgccacaatcaacttgaaacaccagaagatccctgggaattgtgggcctgtcactcactttaaaattactacagtggcgatattgagatatctagtgtgcttaaatgacctcatcttgtaaaggagggcaatagtcaactaaagagctggtgtcaataacagaataatgtttatctcagactcttgtgggaaactttcatgtagatgtgccctctgatatctctggatacatcatacgtagagatttgtgagaatctcttcaacttcttgcttcagccaggttttgcatcagtgagatgcagagccctagggagaggggactcacttactgctcctgctggctgactgaacaacttccaggtaagaggaagggtcgtcccctctgatataggagttgatggcttccttcaccaaatctttctggagctgggcttgggccagctgactccacacagcaggctcattgcatctctccgcaaactcatatgcccggtccaggtttccaatgtgctcgatcaggacctaggggttatgagaggacttccattctctgcaacatctagtcagctccaaaaaacagacacatttttgtttggtttcctgttctgcctaaagctgcatgaccatttcacttcagtcagaagcaatcaggtactaagcatttctcagatggacaggttgagggaagagacaagagctattatatgagaagggggatgccgaacaaagaagagacactccaataaagaggcacagagatggagatagccaggttaagctttctgggccgggggtaggacatgggacttgctcctgaccttgggaggaaagacagtgcaacagagcatagaaactgtaaaagagttcacaagaattgctgtggggaataagattgctcaccaggcagaaacaggcttgctgagcagtctggcagattgcgtgacagtgagggccacccactgtatagtagtggaggtggtggcagtatcagctgccccctaatatgatgagctggtctgtctcaaagcaaggccagagcccatgagggggcacaaaagaagggctcctggattgggggtttcacagcaggtatagaaataaggtaaaggaagaggcaaggacataaagataattggtaggacagcagttcaggtgagatgtcctgtggtttacaactgatttggaaataaaaccagaagaggctcatagactggaaagaaagggatgcagtttaaagaagaagagttcttgaggaggcagaggggcaggcagggagggctggagggcctgctctgggaacctgaccttggatcctgaaaagctcctgctgaggagatgggggaatggggagtatagggggtgagtagcatggtgcagagggctggaatggttgtcattgagggtaagatgtgagtgcctctgaaaatcaaacgtttctgtcacctgggctgaccgatgacattgggtcaggtacccaagtccaagggagtgctggggagtaatagggaaggggcagactaacagccaatggaaggagcacccacagagaaggtcaagacaaggggccagcgggctgggaagatgggttgctggtgaggaacagagaagagcacgaagagatgcactggacaaccagagggtctgacacccttggagaggacaagggcttgcagggcgcactcatgatgtggcagaaggtgctaggtccgacatgcttacactcagcagcccacctggattgctgaggcattcatatcaaacttgtggaaaacggtgaaggcctcctcatacagtgcgctgctgacagcgatgctcgcgatgtccagtgcgtcatagttgtccaggcggctgatgtactccatgacccgtgtgcggtctgccttgatggcagtcaggatcaacagattctgtagattcctgaggagagagggtggtcagcacggcatcccaggaacgaaggctgcacaaaccattttttggcaggtcaggcatccccagacccccagtttttttaaaaaagtaattaatatacacacacataactgctaagtaaatacaacagagtatttgtgaagtatttgggatctaaaaagaaacagtatagcaaagtcttgggaaagcacaggtaagagaatcagaatgtgccaatcaaaccactgggagggctgctgtggctttttagagcccagcctctggatcctgctgtagaggtacctattttcctacctgtgctttctttgtgattcattatagctttatcacatctactgtatttctaagcaatataggcagctttgcatttttttttaactttttaaaaattttgagacggggtcttgctatgttgcccagctggtctcaaactcctggcctcaagtgatcctcccaccttgcccccacaaagtgctgggattacaggtgtgagccaccacaccaggtcactttgcatttcttgaactttcctttgctttaattataatagatgcattcttgcaaaactttatacaattcaaaaatgtggaaaaaaaatcagtgtaacacaccacatatcaataatctaaaaaagaaatactacatctttatcaaatgatcagaaaaagcatctgacaaaatctaacacctattaatgagaaaaactctcaactagaaatagaaggaaacttcctcaatctgagaaagtacatctacaaaaagcccactgttaacatcataagtaacagagtctggacactttccccgaggatcaggaacaaggcagggatgtccactctccacacttctatttgtgctggaggttctggttaaggcatttaggcaacaaaagaaacaaaaagtttcttttctataatgaatcgcaaagaaagcacaggcagcactagattaggaagaaataaaactgtccccggtgtctcacgcctgtaatcccagcactttgggaggctgaggcgggtggatcacaaggtcaggatatcaagaccatcctggctaacacggtaaagcccgtctctactaaaaatataaaaaattagctgggcgtggtggcaggcgcctgtagtcccagctactggggaggctgaagcaggagaatggcacgaacccaggaggcagaggttgcagtgagctgagattgcgccactgcactccagcctgggcgacagagcaagattgcatctcaaaaaaaaaaaaaaaacaaaaacaaaactgtcccaatttgcagccaacatgattgattaaaaaaaactgaagaaatctacaaaaaaaaaaaaatccaataaatgagtttagcaaggttgtagaatacaaggtcaacatacaaaaatcaattgtatttctatatactgacaatgtttttcaatgaacaactgtaaacaaaaaatctatttaaaatacttccaaaaatatgaaataagtataaatctaataaaatctacatatgacctatatgccaaaaactataaactgctgatgaaagaaatcaaagatctaaataaatggagagacatatcactttcatagaatcaacatagtaaagatatcaattctccctaaattggtccatagatttcatgcagttccagttccagcagattttcttgtacatatagacaagctaattctgaaatttatatagataggcaaaggaactacaatagctaaaacaattttgaaaaagaataaagttgagcccaggtatagtggctgacacctgtaatcccagcactttgggaggccaaggtgggaggagtgcttgaacctcagggtttgagactagcctgggcaatatggcaagaccctgtctctaccaaaaaaaaaaaaaaaaacaactagccaggcatgatggtgcacacctgcagctactcagaaggctgagatgggaggactgcttcagcctaggaggttggggctgcagtgagccgtgttcatgccacagcactccagcctgggtgacagagggagaccctattgaaagaaagagaaagaaagaaagaaagagaaagaaagaaagaaaggaaggaaggaaggaaagaaagagaaagaaagaaagagaaagaaaaaagaaagaaagaaagaaaagaaagaaagaaagaacaaaggtggaagaattacactatctggccaattgatttttgacagagatgcaagagcaattccatggagaaagagtatttttaacaaataatgctggaataaactggacattcatatgcaaaaagctgaacctcaccctaaacttcacactttattggataatgaatctaaatataaaatgaaaaagaatgaaacttttagaaggaaataacagaaaatctctgtgacctgggagtattaacagagttcttgttttaacaccaaagcacagtccataaaagaaaagtttatgaattggactttatcaaaattataacttttgttctgttaatgacactattaagaaaataaaagaaaatctacagaatgagaaaatatatggaaatcacatatccaacaaaggacttgtatccagaatatacaaagaactctgaaaactcaacncctaanccaaacaacccaattaaaacacaggcaacagatttcaagagacacttcaccaaagaggatctacggatggtaactgagcacataaaaagttgttcatcatcattagccactagggcaatgcaaattgaaaccacaatggcacactgctatacatttatgagactggctaagataaaaaaataccaatataccaagtgctgctaaagatgaagagtgactggaactctcacatattgctggtgggaatgcaaaatgacacagccattctggaaaacaatagtgaggcggtttcttaaacagtacatataccatgtgattgggtatgtttaaacaaaaatctggacacaaatgttcacagcagatgtattcataataacctcaaactgaaaaccacccaaacgtactttgatgggtgaagagatcctgtggtacattcgtacaacagaatatcattcagtgacaaaaaagaatgtaaggctgatgcgatgcactcaccaagttggatgaatctcaaaggcatcatcacgctgggtgaaagaagcctgtcacagaggagtctataccacgtgactccatttgcatgacattcttgaaaatgcaaaactagtgtggcggggtggtagccagggttgggggttgaggtttgggggaatgtataatatacacggtagctagcacaagggaatgttaaagggtgatggaattgtttgtatcccgactgtggtgattctacagatctacacttgtgttaaaattcctagcactgcattccccatccccttccagaaggtcatttttactgtatggtggttttataaaaaagaattttaaagttgggtgctaagggtcatccatgtacagtgttcatttctactgctatctggtattccactgtatgactgtactacagcctacttattgatggttatctggatcgctcttagagctttgtcttgagtatccctgcacatctcctcatacaaataagctgagttcctttagggctcataaggaagagaggaaattgctggctgtgtgcatcttttttcaccaaactgtttccaaatgtaacgcacattcccagcaggggcacgtcagaggtccagctgttcaacatcctcatcagcactgattaggagagtggggttcctgctgctctggcaggagtaacaaagcatcggatgatgcactgtggcctcactctgtgcctccttggtggctgatgaggctgaattcacaagctgcccttcctctcaccggagggtgtgctcaagctctctgcttggtttctcattgggttgcttgtgtttgtcttttattacaacttttccctactaattttttgttggttgtgttgcaaatatcttccccgcatttgtagcttctcatttgtccatcttctttacgataaagtgcttaagtttaatacagtcttattggtttttcactaaaggtttatttatggtttctggtttctgtgactggcttaagaatttattaggtcataagtatattcttccaagtatatactctaaaaataatatattttgcttttttttttttttttgagatggagtctcgctctgtcacccaggctagagtatagtggtgccatctcggctcactgcaacctccacctcccagactcaagcgattctcccgcctcagcctcccgagtagctgggattacaggcacctgccatcatgcctggctgaatttttatttttagtagagacagggtttcacccatgctggctaggctggtctcaaactcctggcctcccaaagtgctgggattacaggcgtgagccactacgcccagccaaggctatttttacctacgcataaaactgtctggtgaaatcatcaatgaaagaagagcacgaacttgaggttacctgcatgtttgagaagcaagtgtttaagaagacagcagagctacagccacctgtaagtgcctggaagtacacacaaactaacaactatcaaaggaggttgatcagacagcaagacagaatatcgtagccacctcaggcaccttaatcctggcatcctgtcattagtcagggtttatgattccattaaatataatttcacattccatatgccattaccatatagcatctccaagtttaaaaacacacacacaaattcctctctataatactacagcccttgatagcctttctggcctacaaaataaatctcataactaaatctttacagctgcacttatgatgtgagttgattaaaatctgacacagaatctctgatggtgaattttgaagtggagaggaaccccaggtggctggcccatgcggaagcacgcactcttacctctatggtgcctgcccatgcaaaagaagcacgcgctcccacctctatagtgctggtccatgccgaaacacacactcccacctctatactgccggtccgtgtggaagcgtgcactctcacctctatagtgccggtccatcggaagcacgcactcgcacctctatagtgccgggcctgtgctgctgcccctgccacagctcctgctcatctggcttctacattatacttcgggcaagtcttccctgatacatgcccagatctggttctcctgccacctttctccaagctttgttcaccatgatttgaagagttcaacacatccttaggccacatgagaccttcataaaatgccagctccctttctctgagcattgtgttaaaggacagtgtgggccagagcagtaagaggagcgcaggctcctagaaaatgtgaaactgaggctgggctctgagacaggcaggagctaataagggaagggctagattgaggtagaggaggtggtaagaagattggcatgtctggggagcagccaatgggcaggctggatgggtgaagcggtacgagattgtaacagaagatgagtatcaagcagatgttttgaatctgcctgtgtccacagctacccctggcatagcctcacctgtgctcgctgaagacagagttatccagaactatcttctccagcagttcaatcagttcattaggcaggtcggctgtcataaaggctttgacagtgaccgaaatctcttcaggatcccgtgtttctgacaatgctgtctgtaccacctggttttaaaaagcatttgaaagaacttgattaaagtcaattcaagactgtatctttgaagctaaacagaagggaaggactcctccaagatggtctggaatagacacagagaaaatgggagacttcttaatgtaacaaaggaagggttttcaaagttaatttcaggaaattctgtttgctctgttttgacaattagtttttctctcatatcaaatatgctacagactcttactcagctccaatgaccagtgcaccaggcattttgaaatgaatgtctccttttagatttgtctcttaaagccactaatagcaaatatggctccacttctctaatgaagacaccgcagggcttccagcagcctcttactagaagagagcactgccactgctgtggcacagtccacagccagagctgtggagccacgtgccttcacaccggatgacactcagaaccacaatctgaaggaaagaccaacaaaagactggctgtgccacccctcctccaattataggtgtctcacatacaaaaacacttacaaatagggtggaaagacagttttccaaagagtacatttcccatgcaacagcagtttggaacgccagcactgttctctttgcactttggaccaggcaccttcagtgacttccagaatctaatatttttgccaagtttctggttctcctcaggggtgggcaacagccgtgtatcaatgagagggaagagacagctctggacggtctttcatggctaacacagccctctgaccatgaactttcacctagcaatcttgaggggccttaaaggaacctagggtcaaggtcagtccagtccacctttctgctagtctttgtgaactcaatggtaccataagatgcaaaagttctacctctgtggaatttgtagtaactacaacaaggaggctgaagagtttgagaacaggagctctcccagcagctaaggaaccaaaagggtatgcctgagggaaaggggcaccaggacacagcacaagtccatccaaaggagaaggtacacttccaacagtgacatctaactgtcaattcttgaaaaccttggaggccggccgcggtggctcatgcctgtaatcccagcactttgggaggccaagacgggcagatcatgaggtcaggagatcgagaccatcctggctaacacggtgaaaccccagctctactaaaaatacaaaaaagtagccgggcgtggtggcgggcgcctgtagtcccagctactcgggaggctgaggcagaagaatggcgggaacccggaaggcggagcttgcagtgagccgagatcgcgccactgtactccagcctgagtgacaaagtaagactctgtctcaaaaaaaaaaaaaaaaaaaaaaaagagttcgagaccagcctggctaacatagtgaaaccccatctctactaaaaatacaaaaattagccaggcgtggcggcaggtgcctgtaatcccagctactcaggaggctgaggcaggagaatcacttgaacctgggaagtggaggttgcagtgagccgagatcacgccattgcactccagcctggtgaagagcaaaactctgtctcaaaaagagaaaaaaaaaaaaaaagaaagaaagaaaaccttggngcancttaaataaatacacacaggttgttttaagggcaaaaataaatttctnccatctgtttgagtcaatacaggatgccccacctaaggttgcctcaggacactgctctcagtaaacttttcataatgaggttccactccagacactaaaagcagcctccctctgttattatgcgctctggattacaggagcattgcagttgaatttcgcaccaggaggtggctacagatatccaattacagcagagataatgaaagaccagcagctctacccagaaacaggaagacaagaggcccccgctggctccggtatggtgcagtgttaaagtggcccttccccagtaccaacatgaagtcaccttcaaggtgtaccaggtggctggactatacctggagaaatgtctgatgtctgggaacctggatgtagaaccctagtagaatattgtgttgtttaatatttttattagatttggatgggtaagtccaaagttgaaacagagattcaaaacaacatgaccttccataaatctcaaagtatttcaaaataaaaagtttatttaaaaaagtagtggcacaggcttgaggaaacagtggacagaaaacgagaggatgaaattcagtagagataaaggtcaaatccagccctcaagcctttcgaaagcactggtccagcaggttggcaatgtgtatgagggaggtgggagttttaactggtcctattctcagggctgaagccacttgttggacgagggttttgttccaacattggtcttgccccacccctaaacagtctgcctagcacctagggacagtgctgagggcagcagaggcactatctgcaaatgtctgtgaggctataactggagaggaggctcttccacagggctgtgggaagccctcccagaggccgaggcagactcccacctgccaggccatacccaataatgacccctggccccagcactctgcccagtctccaaggaggtgctggatagtcacaggggcataaagagcacctcaacaaagggaagtcagctgagacaaccttgaaagctacttcacctctgtccacgagggctgagctgggcccagcatgcaggcatgacaccaggtactctcttcctgggctgcatatccctgctttggatccaagggccaactctatgcccttggccagttaacagttccaagtcagcttaccctggggaatcaagctatttttaggcaagctatttctgcaggggagaaggttcgtaaggactaagatgttttatttatttatttatttatttatttatttatttatttaatttttttgagacagagtctcacccagttgcccaggctggagtgcagtggcgtgcagtctcggctttctgcaacctccacctcctgggttcaagcgattctcctgcttcagcctcctgagtagctgggattacaagcatgcgccacacagtgtgttttcgtatttttagtagagatggggtttcactatgttggccaggctggacttgaactcctgacctcaagtcatccacccgcctcggcctcccaaagtgctaggattacaggcgtgagccaccatgcctggcctatttatttatttttttgagatggagtctctgtctgtcgcccaggctggagtgcagtggcacgatgtcggctcactgcaacctccaccccctgggttcaagcaattctcctgcctcagcctcccaagtagctgggattacaggcgtgtgccaccatgtgcggctaatttttgtatttttagtggagatggggtttcaccacgttggccaggctggtcttgaattcctgagacctcaagtgatccacccacctccgcctcccaaattgctggcattacaggcgtgagccactgccctcagccaagatgttttaaattaaaaatgaaaccagtcacttgagccacaatgatgatcggacggcaaaatgcaggtgtgcagacatacccatctctgtgcctcacctggtcaattagctgtctcctggatgggttggtctcctcaaggacgtgagcccagagctccggatcctttctgcataccaggtagcgggcctcgcttttgaacagagaattctcattgcacacctgaaatgagcacactcatgtgtgtgacacagcagccaaccagcggaagctgcttgggaggacacaccccaattcgttccctgtgtgcctgatactggtttggtggacagtcagggcccaggcaagacgctatgctttgacatgggatgagcagcatcctacagggttaacgatggactcaaactacctcaaaatgccctttccaagtttacaacaactcccagggatgtgccacatatctggccagtaggacttcctgcattcagggacatgctctgtctcccattctgtctgatacagccactagccatgggaggctactgagcccttgaaatgtggtgcgtgacaggaactaaactggtaatttttaatttagttaaatttaagtactcatatgtagctagctttaaaccatctgtaaaatgttatcagaacagcctagaactggtataaaacagcacaaacactgcaatgtttcaagatctaaaaactgtaaactgtgctttcactggtagatctggagacctttttctgaatgttataacagatctccaaaacaccaacagtccactggaatgttctagcgtgtgcagcacttgctaaatcctggtgaggatcagatctgttgagtgccagatgcccggcacaaggctgagcggcgtgcacacgtgcttgcggatgcagcgcagtccgcctgtgtatcacaggaaaagcccaagcaggctggtgtggcaccaacctcacaggtgccctattcatgtctggatttttagatctggatttttagatcaaatgattaggtaggaacagttcatacaattcaacctaaacatgtaattatatgtggatccaagcctgggcagatgcaggcaaaagacctgggcagatgtctcaaggagaggccagcaagagctcattggtcaggtgatggggaagggcttgtgtagagggttaccccaaaaagggggcatgaagtacaagggtactcgggacatgaggcacccagggaattgcaggcctctccaggtggggtggcaagatggatggctgatcaagttcgggagttgggaaaggtggcagtccacagaggagctcacgagtcaggccaaggagttcaattctgccctcaaattgccaggcaatagtaaggactgtaagcagagggatgataagtcaggttcaggaccaactggtctacaggtacaatgcatacaaattgcatgagcaagttcccaaaagctgtgagaatcacaaggaaataatctcatgacctgccatctccaggtgcacagaaagccctgatcagctccccacaggcacacctttgaaagcttccctgggagcccagggttacatgggcagctcagcacatctgctacccaccttgatgagctcaaggtcacactgcccccgctcataggcaacacaggccagatgggggtctcgcttctcacagtagcggcccaccacgctgctgtcatagtaggcattctctctcaggaagcactcggggctgttgttgctgtcgatgtagattttagccagtgcattgtgagtggcaggctcctcacagccttcctgaatctgggactccagccagggaagcagcagcttgagcctttgaaagaaggaaggtgctgtaaagtctcaaggctaccactggaagtcttgagggcaactccagggctctgacagatgtttcctgaaacaaaaaatctcagagtccattgacttcaggttgctctagggaccaagatggacctggtttccaaactgatttctactgttaggttttcccccaaggtcttcacagtaccaatagcaagtaactcattgctacatctaagatgtgtacatgaacgaccagctatagagacagtcctggagaattagacagaaacaacaacagacactagaatccaggggtaagagaaaacaccaagtaaggacaccttacctatttcttttttctacttcagccaccaactcatcagtagagaactgtcctctcactgccatgattaagtgtttaatcacttcctcagaacaatccacatcaagcagccctccaatcacagctggggtccggctagggttgacctagggtagtcaaggtcaagtaacttcagtgttgcaaacacaagttattgttagaagcctcctacgacgtggacagtttgggcaaaaccctgaaagggctcctgtttagcactgcgctgtgtcccaccaaaattcacctgctgatgtcctaacccctagtgggattctacttggaaagagggtgtttaagaaggtaatcaatgtcaagggtggggccctaatgtaatgggactagtgtccttctaagaagaggaagagacaccaggagtgcacatgcacagaggaaaggccctgtgagggcacagccaggaggctgtctgcaagcgtgggagacagccttcaccagaaaccagccctgccgacaccctgatcatggacttccagcttccaaaactgtgagaaataaatgtgtgttgtttcagctgcctggactgtggtcttctactctggcagtctgagcacacgaacccaccacccttcaaaatgatagtctctgaaatgtcaggtgttacaggcagcctctgaggggaagactgccactgactggggcccagaggcagccgggtgtcactccagggagccagcagtaccttctgcacgtagatctcaatgtacctctgcaggttgttgcggtataaatataggacaaggtcatggacaaagccaaaacgatcacacacgatgatgaggggaagctggtctgtgagcttggcctcctgaggattagaatgcacagaacaagtcagggagtggagaaaccagacagccagacctcggactcattgcacacatgggacggctctgtctctgcagcagagtgacacacaggagactcagaatgagactgctctaaataggctgtcgttttgtggtatggcatttgctttgggaaataagtgagagaaagatattagtatttggttaaagactgctacatttggcattaacattccaaatctggacaaaaatatcttttaagacaagcagctcattatgtgcaaacccaacagaaaccaggccattctcaagaacagcacacctgcggtaagggctgccttttcagacacgcagccgcaggccatggaaacacacccggccaccattcccagatgatgatggcacttgggtaggacagccacaggccaccacaatcatgcctcccctcatgtggtcccgtgcctagatcacattttgaagttttaagtgtggccacatgacctcatttcctccaatggaacgtgaatccaagtgtcatctgccacttgcaggcctcgcccataaaaaccacctatgctggttcctctgtgctcttcccttcctctagctgactgggaagacgacatccaggtgaggtgctgaacacggcaaagcagccatgaagctggtccttgaagtacagtgggaaggaaagtcaccccactgacctccagcctaccctggactgccacataaggaagtaggcttcctgttctttatgacactagtgctgagtggtctacttgtttctgcagctttgcctgcctaattgacaatggcactaatgggatgttgatgaattacaatgcagcaataagtgccagatacttagagcacagcctcaagctgctttccacactcttaaaacgatagaagggttactttagaactttaagccataaagtggagctctgtccctgggactaaggggtccctggcgagacagatccagcttcctgcccctgggacgtcctgcggatggtctgccccacctgccatcagcaagggcagctcatggaaggaggcagcactggaacacaccttcaggaagttcttcacacgctctgggttgtagcagctgctctctcggcatatcctctccacctccttgatctgccctgtcttacaggcagcctgaatgtatttcagatgcacatctgggtcttggctgaagttcacgattgagcccaggaagtagaagaggcctatgaagagagaccattccatttttgtccttgtaacacctgcctgtctcctccgtagctgctgcccaccttccctcgatgaccctgctccactctccagggacccacagcacactcagaactcataatcaatatgccatttgtctgttttggcagctcccaaaaatagctagtcggatttccattatatttggcaggtatacctggcatgttttgatgtaaaatactagatatttggtacaagtgaaattccttttgtgggcccaggtatacctagatagtcgtcatcaagagtaattcccactgaggtaatctgaaatggtggtgggactgcttctctaaaaagacacatcaagggacagagaaataagccatggcctccaggaggaggcctgcaactcaacacagagctgacagtgacatgggcaccacatgctgagccccagggtgagccccagaggacagcattcacagaggctaatgatgttcctcatcattacagaggccagccaggaggcaccagtaacaacagggtacgacacatctgagaaggcccctccctgtcgaggtctttcactgtaactgtgagaccctgatgctaggaagggaatgggcagcccctgggctgacggttctccaccaacctactctactgccctctcccagcccagctccactcaatcgtctgccatggtctttcctacaggggtgtcttctaaagagaaggccagttccctgaggacagggtcatgtcccaccctccaccgatgccccaacctcactggacacatggcagtggcttgatgcctagacaaatgcttagtctctatcctgggtgggccagacagcccccatctgtccctaacaaagccactcccatcccaactgccctagaacacttttttggtgtgatgtccaagaaggggaaaggaagacaaccaggttaccttgtcagccccccacaatcaactgggtagcagacaccacaaagcaatgcaccctctatcgtgggctctcatttaggagaggcccaaagagcctccctcctggggctgtaaagaccagacatcaggccctttcactgtacccacgacacaggcttttagatgaattcttgccagactgtgctgcgtagacacaccgggctccataagtttctccatcccatcaccaaccaacctgatttcttcctttggaaataccaaaaaggttactgaagctgagggtgcacatgagatggcagtagcattctgccaccgactgagcacccaaggcagccagtgctgcatcctgcctggctttgcaggaaggccgtcttaaggcgggcaggtaggcagcaacacctgagaaaggaggtgtagtcacatggtggggtcggcgagaggctgcatggtttacctttgtaactcttgaaggattcaaagagctccaccagggcctgcgtgcccagctgctcgtggtacttagaggccacctgcacacacagctgaaggttctgtctgatgttagcagacagcatggcatgcagacactccacagaatcctccaccgataaggagccaaagaaattgacaagccactgggaacaaggaagagtctgtccacaacgatgcaccactctaaagattgctaacacttggaaaataactaggtcattctcctgttcccctgagtgtcaaaaatacagagaatttccacataaaggggttgaaaagcaactatccatcacgggaaaaagtaggagcaaggagtaaagctgggaaaagacactgatctaaactgttcacctggaatattccacagatgatgctaaaacttattccataaattggaacacaatagctagtttagctttgctaatggtttcagacagtcctattaggttgtcaatgttaaaaggtgaccagtatactcctgctattagactaagtcaaaggtggatatcagaaagaaaggtgctacagggcccagacatgctgctgagcagataaactttgtgcgtgggctgaattagaactgcttttggtagtaaagtatggtaggttagggcagtgacaggctcaggccacagttccacaatcaccaacaggtgaacactggggagcatgtgacattaattgcatagacaacagccataataggagtgcccaggggtacacagtacctcgggattgaggaggtgagtgtggaccacagccctcttgatgtcatagaggtcggtgtagtgctccagtgcttgctgcaggaggcctgccttctcacagagctgggcaatgtgggcccggtcgtaatgagtaaacattttatttccaaggatggcatctgcaacctatgaaacagggagttcggtgagaagccctgatcaatggcaataactttttaagaccagctgctcaatcttgccccagggtagggtatagcctggcaaccagaactcacaggcccctgtccacatccatacctctgtggtggcagcagtgcttgtgggtcccaaatccctggctgtccttcaagccatcttaggccctttgcacaaggcttcattctcccatgttgcagctgggccaagcccatgtggtcacagagttgggcctgtgagaaaggctgaggctccataaagccctattactgggatgagtccaagtcactgttgcagcttttaagcaatcacattctttttttcctttttttttctttttttgagacagagtctcactccatcactcaggctggaatgcagtggcacaatctcagctcactgcaacctccatctcccaggttcaagcgattctcatgtctcagcctcccaagtagctgggattacagacgcacaccaacatgcctggcttatttttgtatttttagtagagacagagtttcgtcatgttggccaggctggtctcgaactcctgacctcaaatgatctgcccaccttggcctcctaaagtgctgagattatagccgtgagccaccgtgcccagccagcaatcacattcttatagggtttctatggcaagatcaatgtgagggctcaagtctaccgattctccttgaatgagctcaagccttagattagcaatgaccagaaggagacctgaacaaaacaaatcccatttgtgcttactagacttctctactaggctaaatacagaactaggagttggggattgcatttaaaaaacaatgaacactcctggaaacaattttgatgaggcataaaatcttttttttttttttttttttgagacagggtctcactctgttgcccaggcgaatggagtgcagtggtgcaatctcggctcactgctgctttgacctcccaggctcaagcaatcctcccacttcagcctcccaagcagctgggattacaggcacatgccaccacacctggctacttttttttttttttttttttgagatggagtctcgctctgttgccaggctgcaatgcagtggcatgaccccaccctgctcactgcaacctccgtctcacgggttcaagtgattctcctgcctcagcctcccaagtagctgggactacaggcatgcgccaccacacccagctaatttttgtatttttagtaaagacagggtttcaccatgttggccaggctggtctcgatctcttgaccatgtgatccacccgccttggcctcccaaagtgctgggattacaggtgtgagccaccgcacctggcccacctggctaatttttatatttttttgtagagatggggtttggccgtgttgtccatgctggtctcaaactcctgggctctgctcaccttggcctccaaaaatgctggggttataggcgcgagccactgcacccagccactaaatattctcttgaagtaagtaatttttgggctaagactggataggtcaacacagcagccttgcagcatggctgagtgagtgctccctcagtatctaatgatggtcttgacaagctacactcctgggtgccttcccctgccacctggcacactctttcttattccttctaggatctgcatcaccaaccaggtatggccacagagtgaccacagccactgtcacacaccagaccacttcagagtgatgcacagagttgacgatcaaacacagtactaagagtagggctttagaacatctagcacttacctgagtctcctatcctttgtttccttcaggtttatctttacttcttgttttcaaacattttctcctcatagcaacagtgtattttatagaatgtagaaaccatcacgcagtcctactgcccagagaagactgccagcgtcctggggcactaagccagagcctgctggcacctcacccaactacttgtttctcctttagggtctgggcattccttagggtctgtctgccaagtttctgagtgacgcttggtgtgtttcaaatctcattcaccagaaacggttacatacactcacaaagtcatgagagtccagtagaccccaagcagcaaattaacagtacttttatttcctagagttggaatatgacccacttcttagcagctaacttgtagatttgaataaattgaggtaacagaacaatatacttaatatgttgtttcctaattataaaaacagtaagtgattattaaagaaaaatcagaagagataagtaaagaacaaagtgaacttgtacaatcttatccacttagtaccgtggtgaacagcttgatataaactcctctaaatccctttcttgtatatatatctaaatttaacccaaaatagcacagacatgtgatttgattatacctgctcccacaagtttcaggccaacaaatgatgcctcaccacagtgagataccactgcacgcccattaagatggtgattactattattattattttagacagggaagatgtgttggcaaggatatacagaaattggaacagctgagcattgctgggaagaatataaaatggtacagcctcctggaatacagtatggtggttcctcaaaaaggtaaacatagaattactgtaggacatgatccagcaagtccacttctggatatatgcccaaaagaattaaagcagggtctcaaataaatctttgtacacccatgttaacagcagcattattcacaatagcctaaaggtagaagcaacccaaatgttcatcaatggatgaatggataaacacatgtcatatatacacatggtggactattactcagtttcaaaaatgaaggtgtttctaacacatgctacaacatggatgaaccttgaaaataatatgctaagtgaaaaaagccaggtaaaaggacaaatattttgtggttccatgtatatgaaatatcttgaaaagccaaattaatagagacagattagaatggcagttgtcaggggctgggaaatgaggagtcactgcttaacagttacatagttactctgggataataaaagttctggaactatgtagtggtaatggctgcatagcattgtgaatgttcttaatgccactgtatcagacacttaaaagttgttaaaatggtaaatttggttatgtatattttaccacaatgaaaaaaagaagaaaggaagaaatgctgccctaattagaactgtttccatgaaagtcctgtatcatgatttctggaaaatccttttaaggaaagtcatggagaatgtccactgagaagtacaagataaacatctggcacaagcccagcccagtccaaagccactgtgctcaagtctgcaaacccagagaggtgccacaggtgctctgcctctcggtgttagcctacaagtcactgacctggggtgcatgaacaaggttcatctccaacagccatgtctgcaggagtccctcagctgggcgattattcttcaaggcatccaataagaaggaagtacactgctgaattaaactgttttccatgaaaatgtccacaatctgaaacatatccaagccacattttcactcagtatgttttcattcagtgtttcattttcctattgaaatagttcctgaaatattatctcatttagaaattcagcaattagttccctcccttggttttttttttttttttgagatggagtctcgctctgtcacccaggctagactgcaaaggcacaatctcagctcactccaatctctgccctccacctcctgggttcaagcgattctcctgcctcagcttcccaagtggctgagactacaggcacccgtcaccacacccagctaatttttctatttttagtagagacacggtttcaccatgttggtcaggctggtctcgaactcccgacttcaggtgatccgcccgcctcggcctcccaaagtgctgagactacaggcataagccactgcgcccggcccctttccattttcttctgtcatcgcaattcacatacagccaggtgtggtggcatgtgcctatagtcccagctactcaggaggctgaggtggatgcattccttgagcccaggagttgagaccactgtgggtaatgcagtgacctcatctcaacaacaacaacacaattcacgtaatttatggtcattaatttattaataatcttgcaaaatcatatcacctacatcatacttatcagtgaggtattttactgaagtatatgaaagggagtaacttttataacatatgaacccccaagcagtaatcatacattacttaatcacatcctagaggcagctgtgatgcttaactttaggtgtcagcttgactggattaaggaacacatagagaacaggtaaagcattccttctgggtgtgtttgtgagggcattcccagaggagactggcatgtgagttgggggaacaagtagaatgatccactctcaatgtcggggaacaccatctaatcggctgggggcacaaaaaaggaaagaatagatttcttctctctttctcctggagctgggacattctccacctcctacctttggacatcagaactccaggctccccagcctttggactccaggacttacaccaaaggccccccagggttctcaggccattggcctcagactgagagttacgccttcagcttccctggttctgaggctttcaaacttagattgagccacgctaccagaatccaaggtctcctctagcttgcagacagtctatcacaggacttctcagcctccataatcacgagccaattctcctaataaactccctctcatatatctgagatagggtctcactctattgcctaggctgaagcagtgacaaggtcaccactcactgcagcctcaaccttcagggctcaagcgatcctcccatctcagcctcctgagtagctgggaccacaggtgtgcaccaccatgcctggctaacttttaaaaaattgtttgtagagatgggggtctcactatgttgcccaggctccctttcatatagctatagctacgctattgattctgtctctctgcagcatcttgactaacaaagcagctgatacttgatatctaactcatatatatcattatattattggggcacaactgggaaaatgcaaatatttacttagacaattattaaagttaaattgatgttaatttaaataattaatatgccttagtaagatgtgaaatacaggaataaatttaataattgtttttgaaggacagctttacaggaaaataaaaaagaacttattaactgtggaacttctcataaagtatgagaagtttatattttgaacaactttaaaatatgaactgtaaacaagatgtgaactggaaatttctttcctattgaaagctaagtaaatttgtctcaaatctcttattcatgttctccaaaatatctgcagattcccagatgtacaaacacatacaactgcacttattatttctaaacagttgttggttctgatgccttgcttcaagctttgttacacatctatatatcatcaaagctccttgtaccaatttactgaaagtgacttgtcatgtgtttacatctaaattttaagtaggttacactaaaaaacaggctgatgctcacgtaatccaggtcagtcagacacccacaggatgaacatctgggggacgcaacagcactagctcctggtgctcaggccaatggtcagggagagacaatgatgtagtaactggggtgggccacgggatggagggctggaacctaaatgacatcctcacaccctacaccatcaccacccaaagacacaaacccaaacaaacattctctaaagtacttcaaaacaaaggaagcaatgagtactcacatagtaaagactagaagacaaactccccaagtacactagattttttaaaactgcaagattaatagcagatgaagaaaagcattgagacaagttaacaggaaacgaatcaaagaaatcttctagatggctctaaaaagccacaaaaagttgtccaaaactgcctacgctcacctggctaatgttggccagcggctcctcgtcctgcactagcattcgagaaaactgcaggccctgttccggactgatcttcattacacccctcagcagaaagatccagtctggggtgtacccaacctagaagcaagggagcaccaatcaggaaaatcaatgaaaaaccctgggcattagaaaaggaagttatccatcctttgttttaaactcgtgttaacaaagaaatgagcagcaacattatcatgtgtaggtaccaccttctgccaaacacaatatccaattaaatgaattgatttaatgtacatggaaggcacaattaactatacaaagagcccagaccacaaagaagtttcctgatctgtgtgcaaacacagcctgccagtaagcacacagggataagatctgggagtctgccaaaatatcaaattaacatacagaaggaagagagggagagaaaaaacaagataaagctcccaaataaaacgaagatggaaggactggaaaactaaggataataaaaagctgaagagaataaaatatgatcattatgaataaagatcctaacagcaacattgccaactctcacaccagaggacttacaaagaagggtattttataaactttaaaatcagcaaccactcaaccacacgtgagtaatctgtgagatgccagtggttcaacacacgttacctttttggcatagagcacaattttctggaattggcctgtttctgcaaaacactggatcactttgcttggcacatttgcccgaaggtacacactcagagcgagcatggggtcagtggttttgaccaagtctccgagctcctctgagcactccagctgtggtatgccaagggacaaggcaaagttaggaggcaggtagggagcctggaccaagttttcaagctgtgcgggggggctacgagctcacaagtgtttctaccttatcttctttcagccacttctctaggagttgcttacgcccctgctgaagaaccagatggcaaagttctaaggattcaagtttattgagctgaccctggtcgagcaggattccgaagtactgcagcaatggagaagcctggccagactgagcgggtatactctggaatttctggaccgtctctctggtacgcaggattccctaataataaatggaaaaataggtcattgtgttgtaatcacaggggatcccttcactcaacttccttgtatgtaaaaacaaaaatctgccagtggaaattccacactgctctgtcatagacaaaaagtcctctaccaaggcaactgcttctatcttcaacaataaccataagtataggggaatctaggtcctccaggtggcttcacacttagggtcttacttctcccccagcatgctgcagtaagaattcggcctctcaatcagtcttgtagtagtgaagttctgctatcattatattctaattcaaaatactcaaattcacagatgaaggctagaaatggtttgttcacaactaccccttgaaagacaagaaaaattctttcaaggacaagcaacttgaaagtctttatctactcaggaacagatccagtctctgaacaatttatccaaatgaaataaacccaagaaaaagccatatgccgaaatgctatattctaaaagagtggagaaagtccagggtaggactatcgctagataaaacagggaacaaccacttgatgtattgtacagttgcatatttgacaaccaggtagcaagagtggaaaatgctaagttacagaaatgtgaaactgtatctaagctgttgggtgagaggtacgtatgcacacaaagtgggaggcgtgaagaagtgccgatgcagcaagagtgtgttttttgtttacttcctttactgttatgccattggtgcaaaaattttaaactaaaaactcctaacataacactaatagactgcaatatcactagtgaaatgcttttatgacttattttcctctcaaggttggttcttaacactcagaacacttgaacagtattcaaggtttatcacctttggtgcagacgctgcaactttggcggcttcagcatagctgccctgtgcaaagagggtattgaattttctcacaaacaacttctctgccccagccaggttactacgaacggccaaacgcagaccaaggtctggattctgaagcacgttggttgcataattcacaatgttatcttcctcaacacaaactgacagtacctgtaaggacacaacaagtgagagcagcccggcctagaagagtgctccaccatccctctgccatgttcccttccgatgctggagtggtagccacattctcaggcgagtgttgagcacacctgtgatggtggccctcacagtgaaaggaggcaaagcagccgaaagccaaatggtaacaaaacagaacagcataggagtctatgtagttattaaagtcacacagataagtgtgatgcgttctgcgctacagcaaaatgacctatgtggatggaactgacaatttttcttcttaaactttttatttttaaagtacagagtttctttcttttttaaaaaatatttttgtagagacagggtcttactatgtcgctcaggctggattcaaactcctagcctcaagcaatcctcctgtctcagccttccaaagtgctgggattataggaatcagccactgttcccgacttttttttttttttcccctgagacaggctctcactgtttcacccaggctggagtgcaatggtgtgatcacagctcactgcagcctcaaactcctgggctcaagccatcctcctgcctcaacctcccatgcagttgggattacaggcataaactattgtgcccagccaagagtttcttcttttaactatctttttcaactatggttgagaaaagttacttaaataccatagtatctgctttttcaaccctccccagttagggtgtgcatggtataaagatgatgtgcatcagaactgctgttctatacgcaggaaggagctgctctcctcctggaatcaatcctgtgttaggaatggtgctgtctgaagagaggaagtgtcaatatgaaggaggagacatgggtttaagtttaataacaggaactattaatagctacacccagctgctttcctagagaagggggaaagtttaaacgccagtccctaatgaatggaaaaggtagaaaatgaaatgtcagagttacacacctgtccctttttgttgacaccaataattccagaggttggtttgtgtggagcagtgacaaatattgtgtcagcactaatacggttcatgcagatgcacacgccagactctaggtcgtacagatgaagatagccatactttgtgatcaagtaaataacaccatgtttagctccaatctataagaagacagagagcaagaggttggaaagtaaggaggagaagccatgcgggtaaaaagagctcacaaatgataaagaggattcttgtttgtttgtttgttttttgagatagggtcgtgctctgtcacccaggctggagtgtagtggtgccaccatagctcactgcaacttccgacctctgggctcaggtgatcctcccatctcagcctccaatgtagctgggactacaagtgtgagctgccacacctagctatacaaggattcttcagtttctcaggccgagagattactggtgggagcaatgctttcctgagacatggattctaagttgtacttgattgagaattagttttaaagacaatattttgtccaaccactctcaaataaaggtccaataaactcaggctactccatttatctttcaggtagagcgatcctttcacagtttatcgaacccctttaagcaagctgtgagttcataagagaaggggaaagttctggacaaagacctcaaacgccaagatgatgttccagcatgccttctaccaccacttattaacctttgagttttgccaaatgctattaacttttacagaaaaatatttaacacacaagaaaacctgaaggggctggggagaaaaaacagatgcatttgcccaaccagattattaaacatatatattaaaacagacagtaatttttgaagtatgattttaccactggaagagacagagagagaaaataattaagagccctgaaagagaatgaatcatatatgagaatttattaagaatgagtgtgtggtggctaatgactatagtcccagctacttgggaagccaaggcaggaggatcacttgagcccaggagtttgagtcaaacctgggcaacgtagcaagactccaactctagaaaaataaataattagtaggtaacatattagtggaaaataggcactttaatcaatatataacatatattattaatatagttagctagctatctggagatggaggtaagagtaaagaactgaatttctatcttactctttagatcaaagtaaattccagatgggtcaaagattttaaataaaaaacaaggacaattaggataggaatgaaagaaaatataggtaaatgttgtgatcatcttcaggtgcagaattagtctcaaaacatgataccactgccacacaaaaatgcagcacttccataaggtgccacatatcacaaattacgactgggaaaaatattcaaaatacatcagacacttagtactctacaagtacaaaaagctcttacgaataaggtaaaaatcctggagttgggcacagtgacacacacctgtaaccccagctgcttgggaggctgaggcaggaagatcgctcgaggccaggagttcaagactggcctaggcaacatagcaagaccccatctctactttttaaaaaaagatcccaatagaaaaaaaatgcaaagattaggaaaaggcaattaaccggatacatatgagtggctgatacatcaattctgccttgatggtaaccaagggaaagacatcacaacatgggatgctgtccagctaccaccggcagcatcagtaggaatgtgaactggccagcatggtcaggagagtctgtgatgagagtgtgcccctgacccagcagtttaatttctaggaatttatcctcggacttttagactaacatacaaagatgtatggagcacaatgttccttatagtgtttcttgtaaatgtaaataccaatcaacaggggattgtttaaatgagttgtagcaaatccacagaacagatgacacagacaataaaatacatacattatgttactggaacagaatgatctacaacatagctagaggagtttatacagcagcaaggctagtgcagagccattttcataagagtccatctgtataaatctgcacaaatgtatgcatgttaagttacttccaaaggggtagccaaattatcagcagtgctaggatttcaggtgatatttaatcctgctgttacatttattgatattattagaaatgtacagataacatatattttatgagaacaaaagagtaaaaaggagagtagattatataatcttacatatataatgtgatgccaattttgttcagaaaaggtatagatctaaattttttataaaacaaattgtaagattttttatttttattcttatttatttatttatttattttttggaaatgaagtcttgctccaggccgcggtgcagtggcatgcagtggtgtgatcttgcctcactgcactctctgcctcctgggttctagaaattctcctgcctcagcatcccatgtagctgggactacaggtgcacaccgccatgcccagttaattttttatattttagtagagacggggtttcaccatgttgcccaggctggcgtcgaactcctgagctcaggcaatctgcccgcctcggcctcccaaagtgctaagatgacaggtgtgagccaacgcgcccggccaagatttcttatatattttacatccaactggtttatctacagaggaatgttttctgactctgtgcctttgacacttccacaacaatattctgctcctcaataaggaaagcacacttgatcctgtcacgaacacacttagcacacacggaaccaccacaggccctgctgacatgtgtttctgttttagggaacctcacaagaacttcaggtctcatagcacgaactcctcgaagtctggctaggcacatgccacatgcaggttcaggtgttttcccaaccttcttgatgtaaaggtgaataattctcccaccaggggcttgggactacctagtttcactagaggctgcgtgtcaaaggctgggccattctgaatgccagctcaaaggactgtccctgggagctctaggctccctcaatggcagccaattgtaaaggaaataagtgttttattcttttttttattattataagttctgggttacatgtgcagaacgtgcagttttgttacacaggtatacacgtgccctggtggtttgttgcacccattaacccgtcacctacattaggtattttattctttaaatattctcataccacagtgaacatctaatcttttataataagaaggaaagagctgaggactttgatgtgtgacttggcaacgtcttcctgctgccctaactcaccctcatgccgggcattcctttctacgaacagggctttcccagctcacacgccaaagccttaggcctctaaatgggtttgaaagcatcacagtggcaggagacagcagaagcagactaaaaatggcagcctcctgtatcttgggaggtgctagagtagattttaggacatgaagatgtttagagagcagcacattcgtacctgcatagccactggaaaatcattctgtgcctctggaggaaaaaacacatctactgctttctttacaaaaggttggtttcccgctgcaggctgtccaacttcaatgatgtgcaactagaagagagattttaggtcaatcaaggggaccgcctgtggtggtgggcaagtgctagtcaaggcacagaggcaagtggagcctcagctccacacactggatgattaacgctaaaagtcacattcaaccaaagcagaacaacccccttgtcggagtgcctgtgattatccaataacctgctgcccaccaccaagcatggcacaaagggccaatgccaggcagcctggagcctcagttccagcacagtggcagagtcacttcccctccccgggcctggatgccgatgaaacaaagggctccagtcagaatctgctgtcccttccaactctgctctctgcctttctgggtatggcccagactcatacaagcctgttagtgcaagatctcatcactggaggcgaaactcacgagacatcctcaccatggcacaggcctgaggttttcaaggttgtgctgggcgggggtaagaatctgatgagggagcccatccctgccttatgagaacagctccaagttcctgacctatgccagtgccttccctataactttctttttcttcttttttttttttttttttaagatggagtctcgctctgtcgctcaggctggagtgcagtggcgcgatctcagctcattgaaacctctgcctcccgggttcaagcgattctcgtgcctcagcctcccaagtagctgagattacagattacagatgcatgccaccacacccggctaaactttgtatttttagtagagatggggtttcgctatgttggccaggctggtctcaaactcccgaccccacctcgggtaatccaaccccacctcggcctcccaaaatgctgggattacaggcacgagccaccacgcccagccaccataactttcatctaaagaaaaaatattataactaacacaagtccacaacaaaatccaaaatgaagggtaagagacacaaaacaagggcgggaggctgggcttagaggacacagacaagggtgtctgtggaggggcagtctgggtttgcggtctgggtttggccgggcagagagaggagggaaacaccaaaggggctcagataaggaggggagcagcactgagagccgggccaatgggggaggctgagcggcaagcatgtgggtgctcctgtggggacagaagtctgtggatggggaatagaaaagtcttgcactgggagctttaaggcagataaaaggtagtttaggaaaattatctggctaggcctattggtaagaaggcgtgaagcaggtctgaggacctaataaatggctattctgtaacccaaatgtgaggtgagaaaggcttagtgtaccacaaaagggtaagtcagatgtgggacttgttaaaggtcagacagtgacgagagaatagaatggggcttgactgctatgggttcttgctcgggagctgagaagggtgacactgccagcaggagcagaggcacagaaaggacaccaggctctcagggcagcagcaggaggaggttggcagaaaagaactgtgtccaggcaagctccgccccacatgtggagacagctggccagtcccaaaaggacaggtgagtcctgaaaggaaggtgcatgcctgggcacaggcggggcgggcaccctcccaggaccccacacccaccctgcagccgggaggaccgagtctgccacaagacacagggccgctccaggacaggtactgtcaggaaaccgcatttcccaggctctctgggtcacagaagacctcctggtccatctccagctcggctggaggggcatgcccaccagaaagctaggtgtagagagaacccccagccccttctcttcttggggctgccgtctgtgtacagagccccgctctgggaagtgctcttctccacagggcactctgtgaggcaggctctgctcctcagagggaggcctgtcgctgccctgctgcatctgtaaaggagaggtgtgcctcactctgagggaatatgggagcaagctctttgagccacataactaaagtcagtgtccttcatcagcaacaaggctgacacgtgacccgagtccttttccttctggctctcaaatgaggagggcatgaagtatgttactcaacaggaggccaaagtattcagtgtatttcagatgaggaagtttgtaaagccacattctaattgagaactcctctgccttggggaatatttcggggctaacgaacaacccaaaattatggtttgagaaagtgtttttcacaagacgactgtcttgaagcagctctccaagtggctgagaccacaatggcggaacccaaggtctccctgacatcacaagctcttctgtctcctcacctctgcccatggcagccctgccgagcagccgctggccatgtccctgagcctaataaaacccactggctcctgggcacagtctcaatctctctggagcctccctgaggcgcctcccaaccacctgggaagaaccatgctaatggcaaggatggcaccacactggtgatttcacagtcatctccccaagagcagaaactgtgcctcatctaccttttttttttttttttttggagatggagtctcgctctgtcgcccaggctggagtgcagtggcgcgatctcggctcactgcaacctctgcctcctaggttcaagcaattctcctgcctcagcctcctgagtagctgggactacaagcgcacacagccaggcccggctaattttttatattttaatagagatggggtttcgctgtattgtccaggctggtgtagaactcctgagctcaggcaatccacccacctcggcctcccaaactgctaggattacaggtgtgagctaccgcacctggctgcctcacttacctttagagtgcatttcagtctagtctgtgtggaaggattttttttttttcttttgagacggagtctcactgtgtagcccaagcaggagtgtagtggtgcgatctcgactcactgcaacctctgccttgcaggtcccagttcaagcaattctcctacctcagcctcccaagtagctgggtttataagaatgcgccaccatgcccagttaatgtttgtatttttagtagagacggggtttcaccacgttggccaggctgttcttgaactcctgacctcgtgatccaccctcttcggcctcccaaagtgttggattacaggcgtgagccaccgcgcccagcctgaggattttttaggggaatggggccacttaatcatgtgcatcacggtgcacagttctcaacaccaccatgaacctttcctcacacagacatctgcaggccatgcccagccacacacacgcacacccctaacaccagctcatgacacttttctcagggagaagacagtagagtggatcttaccttgcctcctgtgggattacgtacagcaaagcagaaaagggtggcaggcttggcattcccctccatcttgaactctgcaaaagccgcagcatggccttctatgggttgtgaaaccttcctatccacagagtagagctgcattgctccaaccacacggttttgctaagaaaagatattatgcaatgaaagggagagaaaagagaggaatataaagaaacaattcttaaaatatatttctaaaatgaaagtctcatacattagaggtatacttcctctagtaaaaattaaatgtattagctattaaaggcatgatatcactctgaattttatgtggaaagatggcaaacactatggaaaaaaataagaccacaaaaaagtaagatggacaaacctaatttgttaaatatagtaagtgtgagagcattttttcatggaaagtaactcgtgcactttggaggaaaaactctaaagcattaatagtagttaaatcgggggatgcaatcacaggtaattttgaaaattgtgttttctgaaatttctaagtagcaaaaattgtatttaataaaaaccaataaggccagcacagtggctcacacctgcaatcctagcaccttgggagaatcacttgaggccgagagttcaagactagtctgggcaacatagcaagacgccatctctacaaaaaaataagaaaattagctggtcatggtggcatgcgcctgttgtcttagctactcgggaggccaaggcagggggattgcttgggccaagaagtttgaggttgcagtgagctatgactgcagcactgcactgcagcctgggtggcagagcaagactctgtctccaaaaaaaccaaaacccccaaaccagtaagactaatatcttttataaaacttagaacttgtattttctttctttctttcttttttttttttttttttgtgatggagtcttgctctgtcacccaggctggagtgcagtggcgtgatctcggctcactgcaagcttcgcctcctgggttcacgccattctcctgcctcagcctcctgagtagctgggactataggcgcccgccaccatgcctggctaattttttgtatttttagtagagacggggtttcaccatgttggccaggatggtctcgatatcctgacgtcgtgatctgcctgcctcagcctcccaaaatgctgggattacaggcttgagccaccatgcccagccagaacttatattttctactaaagaatttcagtacatttatatccaatgtcaaatgctcaaaaagctaagtgaatggaatacaaaagggtcccagttcaagctcctgtaattaaacattcaatcctctctgctgagtgagctcacatatagtcgtgggtaaaatcctcagtctattcctcactcactcacaactccttaaaatgggataacaaaggcttcaactttgtctttaaaaatattttctattgcacagatttctgttaacgttattaagcaaagtactgacacatgctaccacatggatgaaccttgaaaacatgctaaggaaagaagccaggcatgaaaggctgcatattgtctgattccacctatgaaatatccagaaaaggaaaatttattgagacagaaaatagattagtggttgccaaaggctggtaatagggagaaataaggagtaaaccagcagataagtggtctgtgttttaacagaaaaatgagcatggaaaggtaaaaatgagaatccaaagacaggacaaaactcaccctccccaagagactgtgggaagacttccagcaacatgatgatagcacatttgagtcctaaaggtacagatacctaaacgaagcctaaactgcagccaagacgaagaggcagagaagacagaacagccaaggtgaaggtgagagaccagaccttaggctacgtgtgtggccttgggccgatgtcctgcttctaagtcttaggcacctgccaggcttaccttcccacctcatggggctgctgagtgttaagtgtgtcaaattttggtaaaggcatgttaaggactgtagcaggcaaggattcaatgagcaaatgcattcattgtgccaggcaccatgctaggggccagggataagtaaaatatgacacaggtccttctctcaagaacagatggtaagagtttccggcaagtacacaagcaactgcaatacagagtgctgattgctacagcatgggagagaacaagatgccttatcagctcaccaagatcagtaagtcagggaggcttcccaaagtgacacctaagctggagtaagagctaaccaggtgacaggaacagaagttgtttcaaacagaaacaggcatctgtatttgcaaatgcttagacagggttggcaaactatggccccatgttcccctctccccctcctttttttttttttttttttttttgagacagagtctggctctctctcacccaggatggagtgcagtggcgtgacctcggctcaccacaacctccacctcctgggttcaaacgattctcctgcctcagcctcctgggtaactgggaccacaggcgcgtgcaagcatgcctggctaatttttgtctttttaatagagagggggtttcagtatgttggcctggctgatctcaaactcctgatctcatgatctgtccaccttggcttcccaaagtgctgggattacaggcgtaagccaccacacctggcttcccctcccctttttatgttgaggtgacattcacaaaacaaaatgaaccattttaaagtgtatgattgaatggcatttaggacactcgcaatgtgtggaaccaaaacctcatcatagttccaaaacattttcatcacccaaaagaaattcctgtgcccattagtcagtccccagtcccctgacccaagtcccctagcagccaccaatcctactttctagctccatagatttactgattctaaatatttcatataaatggaataacaataaaatatgaggccttttgtgcctcacttttttcatttagtaagtttttgaggtttacctatgtgtagcatgtatcagtacttcatttttagggttaaataatgtcccactgtatggatacaccacaacttgtttatccactcatttgctggtgaacatttgggctgtttctaccttttggttattataaaaaatgctattacgaatatctgtgtaaaagtttttgtgtggatacattttcatttctcttaggtagacacctaacagtggaactgctgggtcaaatggtaattctgtgtttaacttttttttattttttgagatggagtctccctctgtcatttaggctggagtgcagtggtgcgatcttggctcactgcaagctctgcctcccgggttcacgcaattctcctgcctcagcctcccaagtagctgggactacaggcgcctgccaccatgcccggctagtttttttgtatttttagtagagacagggtttcaccgtgttagccaggatggtcttgatctcctgacctcgtgatccacctgcctcagcctcccaaagtgctgggattacaggtgtgagccaccacgcctggccttatgtttaactttttgaggaaccaccaaactgctttccacagcatctgaacatttttatattcctaccactaatgtaggagggttccaatttctccataacattgccaacacttcttttcttttcttttttttgagatggagtttcgctcttgttgcccaggctggagtgcaatggcgcgatctcggctcacttcaacctctgccttccaggttcaagcaattctcctgcctcagcctccggagtagctgggattaaaggcatgcaccaccacacccggctaattttgtatttttactagagatggggtttctccatgttggtcaggctggtctcaaactcctgacctcagggccaacacttattttctactttgtaaaaattataaccattcgagtgggtgtaaagtggtacttcattgtggttttgaattgcattttcctaatggctaatgatgtcaagcaagtcatttgcccactttttaactgggttgactttttgttgttgagttgtaagtgttctttgtatatctggatactagacccttatcagatagatgattttcaaatattacatcccaggttgtcttttcactttattggcaatatccttttatgcacaaaagtttttaattctgaagtccaaattatctattttttaattttgttgttcaggcttttggtgctattatatatctaagaatccatgccaaatccaaagtcataaagctttctccttatgttttcttctaagagttttgtagttttaccttctacattgaggtttcagatctattttgagtttatttttgtacatggtgtgaggcaggtgaccaactccattcttttgcatgtggatatttagttgtcccagcaccattcctgaagagactattgtttcaccattgaacagtcttgacactctcatcaaaaatcaattggccacagatgtaggggtgtattcctggaccttacattttttcccattggtctacatgtctattcttatgcccatgaggtgttttgttgttggtaaatgcatgggatttttttatttgttgttttttagtttgtcagtaaagcatatacatgtaactatgatttataatttttgttttatattcttcaaacatgatgatttctttgtaaagaggcataattcccaagagtttttattttgttgttgttgttgtcatttgttttgttttgttttgtttttgaggcagagttccactcttgttgcccaggctggagtgcaatggtgtgatctcggctcactgcaacctctgcatcctgggttcaggcgattctcccgcctcagcctcccaagtagctgggattacaggcacatgccacaactctcggctaatttttgtatttttagtaaagacggggtttcaccacattggccaggctggtctcgaactcctgacttcaggtgatcctcctgccttggcctcccaaagtgctgggattaaaggtgtgagtcaccgtgcctggcccccaagggtatttttaaaagcttaattgagatataattcacataccatagaacttatctatttaaagcaagcttgtccaacatgtggcccagtatagccttgtatgtggcccaaacacaaattcataaactttcttaaagcattatgaacttttggctgggcatggtggctcacacctgtaatcccagcactttgggaggccgaggcaggcagatcacctgaggtcaggagttcgagaccagactgaccaacatggagaaaccccatcactactaaaaatacaaaattagccaggtgtggtggtgcatgcctgtagtcccagttattcaggaaggctgaggcagtagaatcgcttgaacccgggaggcggaggttgcggtgagccaagaccatgccactgcactccagcctgggcaacaagagcaaaactcggtctcaaaaaaaaaaaattatgaatttttttgcaatttttgtttttagctcatcagctattgctagtgtattttatgtgtgacccaagacaattcttcttccagtgtggcccaggggatccaaaagatcagacacccctggtttaaagcataccatccaatgtttcttcgtatactcagagggctgtgcaatcatcactacaacatagttttagaacactttcatcctttgaaagaaaccctattagcattcaatcctcattcctatctcccagactccacctccagtcataggcaactacttatctattttctgtgtctataggtcagactatcctgaacatttcaaataaatggaatcatatagtatgtggtcttttgtgactggcatctttcacttagcttaatatttccaaggttcattcatgatgtatttttagtagagatggggtttcgccatgttggccaggctggtcttgaaatcctgaccacagggtgatctgcctgcctcagcctccctcccaaagtgctgggattacaggcatgagccactgtgcctggcccttctaagagttttataggttcagttcttacatttaggtctgatcgattttgagttttttagtattatgagacagaggtcccatttaatgcttctgcatataaatgtccagcgccccaagaccttgtattgaacaactcctctttttttcactgaactgtcttggcaaccttgtcaaaaatcaattgaccacaagggatacaacactttgattagactggaggaataagttcaaatgatcatgcctataatcccagcactctgggaggccgaagcgggcggattacttgaggtcaggagtttgagaccatcctggctaacatggtgaaaccccatctctactaaaaatacaaaaattagcagtgcgtggtggcacgtgcctataatcccagctactcgggaagctgaggcaggaggattgcttgaacccgggaggtggaggttgcagtgagccgagattgtgccactgcactccagcctcagcgacagagcaagaccctgtctcaaaaaataaaaaaaattaaaattaagaaattaaaattaatgaatttttaaaatatatatttgcactctactgatattattttgattcagagaaatatgttcataacttattagaaataaccttgagtagtttgagaccagcctggccaacacggtgaaaccctgtctctactaaaaacacaaaaaaaattagccaggcatggtggtgcacatctataatcccagctacctggaaggctgagataggagaatcacttgaacccaggaggtggaggttgcagtgagccgagatcgcaccattgcactccagcctggacaacagagcaaggctctgtctcaaaagaaaagaaaaaaaaagaaataaccttgagtaaatttaaatttatttctaagttgatggtatggctaggttttgataatttttatttggtttcccttccctttaatcagaaaattaactttcataccctgttcacaaaccatcaaagctgattttgaaacttaaaaaaaaaatcgccaggtaccatgcaaaagcaatcttccctttagaatgactgatggtatgctaaggtttttcgtggcatattattattaaaggtgaatacaaataaatgggccgggcgcggtggctcacacctgtaatcccagaactttgggaggccgaggtgggcagatcacttgaggtcaggagttcaagaccagcctggccaacatgatgaaacactgtctctactaaaaacgcaaaaattagctgagcatagtggcacacacctgtagtcccagctactcgggtggctgaggcaggagaatcacttgaatctggaaggtggaggttgcagtgagctgagttcgtgccactgcactccagcctgggtgacagagtgagactctgtctcagaaaaacaaaaaaagaaaagaaaggaaaacaaaacctgttttttgggcacatcacttttctgggactcatctgttctttttttttttttttttttaattttagagacagggtcttgttctattgcccaggctggaatgcaaagacatgatcatggctcactgtaaccttgaactcctgggctcaagcaattctcctgcctgagcctcccacgtagccaggactacaggtgcatgccaccacaccaagctaatttgtttgtcatctattctcaagttagtaccacattctattttttttaacttttttaatttttttttagacaaggtctcactctgtcacccaggctggagtgtagtggtgcaatctcagttcactgtaacctccacctcccaggctcaagcaattctcccacctcagcctccagagtagctggaactacaggtgcatgccatcatgcctggctagtttttgcattttttgtaaaaaatgggttttgccatgttgcctaggctggtctcgaactcctgggctcaggttatccaccttcctcaacctcccaaagtgctgggattacaggcatgagtcactgagcccagctagtaccacattctggatcactgtaggtttgtggcaagttttaaaattgggaagtataagtactccaactttttatttgttttatggttgttttggctattctgggttccttgcaattccacataaattttaggatcatcttgccaacttctacaaagaagctagctggtattccaatagagattatgttgaatttgtagaccaatttgaggagtacttccatcctaaaagtattaaatcttcgagtccatgaacatgcaatatttttcgatttagatcttctttaattacttccaaacatgttttgtagttttcagaatgtaacttttgcactttttaaattaaatttacctctaagtattttattctttttgatgttattattaatgagattgctttcctgatttcatttttggattgttcgttgcaaatgtttaggaacacaattgatgtttgcaaactgatattgtattctgtaaccttgttcaatttgtttattagttctaatagttttttactagattccttaggatttccatatacaagcttatgtcatctgcaaatagagacagctttaattcttccatttaaatctagatgcctttttgttttgttttgtttctgagacggagtctcgctcttttgcccaggccggactgtggtggtgctatctcggtcactgcaagctccgcctcccgggttcatgccattctcctgcctcagcctcccgagtagctgggactacaggcgcccgccaccgtgcccggctaattttttgtatttttagtagagacggggtttcaccgtgttagccaggatggtctcaatctcctgacctcgtgatccgcccgccttggcctcccaaagtgctgggattacaggcgtgagccaccgtgcccagcctaaatctagatgccttttatgtttttctcacctaattgccctggctagaatctctagtccaaagctgaacagaagtagcaagagaagacatccttgtcttgtttctgatccttgggggaaagctttcagtttttcaacatgaagtaagatgttagttgtatttgttgtagatgccctttatcagggtgagtaagccaaagtcttaggtcttgtctcccctgtatatctgcaatgccactgccttcatctagtcacacatgcttcatatcttctgggggttgcagaaatggaacagagcgttccagaaatggaagtactccttccctgtttgcgtattcttaacctttctcatacatgtctctattccagaacagactacatggttttgttcctgtatctgcctttcaactagtctcctggcctccagtcttcatggtggtccatcttcaacatcaatgatagcattttttcaattccactatgctgctaagaaggaaaattaattacatcactctcactcaaaacctgctacataattcccattgcctgcagtctggcccccaatcatctctctaagtcttgcccctctagctacctaatatgcttacctataggtatcatccacggtgggtgaccccagactcccagaaagagccattctcctccattctgtgcctttgcatacactgtgtccttccaaagtgcactttaatagctagcaaaatgcatcttagatcccctgtgttgcaggctgtcttgacttaagctgctctctcatggctcccacagtattctcttcaaacatgtgacagttccttaattactagaattgtgcagatacaccttccccactaggctatagacaaatcattcactggtcatcaggattgaatgacgaagatctatgtcccaagtgcaaacatcctgtagtcctcaagtatctggtgactgaattagccaccaggaatgaaaaaaggggacgggcgcggtggctcacgcctgtaatcccagcactttgggaggccaaggcgggcggatcacgaggtcaggagatcaaggccatcctggctaacacggagaaaccccatctctactaaaaatacaaaaaattagccaggcatggtggtgggcgcctgtagtcccagctactggggaggctgaggcaggagaatggcatgaacccaggaggcagagcttgcagtgagccgagatcgcgccactgcactccagcttgggtgacagagtaagactccgtctcaaaaaaaaaaaaaaaaaaagggaggacaaaaagatactgctttcagtataatagaatatgagttagtaacattccagtaagtccttaaaatacagtctaagaactacttcttttttttcccataaaattaaatgctttttagtgtttcaaataagcagcatttacacagaagcagctctatgttaaccatctagatgctgggactttgatacaatacctacagtgcagacacacgggggccagagatgccaggaaggccgcgttgtgtgtgggccgtggtgtgtgcgggcagtgtgtgcaattaccaaggacaggccagctgaccgcccatttccccaagacctccctccctgcggcagctgtgcacatcggggccctttgaccccatgggccacggtccctccctgccctggctgggacgcagtgggcaggatgtctagccctctctcgtcttcccgaaggactacttcttataaaactatgggttccaaattactctataaaattcctcaacaacctctcaaaacagtgctagaaatagtttatacaatgaacatcagtaacctgaaggaatgcagtagtagttaataggccaaaggtaaattaagattatttgatccaagttcagatttctttgtaatctctatttctctcagttccaggcctacttttgccttatacctataaccaactttttttttttttgagacagggtcttgctctgttgcccaggctggagtgcagtggcgcaatcttggctcactgcaacctcaaacccctgacctcaagagatcctcccgcctcggcctcccaaagtgctgggattacaggcatgagccaccgcacctggccctataaccaacttctaatgatttaaccactccattctaatattgggctttgaagttacatcagaccagcccctaaaggcagctcaaggcttacctgagccgagatgcctacgagcagcagccacttctggtactcatcagtccggtagtgaatcacctggcagcccaccagactggtatgtctatcaaacatcttcatgggctgggagtcaccttccatgctccagtggtagaccgcggtctcggtcaccaaggcaacagtgttcacagaaacccatttccagaaaatcacttcttctgccatagtatgagccttcattttactcttcatctcaatattaaagatctgaagtgtcttcccagctagtatttgatataatagagattagagaaagacaaattaaaaatctgaaagacaaattcatatactcttaattctgaattcttttaatattactttaggttgtactgctaatctgattaacagggtctgaaagatgctgccagagtagtaattaagcataccttaatgtctaaatattgagaagagcctgtatgcattaaattcttcttcagaggaatgtaaaagtatgtaactattcatagaaatatgtgaataacaatgagaaattagttctactgaagcaagcctctcttttagattggtttcttctagttttaaaatacttttctggataactcagcaaaaacataagacaccccttctctgtgtggtctccaattttcaagaaagactacaactatcccttcacattaaaccaacttctccaaatttgtcttaaattctagaccaatgctgacaaatggaattttctacaatgttggatatattctatatttgtatccatcacagcagataatagctatatgtggctactaagcacttaagatgtatctagcaagatatttcaggaactgaatttatacttttatttaactttaattaatttaagtgttaaacagccccatgtagctaatgtccaatagggcagtacaattctagacaaaatatttggcatccattctctggcaagagatccatattgtttctacatgtagcaatgaactaaattttgattttggaattatacaaaatttagacctaacataaaatattaaaatattgcttcccacaaagattgggaacaaggcaaggattatttctctgaccacttgttttgatactgagaataacatagctggtgtgataaggcaagaaaaataaaaggcataaagatcaaaaaaggaagtaaagctgtcttaactcacagacaacataattatttacaaagaaaatcctgcagaatctacaaatctacaaaacaactattagaattaatagatgactacaggagtgcagcaagatgcaaagacaacctacaaaaatttcaattgggctgggcacagtggctcacacctgtattcccagcactttgggaggctgaggctggtggatctcttgaggtcaggagtttgagaccagtctggtcaacatggtgaaaccccatctctaccaaaaatacaaaaattagccgggcttggtggcagtcacctgtaattccagctacttgagaggctgaggcaggagaatcgcttgaacccaggaggcagaggttgcagtgagccaagatgatgccactgcactccagcctgggtgacaaagtgaaaacaggtctcaaaaaaaatcaactgaattttgagatactagcagcaaacaatttggaaatataaaaaagaattcaggccgggcatggtggctcacgcctgtaatcccagcactttgggaagctgaggcaggtagattaccggaggtcaggagttcaagaacagcctggccaacatggtgaaaccccgtctctactaaaaatacgaaaattagccgggcatggtggcacactcctgtaatcccagctactcgggaggctgaggcaggagaattgcttgagcctgggaggcggaggttgcagtgagccaaaattgtgccactgcactctagcctgaccgacagagtaagactctgtctcaaaaaaaaaaaaaaaaaaattcataccaccacccaaaacatagcattttggagtaaatttaacaaagggtaagcaaagtctctacactataaaatattcctgaaagaaagtaaaggcttaaataaaagaaggggcataccatgttcatggatcagaacacttaaaattgccaagatgtcatttccccataaattacgtacaggttcaatgcaatcccaatcaaaatcccagaatccttttccttctttctttctttctttttaatagatacagggcctcactttgtcacccaggctggagtacagtggagcaatcatagctcattgcaacctcaaattcctgggctcaagtgatcctcctgcctcagcctctcaagtagttgggactataggcatgcactgccacactcagctaatttttcttttttttttctttttcttttatcttttttttttttttttttttgagacacagtctctctctgttgcccaggctggagtgcagtggcatcatctcagctcaatgcagcctccacctcccaggttcaagtgattctcctgcctcagccccccgagtatcagggattacaggcacatgccatcacgcccacctaattttcgcatttttttgtagagatggggtttcaccatgttggccacgctggtctcaaactcttgacctcaagtgagtcgcctgcctcagcctcccaaagtgctgggattataggcgcgagccaccatgcccagtctaatttttaatttttttttttttttagagactaggtcttgctatgctgcccaggctggtctcaaactcctggcctcatgcaatccttccatctcagcctgtcgaagtgctgggataacaggtgtgagccaccaccctggcccagcatcttttgtttgcttggtggaaaataaaatgatgctataatgaatatggaaatgcagaggacaaagaatagacataacaaatttggaaaagagcaaagctggaagacttacaatacctaatgttgagatgtactataaagctattaataaaacctatgttattgtcataagacacatagatcaatgaaacagaagaaagtctagaaacagctgcatgcactgatttgataaaagtgcctcaaaaaactcaataggcccaaacacattttttataaaaatagaaaaatccattctaaaatgtatatggaacctcaaaggacctcaaatagccaaaataatcttgataaagatgaacaaggttggatgatctcacacttcctgaatttaaacctcattacaaagttaaagtaagcaaatgtatggtaacagcatagaaacacagacaccagtggaatataagagagaactcaaaaatgaaccttcacatatatgatcaaatgatctttgacaagggtactaagaccattcaatgagaaaaaagaatactcttttcaacaaataatactgggaaaactgggtccacaaaataataaaattggacccttaccttataccatatacaaaaagtaactcaaaatggattaaagacctaaacataaaaactaaaatcacaggcagaacctgagtcctgttctctcactttcctccccagacagcatgagtttcaccactcactccactaccttctctactaactaccagtccctgggatccgtccagccgcccagctacagtacccggttgatcagcagtccagccggcatctatgcagatgtaagggatttgggctcccagatctctgtgtcctgctccaccagtttccagggtggcttggggtccagggccctggccactgggatggccaggggtctggcaggaatagggggcatctagaatgagaaggagaccatgcaaagcctgaacgaccacctggcctcctacctggacagagtgaggagcctggagactgagaattagaggctggagagcaaaaaccgggagcacctggagaagaagagaccccaggtcagagactgggccattacttcaagaccactgagaagctgatggctcagatctttgcaaattctgtggacaatgccttcatcgttctgcacactgacaatgcccatcttgctgctgctgactttagagtcaagtatgagacagagctggccatgcaccagtttgtgaggagcgacatccatgggctctgcaaggtcactgatgacaccagtgtcactgggctgtagatgaagacaaagattgagactctcaaggagaagctgttcttcatgaagaaccatgaagagggagtaaaaggcctacaagcccgtattactagctttgggttgactgtggaggcagatgtccaaatatcaggaccttggcaagatcatggcagatatctgggcccaatatgacaagctgactcagaagaacctagagaagctggacaggtactgatcccagcagattgaggagagcaccacagtggtcatcacgcagtccaccgagatcagagctgctgagataacactcacagagctgagatgtccagtccagtccttggagattggcctggacttgatgagaaatctgaagatcagcttggagaacagcctaagggaggtggaggcctgctataccacgcagatggagcagctcaacagggtcctactgtacctggagtcggagctggcacagacctgggcagagggacagcgccaggcccaggagtacgaggcctggaacatccaggtcaatctggaggctgagatcaccacctaccaccgcctgctggaagatggggaggacttcaatcttggtgaggccctagacagcagcaactccatgcaaaccatccaaaagaccaccacctgcaggatagtggacggcaaagtggtgtttgagaccaacgacaccaaagttctgaggaattgagccagcagaagcagggtaccctttggggagcaggaggccagtaaaaagttcacaggttaaaaaaaaccccaacaattaaaatcataaaatgtttagagaaaacataggggaaaagcttgatgacattggatcttgcaatgatttttttggatatgacaataaaagaaaaaaaatgaattggacagcatcagaggtcacaaaagagagaaaaggcaacccacagaataagagaaaatataggcatacctcactttattacactttgttttattgtgtcttgcagatattgcacttgttttgttgttttgttttgtttgagacagcgtttcgctcttgttgcccaggctggagtgcaatggcatgatcttggctcactgccacctctgcctctcaggttcaagagattctcctgcctcagcctctgtagtagttgggattacaggcgcccaccaccatgcccgactaatttttgtatttttagtagagacggggttttaccatgttggccaggctggtctcgaactcctgacctcaggtgatctgcccgcctcggcctcccaaagtgctgggattacaggcgttttttttgttttgtgaacaacaacaacaaaaaaaatcaaaggtttgcggcaatcttccatcaagcaagtctattggtatcatttttccaacagcatgtgctcacttcctgtctctgggtcacactttggtaattctcatgatatttcaaactttttcattattatatttgttatactgctctgtgatcagtgatctttcatgttattacagtaattgttttgtgtcaccatgaaccacacacatataagatagtggacttaataaatgtgtgtgttctaactgctccactgactggccatgccctagtccctcttcctctcttcaggcctccttattccctgagacacaacaatattgaaattaggccatttaacaaccttccttgctaaaggaaagtgaaagtgaaaggaagagtcctacgtctctcactttaagtcaaaagttaggaatgattaggctttgtgaggaaggcatgtcaaaagccaaggcagactgaaggttaggtctcttgcaccagttagccaacttgtgaacacaaaggaaaagttatttaaggaaattaaaagtgctatttcagtgaacacattaatgataagaaaacaaacagccttactgctgatatggacaaagttgtagtggcctggatagaagatctaagcagccagaacaatcccttaagccaaagcctaatccacagcaaggccctaactctctgcaattccatgaaggctgagagaggtgaagaagttgcagaagtctgaagctagcagaggttgattcatgaggtttaatgaaagaagccatctccatagcataaaacggcaaggtgaagcagcaagttctgatgcagaagctgtgtcaagttctccagacgacctagctaagatcattgatgaacaaattttcaatggagaagaaacaacctcctactggaaaaagatgccatttaggactcaagcaagagagaagtcaatgcctggcttcaaagcttcagaagacaggttaactctcttgttaggggataatgcagctggtaactttaaatggaaggaatgctcaccgaccactccaaaaatcctaaggcccttaagaattatgctaaattgactgggcgcagtggctcacacctgtaatcccagcactttggaaggctgaggcaggcagatcacttgaggtcaggagttcgagatcagcctgaccaacgtggaaagaaaccccgtctctactaaaaatacaaaaaattagccgggcatggtggtgcatgcctgtaattccagctacttgggaggctgaggcaggagaatcccttgaactcgggaggtggaggttgcggtgagccaatatcgtgccactgcactccagcctgggcaacaagagtgaaactctgtctcaaaaaaaaaaaaaaaaaaaaaaaaagaattatgctaaatctcctctgcctgtgttctatgaatggaaaaacaagagtcgtgatgatagtacatctgtttacagcatgatttactgaatatttaaaactcactgttcagatctactgatcagaaaaaaaaaaaaaggttcctttcaaaagattactgctctttgacaatgcacctggtcacctaagagctctgacggagatatacaaggagatgaaagctgttttcatgcctgctaacacatcaattctgcaatccgtggatcaaagagtaatttcacctttcaagtcttattatttaagaaatgcattttttttttttttgagacggagtctttgctctgttgcccaggctggagtgcagtggcgtaatcttggctcactgcaagctccgcctcccgggttcacgccattctcctgcctcagcctccccagtagctgggactacaggcgcccaaccatgcccagctaatgtcttgtatttttaatagagaaggggtttcaccgtgttagccaggatggtctcgacctcctgaccttgtgatccacccgcctcagcctcccacagtgctgggattacaggcggaagccaccgtgcccagcctaagaaatacatttttaaaggctacagctgccataaatatgtctcctttgatggatctaggcgaagtaaattgataacctcctggaaaggattcaccattctagatgcaactaagaacattcgtgattcacgagaggagatcaaaatatcaatattaacaggaatttggaagaagtgtattccaaccctcatgaatgactttgtgaggttcaggacttcagtggaggaagtcattgcagatgtggtagaaacagcaagagaattagaagtggagcctgaagatgggactgaattgttgcaatctcaggatcaaacttgaacagatgagggctgcttcttagggatgaccaaagaaaggggtttcttccaatggaatctactcccagtgaagatgctgtgaacactgttgaaattactacaagaatttagaacagtacataaacttacctgataaagcagcaccagagtctgaaaggactgactccaattctggaagaagtctactgtgggtaaaatgttagcaaacagcattgcacgctacagagcaatctttcattaaaggaagagtcaatccctgcggaaacctcactgatgtctttttttaaaattatttattatttatttatttgttttttgagatggagtctcactctgttgccagactggagtgcagtggcgtgatcttggctcactgcaacctccacctcccggattcaagcgattctcctgcctcagcctcccaagtagctgggactacaggagcgtgccaccaggcccagctaatttttttgtatttttagtagagacggggtttcaccatgttggccaggatggtctcgatctcttgacctcatgatctgcctgcctcagcctcccaaagtgctgggattacaggcataagccaccgcacccagcctgatgtcttattttaagaaattgccagcctgtcgcggtggctcatgcctgtagtcccagcactttgggaggctgaggcaggtggatcacgaagtcaggagatggagaccatcctggctaatgtggtgaaaccccatctctactaaaaatacaaaaaattggctgggcttggtggcaggtgcctgtggtcccacctatttgggaggctgaggcaggagaatggcatgaacccgggaggcggagcttacagtgagccgagattgcactactgcactccagcctgggcaacagggtaagactctgtctcaaaaaaaaaaaaaaaattgccacagccactccagccttcagccaccaccactgtgatcaatcagcagccattggcatcaaggcaagaccctccaccagtaaaaagtttacaactcgcagctgggtacagtggctcatgcctgtaatcccagcactttgggaggctgaggccggcagatcacttgaggtcaggagttcgagatcagcctggccaacatggtgaaaccccatctctactaaaaatacaaaaattagctgggcgtggtcgcacgtgcttgtaatcccagctactcgggaggctgaggcaggaggatcccttaaccctggtaaacagaagttgcagagagttgagataacgccactgcactccagcctgggtgacagagagagactccatctttaaaaaaaaaaaaaaaaaagattacaactcactgaaggctgataatggtaagcaatttttaggaataaataaatagattattcatttatttatttatttattttgagacagagtctctctctgtaacccaggctgacatgcagtcatcagactcctgggctcaagatattctcccatctcagcctccttgagtaggtgagactacaggcgtgcaccaccacacccagaattttttttttttttttttgagctaaggtctcactgtattctttgccatgctgctcttgaattcttaggctcaagcgatcttcccaccttggcctctgaaagtactaggattagaggtatatgccaccatgcctggccataaattatttatttttatttttatttttattttttgagatggagtctcactctgtcacccaggctgaagtgcagtggcgcagtcttggctcactgcaacctctgcctcccgggttcacaccattctccgcctcagcctcttgacaggctgggactacaggcaaccgccaccacgcccagctaatttttgggttttgtatttttagtagagacagggtttcactgtgttagccaggatggtcttgatctcctgaccttgtgattctcctgcctcggcctcccaaagtgctgggattataggcgtgagccactgcacccagccaaattattttttaattaagataatccatttttttagacataatgctatttcacacttaatagattacagcatagtataaacataacttttatatgcactgggaaaccaaaaaattcatgtaactcactattgtaatattctttttattgtggtagtttggaattgaactcaaaatatcttcaaggtatgcctgtatatggaaatcatatatctgacaaggggttaatatccagaatatataaagaatgcctacaactcaacaacaaaaaacacaaatagtccagttaaaaaatgacccacgtggagtggttcacgcctgtaatcctagcgctttgggaagctgagacgggatgatcatgtgaggccaagagtttaagacagcctgggcaacatggcaagaccctgtctctacaaagaaaaaatgtttttaattagctggttgtagtggcgcatgcctatagtcctagctacttgggaggctgaggtaggaggatagcttgagtccaggagttcgaagttacagtctcttaaaaaaaaaaaaaaatggctaccattaaaaagaaaacaatacaaataacaagtgttagcaagaatgtgaaaaaattggaaccctgtgcactactgagaatataaaatagtgcaaccactatagaaaagagatggcagttcctcaaaaaaattaaaaatgaataatgatatgatccagtcaattacttgtgggtatagaattaaaaggattaaaaacaggttccccaaaagacatctgtacactcatgttaacagcggaattatttacagatctagctttttttgaggtactactatctctgaggtacacagctagaaaaaaagagttaatctgactatccagttagttagccaagctacgcaacaactgatattattacaatattatcatcaattagcaaaactggttttaaaccacaatttgagaaataaggctgctgttgctaacagaaagtctttaatgatatcatgatatacctgggcaataattaagatgatttcttgaattcacaaaaaggagcaactcaatggtgaaatttcatgcaatttttttttttttgagacagagtttcgcttttggggcccaagctggagtgcaatgggtcgatctaggttcattgcaacctccgcctcccggattcaagtgattgtcctccttcagcgtcccaagtagctgggattataggcatacaccaacatgcccagcaaatttttgtatttttagtagagacagggtttcaccatgttggccaggctggtctcaaactcctgacctcaggtgatccacctaccttgtgctcccaaagtgctgggattacaggtgtgagccaccgtgcccagccgaaatttgatacaatttatatccaaaacacatgatcagtaagataaaggcctgctgccataaaacagttctaaagttagctataactatattatcaacttaagtttaaactatataaatttataaaacaactgcttttggacataatttaggtgtgatgtagttttgctctctagtcaaaatggtaaatgttagaccctcactgtcttcaggcactaacagcttatggtaaatgacttctaatcagactgaactaagatgggagctcaaatccacaaaaagaaataaagagcactggatatgataaatatgttggttagtataaagatttctcttaatttcattaaataatatcatttaaaaccacaataaaactacaggttgttgagtttataacatatatagatgcatatatgcatcttattttctcttttttaatatattttatatattcatatatatgaatgataaaaatagcacaacagagggaggaggaaatgaagctatgctggagtgaaatttctgcattttaacagaagttaatattaataatctgaaatcatttgtgatgttaggatgcattttataaaccctacagcaaccaccataaaaatacacatacatacacaaaatagtaaaaagaaaaattcagaagaattaaaatggtatgctacattttaacaagaaaggcacagggtaggcagctgtgcgcatgttcctgaagcagcctatatacaccttgccagaagtagggtttttcaaaacaatcaagaaaactaacaaatcttatttatttatttttacagacagggtctcactctgttacctaggctggagtgcaatggcactatcccagctcactgtagccttgacataatgggcttaggatgatcctcaagcctcagacttctgagtagctggaaccacagacacgtactaccacactggctagttttttgtttttgttttttaatttgtagagatggagtctccctatgttgcccaggctggtcttgaacttctggtcccaagtgatcctgtcacttcagactcccaaagtgctgggattacaggtatgagccaccaggcctgacccaaaccttagttaatgatcaagaaaaaaacagaagacacaaattatcaaaattaagaatgaaagagggcaccactgccaaccccaaagaaattaaaagaagcgaatattatgaacaattttatgtcaacatactagaagacttagataacctggatacattcctagaaagacacaaattaccaaaactgacacaagaaaacagaaaatctgaacagattcacagcaagtaaggaagttgaatttgaaatttaaaatcttcccacaaagaaaaccccaggaccagaaggctttcactgttgaattctatcaaatactcaaagaagacagaaataagtccttcacagattctttcagaatatagaggaagaaggacctcattctctaaggccaacatttgcctaattacaaagtcacaaaaggacatcacaagaaaagaaaactatagaccaattataaaaataacagaaaacccttagaatattagtgaacaaaatccaacaacataaaaaaaccaccatacaccatgaccaaaagagatttaccacaggaatgcaaggttggcttaatagccaataattaatttatgtaatacaccacactaataaaggacacaaactatgtgatcatctcagtagacacagaaaatagaagggaacttctccaacttgataaaggatttatctaccccaaatccacagccaacatcatatttaattgtaaaaggctaaaaactcccccctaaggtcagaaataattcaacgatttctgttcttgtcacttctgtttaatactgtactgggtattctagccgatgcaatgttgaaacaaacagaatctggattagaaaggaagatgtaaaactgtctattcacagataacatgatacagtatgtagaaaatgccaaggaatccactaaaaactacaagaataagtttaataagtatataggatacagaaaaatatacaaaaattattttatttctatatactagcaagaaacaatccaaaaataaaactaagaaaataagtctgtatataataacataaaaaaagaataaaatacttgggaataaatttaacaaagaagtataggatttgctcactgaatatgcaaaacatcactgaaagaaattaaagatctaaataaacagagacattaaatgactagaagacttaatattgtcaagatagcaattcttaccaaattgataaattcaatgtaatctctatcaaagccccagaaggatttttgtaggaattcacaaactaaacccaaaatttatgtggcaattcaaaggatctcgtttcaaagagtttcaaaaactattttgaaaaacactaagttggagtaccaacactatctgacttccaaattaccataaagctacaactatcaagtaatcggtgcaagaatgggcacagatctgggtcgggcacagtggctcacacctgtaatcccaatactttgtgaggctgaggcaggtggattacctgaggtcaggagttcaagaccagcttggccaacatggggaaaccccatctctactaagcatacaaaaaactagccaggcatggtggcaggcacctgtaatcccagctacttggaaggctgaggcaggagaatcgcttgaacccaggaggcagaggttgcagtgagccaagattgcgcccctgcactccaggctgggtgagaagaacaagactctgtctcaaaaaaaaaaaaaattaaaactacaaaaccataggctaagcactcttagctatgactccaaaagcatgatccattaaagaaaaaaaaaataggtaagttgggctttatcaaaattagtaagttttgcccttcaaaacatatcctatggtttgaatgttttttgttctctccaaaatgcatgctgaaacttcatccccaagtgttgggagatggagccttttgggaggcaagccctcatgttctcacaaaagagcttgatggagggacttaggttcctttttgcccttctgtcacagtgttcctcccctccagaggatgcagcaacaggggccatcttggaagtggagtgtgaacccttaacagacacactatctggtagcatcttaatcttggacttcccagcctccagaactatgagaaataaatttctattctttatagatttcccagtgtcagccatttcattatagcagcacaaacagactaagacaagatgtcattaggagaatgaaaagacaaggtacagactgggagaaaatatatgtaaatcacatagctgataaactatgtatatccagaatatataaagaactcttataattcaataataagatggacaacacaattaagaactgggcaaatatttaaatagacatttctcagaaaatatatataaatggttaataatcatatttaaaaataaaagatatttaacataattaggcattagagaaatacaaattaaaactgcaaaatgctagtacacaaccactggaattgctataataaaaaagatagtatcaagtgttggcatggatgtgtggagaaactggcatcctcatacattgctgatgggtacataaaatgagacagtcactttggaaaacagttgggcagtttcttaaaaagctaaacagggccaggtgcagtggctcatgcctgtaattccagcaatttgggaggccaacgcaggtggatcacaaggtcagatcaagaccatcctggccaacatggtgaaacctcgtctctactaaaaatacaaaaattagccaggcgtggcggcacatacctgtagtcccagctactcgggaggctgaggcaggagaattgcttgaacccaggaggcagaggctgcagtgagccgcgatagcgccactgcactccagcctgggtgacagagcaagactcctcaaaaaaaaaaaaaaagaagaaaaaaagctaaacaggccggtagtggtggttcacgcctgtaatcccagcactttgggaggccaagggggtggatcatgaggtcaggacttcaagaccagcatggctgagatggtgaaaccccgtccctacaaaaaacacaaaaattagccaagcgcaatggcaggtgcctgtaatcccagctacttgggaggctgaggcaggagaatcacttgaacctgggcagcagaggttacagtgagccaatatcatgccattgcactccagcctggatgggcgatagagtgagactccatctgaaaaaaaaagctaaacaaatttatcatatgatccagcaattctactccacccaagagaaatgaaaatatatgtccacatgcacacatatgtttattgcagcactatttacaatagcaaagacatggaaccaacccaaatgcccatcagtgatggactggaaaatgtggtacatacacaccacggaatactatgcagccacaaaaagaaatgagatcatgtcctttgcagggacatggatgaagctggaagccatcatcctcagcaaactaacacaggaacagaaaaccaaacactgcatgttctcactcataagtgggagttgaacaagtgaacacatggacacagcgaggggaacaacacacaccaggcctgtcaggggagtggggggcgaagagagagagagcatcaggacaaagttaatgtatgcagggcttaaaacctagaggatgggttgataggggaagcaaactaccatggcacatgtatacctatgtaataaacctgcatgttctgcacatgtatcctggaacttaaagtaaaattaaaaaaaaaaaaaagaaattgcagaacaacaacaacaaagaaaatatgtccacacaaagacttgtcagtgagcattgatagcagcaatattcttaatagctaaaaactggaaacaatccaaatgtccatcaactggtgaatggaaaaacaaaatgtggcatatccatacaatgaaacactattagacaataaaaaggaacaaactactgatacatgttataacatggatggacctcaaaaacactatgctaggtaaaggaagccagatgtaaaagactacatattgtatgattccatttatttgaattgtctacaagaaagtctgttgaggaagaaagcagatgagttgctgcctcgggccgggagtaggagtgagaatggttctaaacaggcatgaggaaactttctggggttgcagacatgttccaaaactgtattgtagagatgattccacaactctatgaattcactaaaaatcaccgagaaggagtgaatgttggtcgggcacggtggctcatgcctgtaatcccagcactttgggaggctgaggcaggtggatcacaaagtcaagagatcgagaccatcctggctaacatggtgaaaccccgtctctactaaaaatacaaaaaattagctgggtgtgatggtgggcacctgtagtcccagctactcaggaggctgaggcaggagaatggtgtgaacccgggaggcagaggttgcagtgagccaagaccatgccactgcactccagcctgggcaacagagcgagactccaactcaaaaaaaaaaaaaaaaaaagaataagtgaatgttatggtatgtaaattatacttgaaaaaagcagacaaagaaagatataaaaaaaaaatctggaccaaaaattcttggtggtacgctgtcaggatgggggtaccttttagtgtcaagcagccttagatcacagaggaaatttcttctagcttgaaaacttgtcaagttgtccttagcctggtttaaatgaacatgtgtttatgaggcacaaaatattcagcatcactaaaaggaccaaaaaaggaccagccttctttgggaaatacttcaggtcagacttaagtagtctaggtgaggagggggcctccagggggtgccattccccctcttctatcccccactgagctcagtgccaactctgccgcacagatactagattagcctatactccatctacttctaaaaattaagagaaaaaaggtaaagtttgtaaaaagagatacatataaatactgaaaaggtaatgtgatatggtttggttctgtgtccccactcaaatctcatctcaagttgtagttcccagtgttggagagggacctggtgggaggtgactggatcatggaggcagatttcccccttgctgttctggtgatagtgagtgagttctcacgagatctgatgggtataagtgtgtgtgtggctactctggacacactgcctgtgggttagccctgctctgcaaggagcagttaaaaaaaagtgtgtgtgtatggcactcccccttttgttctctctctactgctccgctacggtaagacatgcttgcttccccttcaccttctgccatgattataagtttcctcaggcctcctagccaagcttcctatatagcctatggaactgtgagtcaattcaacctcttttcttcataaattatcctgtctcaggtagttctttatagcactgtgagaacggaccaacacacaatgtttcataataaaattgacaatatcacacctgggccagtaatgcaaggtatctgccaactttccctataaaaggacataaaagacctctgtctgttttgttttgttttgtttttacaactcctcataaaaaccattcttggccaattgaggtggctcacatcagtagtctcaggactttggaaggctgaggtgagaggatcattttaggccaggagtttgagatcagcctgggcaacatagtcagataccatctctacaaaaaatgtttaaacattagctgggcatggtggcatgtgcctgtagtcctagctacttcagaggctgacgcaggaggatcgtttgagcccaggagttcaaggctacagtgagccatgatcacatcactgcattcctgcctggatgacagagagagacctgatcttaaaacaaacaaataaaaaacattcctagttcaggagcaaaaagcagaccgtttgccaatccctcagttaaggtgttccactaaaatcacaagcaacagatgagtaattctgccaccacttcatgctctttaagtcaaaggcaaaatgtatctggttttaaagaattcaccacaaatccgtcagcaaagaaagtatgaacagagactgggtactgggtaagtgaatctgctccaggcttctccagaaagccgggcaatgacgtgggctgagtatctctgagcacttgggagttcacggccaggcatgaggacaggctgcaatggtgtcccttttaatttttttttgagacagagtttcgctcttttttgtttgtttgtttgagacagagtttcgctcttgttgcccaggctagagtgcaatagcacgatcttggctcactgcaacttctgcctcctgggttcaagtgattctcccgcctcagcctcccgagtaactgagattacaggtgcacgccaccacgcccagctaatttttgtatttttagtagagaggaggttactccacgttcgtcaggctggtctcgaactcccgacctccaggtgatctgcctgcctcggcctcccaaagtgttgggattacaggcgtgagccaccacgcccggccttaatttaatttaatattatttttagggacagggtcttgctctgtcacccaggctggaatgcagtggcacgataatagctcactacaacttcgaactcctgggctcaagtaattctccagccttggcctcccaaagcactgggattacagacatgagccacctggcctagccctttttgtaaagggaggtccgagagctgcttcacgagcccctttccaatcacaaaacttcaccagccaaaatgggaaaaatctgtgagatacaaggtgcagcacccccccacacaccctgtatttctgcactggatcctagaagctagtcaaggtgtgtgatatggcagaggactctgaggagctcacttacaaatcaatcatctccatcaaccaatcactatacaaacaactctttcttcaaagacagtttgctcattttggtgtagggccttgaaaacacactgtacatcctccacttgtcaacgatttgtactacaatgatctgagattttactgctacagaattagcagtaaaaataagataaagccttaaaattatgtccctttttggttccagagtcttacacttcccccacggaaaagaaaacaagactcaacatgttatagttgaagtgatctatatgaccattaagaacgaaaataaaaagcagcagcccctgccacctggaagctggcctggcaatcacagcaaggccatgctgctctcctgatggacataaaccaccttggagaacaccagcctcaggcaagggccctctgagaccacgatcaagtgagacacagcaagcacagaaaaaacaaggttactgcgcaactcacaaaataccaacacgcctctctttcagctaaaatgagtgactgctacttctttacccattatagctttaatctcactctagtcttccctccctaatagatgaaatttattgagatacgcaatcataaaaattacccccacttgctgccaacatccaatctacagcaaacccctgcttccttagactaccccctaaatcatccaaccaaagcccaaatcctataaaaggctctaacaccttcttactgagacactccccagttccccatggcgtgtgttctctcccactgcaacagtaaacccaccttcttcaactgcaagtgtgttcctggtggtctttggctggaagggattgacaacatctaactattgcgttctctttactccccgactccacaccacaacacacacacacacaccctaggagctccgcactgcacattgttaaagagaactgtaccagaaaaccaggaagattaaaatgcagatcatttctgagacctgctgaaaacactaaacagcaaacaaaaccgcaaacaacatgctaaataaggcctctcaaaagtactacaacaaggctgggtacagtggctcatgcctataatccaagcactttgagaggccaaggcaggaggatcacttgaggccaggagctcaagaccagcctgaacaacatggtgggacccccttctctacaaatatttttttaagtactacaacaacataaaatgcagaaaagggcgacactgcaaggcaaatattccatcaaaaagagccaaggggtaagtgacaaagtaagagacagataaaagcatcattaatatcccataattgtaataatttctaaccaaaatcatttatactgcttacactatatgttcaaataattactttgacaagattacaagggaaaaggtagggttggtaatagaacaaagatcctttcaaataaaagaatttcagttatttctttttaaatagaaaggtcttaactttcagatgtccttctacctactgaaatgaccaagtagacactatttctgtaataaaatagaagcctaggcaaagctaatatttggcattcacaaattttacctccagaaacagtttttgcttttctttgtttcttttttttttttttttgagaccgatttttgctcttgttgtccaggctggagtgcaatggcgcgatctctgctcaccgcaacctccacctcctgggttcaagagattctcctcagccttcctgaggagctgggattacaggcatgcgccaccacgcccagctaattttttgtatttttaatagagatggggtttctccatgttggtcaggctagtcttcgaactcccaacctcaggtgatctgcctgcctcggcctcccaaagtgctgggattacaggcatgagtcactgcgcccggcccagtttttgcttttcaaagtaagtgatactgcatttcacacaaaacattaagtctactgcatacataatccttttatttgccaaatgaaggcaatataagaagattctatatttttcaagataactagaaggctttaagcacccaagactccctgatttcaaggaagtaaaattctattaattatcagctcctctatcattgatgtgtttcacaggaggaaaacccccgagcctgtgtcgtcggatgaccggaagcaccactgcagcaggccctcaggcaagggggccacacagccttcctgggaaacatgcacagtgctgttgtgcgttcctagtcgcatgaagacaaaggcctgggcattttcttcctctcggtgtgtctggcgctgtgggtgatgttaccaagaagctctggtgctcaggggcctcttactagggcacactaaacataacttttgctaaaacttttggaattaagtggaatactattgaggagcacttcgccatgagcttagtgacacttgttcaatatttaaggtaacaaagcagttaaaatgaggtaagattcctttctaacaatcccatcgggtttacctttcagagctatcaccttagaggctggattcatgatggcactctctgcagagataggccgtcggatcggagccattgggtcactcatgtcaatgatcgtgacctgtgcctgctcaccaactttctctcggatacatatgaacttgtcagattccatggtcagtgtgctgaatccaatgttagctggattaattccaaggttttggagctaaacagaaaaaaagcatttgattaaatttttttcctctgaaatggactgactgtagccaaaggcaaaagaggagaagttaaataaaatttagaaaaaagttaacattaggtaaacacttgaaggaaacattagcttgcttttctacgcctgtaatagatccacccaagcctgtgaatcaactctccttgagagattaccagcccacagtggagataagacatgtgcaggatgacactaggcagtgtcaaggacgccacaagtgatacagacaggaggagatgagttgggggtgaactcccaaagaacaccatcagataaggtgtcacagataagcccaccaccgaggagagctttgggaggaaggaggtcttggagaggtgaaggcgagggaagtggaagggaaaaagggaggaaacacaaaacctgatttctccaaaaggcaagaaaaaagaactggccaaaagtttttgcttaaacatttccctagatatcatcaaacctgtctacatctgacttgaatgaatttctaagtcagtgtgaatacttcctggagagtctggggttaataagaaagtcagcaggtttggcacatcttccagggccgatggactgctactactgtgtaaactgaaaccaagcacctttctccaaaggccatcttatacgcagtgcctgggctaaatcaagacctgctaatgggataagcttcagtgaaaaactctgggaaaacacatactcaataaatgtttatcactcccacaaagcaccaagcttatttctataaatttctctgctctgacctacctacaagacacctttatttacttatttacttatttatttatttattttttgagccggagtctcgctctgttgcccaggctggagtgcagtggtgcgatctcggctcactgcaagctccgcctcccgggttcacgccattctcctgcctcagcctcccaagtagctggggcttcaggcgcccgccaccacgcctggctattttttgtatttttttttagtagagacggggtttcaccgtgttagccaggatggtctcaatctcctgacctcgtgatccgccctccttggcctcccaaagcgctgggattacaggcgtgagccaccgcgtctggtcgacacctttatttttaaacactgttctgttcagccccaattctactgctactgattggaccacttaacatctgttaccttgtgtaaccttgaagaggctcacactagcaacaaagatcatggaccgctgcattaaaattgcaccaccctttggaaggaacacaagtgagactgttcatactgagagtataattcaggacggtgccttgtttgtcttttgtagcagagtctagcacatactggatgttccagctgctgagtggagcaggctacaggacaacaagtcacctcatctcatcttcctgttaacccactgagacaagcatctcacacacactttacacttgggaaaaacaaagtgttggggttaagaaatctttcagaaattacaaagctgattaatgatggagccaggtataataaagcctgtgttctgaccacaatactgagttgtttgaaattcatattccattttaacacagaaaagataaactaagtggtgattatgttcccaaatgagtccaccaaaacaaacaaaaacacatataacagcaaaaaaacaaaacattacttcataactgtagtgaaatagttttttaaaaaatagaacttgccaattgatattgccattattacaagaaagtcccttcatgttccaacgttgggttatagcaaggaaaataatgctaggagtggtttattaagcataggaaaaacctaagtatttttcctgttctcacacatcactcaacacaagactgccaacgccagatgtgggggggtttctccagcagacaccacctagttatcctacaatttaattcaattctgacaatatctacctggaaatagtatcagatcccacaggttgagggctcagtcccataagactgactacacttcagacactaatcgcaagccccaggctgtggcctgtacttctgaccatccagctataaagcagggttcccatgaccttcttcctgggtttgactaatttgttggagtggctaacagaactcaaggaaacacgtttctcatttattacaagggatattacaaaggatactgatgaaccgccagatggaagaggcgcatagagaaaggcgcgaggggtgtccttgcctctcccagcacaccgctcttcagggacctccatgtgttcagctatcatggagctcccgacatctatctacacatcagcaccacattattttatttatggaggttttgtaacatctggtagggcctgccgtcctcagcacttgttacttttggaattttcttaggtattatattgcttaacattttgtaagtctaaaaaaaaattcaagccccaaaataagaacatgggggtcatttgtggcaggcgaagtcatgaaactggacggaagcaccaagagagaccgtgaaaagtgagagaatggtttggaagcccagggcacagagccccaggacacaccaaggcttagaaggcaggcagaagagcagcccatgaagatggacataatttacttaagtaaagttaacatatttaagtaaaccaagaataaaagataacagaagccccataagcacaaccactgatacttagtaaaccaggaaaccacattatcacaaccaaagaaaacctcccagtctcaccacctttttcacaaatgagccatgttcaaattccatcatcctctcctagtttagttccctgctggcttatacaacaacatccaaggtcataaattcctggaggacacagatcagattagtggggtttttgttttgctttgtttttgagacggagtctagccctgtcccccaggctggagtgcagtggcgtgatctcggctcactgcaacatccacctcccgggttcaagcgattctccagcctcagcctcctgggtagctgggattacaggcactcaccaccacgcccagctattttttgtatttttagtagagacggggtttcaccatgttggccaggctggtctcgaactcctgacttgtggtgatccacctgccttggcctcccaaagtgctgggattacaggcttgagccaccacaactggatagattagtgttatttactctgtctgcaattaatagaaaaatcctgaaaaatagaataatataaatgccctagaagttacagtatttatgtatttatgtatttatttatttatttgagacagtctcgctgcgacgcccatcctggagtgcaatggcacaatcttggttcactgcaacctccgcttcccgagttccagcaattctcctgcctcaccctcccgagtagctgggactacaggcatgcgccaccacgctcggctgatttttgtaatttttagtagagatggggtttcaccatattagctaggctggtctcgaactcctgacctcaagtaatttgcctgccttggcctcccaaagtgctaggatttacaatatttattaacaaaacagaggacagtgggattccagaagataagactgctgcatctgaggtttcccctccaaattctacaacattatccatcagatttgtgagccctttgaaaagaaaaacatgaatacctgcaatcaatatgggctcactaagaagtcatgccaaaccaatctaattttcttgaagccaagtaaatgtgatagaataaatcttcatttcagcaaagtatctggcttacctctgctgaggtagccaaagtaactttcacggataatcagtcccctaccccaagccttttatctgtggcatgcttatagaatagagagctttgcgctttgtgttagttattcatatttacttaatctcttgtttcttctcagagtcaaattcattttgaatccatcaaaacatttagcacataaaagcccaaacaatgtatgaaacaaaagactcttggaatgaggtagaaaagcatgaggtgagcttgtgtccacagctgaactgcacctcagtggtgctggccacatggatctgtctgtctgctgccagggcccagagctctgaccttaatcacctgctagtcaatattctgaataatgactctaaccaaagtcatatacagggactgttttatcggctaaggttatgctttgagactgtcaatatactagagtaacaatcagaatcttaacagatttgaaaggactatgaaattaaaaagataaatgtacacaaataaaatacatttgtgttaagtataaaaaaaagatcaaagcttgcttcaaaaagcagctctaatacataaaatgtcaaccaaatgcaatgcataggccttctttggatgctgattcaaataaagcatttgaaacaaatagagaaacaacactgacaagatactggatgatactgagaaactactgattttttttttttaggtgtgatgttattagagttaaaaaataaagaattattagtgtatatcaatggatgaatagataagcaaaatgtgttatacacatgcaataggagtattattcagccttaaaaaggaaggaaattctgacacatgctacaacatgaatgaaccttgaggtcattatgctaagtaaaaaaaaaccaaggtctggtgagatggctcacgcctgtaattccagcactttgggaggctgaggcgggtgggtcgcttgaggtcaggagatcgagaccagcctggccaacacggtgaaaccctgtctctatcaaaaatacaaaaattagccaggcatagtggcgggcgcctgtaatcccagctacttgggaggcggaggcaggagaatcacctgaacccaggaggtggaggttgcagtgtgctgagattgtgccactgtactccagcctgggcaacagagcgagactccatctcaaaaaaaaaaaaaaaaaaaaagacagtcacacaaaaagacaaatattgtatgattccatttatatccagtatgtagaagagtcaaatctatagagacaaaaagtagatggggttggggggaggagtgtgaatggggagtcatttcttaacaggtatggagcacccattttacaagatgaaaagagttgtgggccgggcgcggcggctcacacctgtaatcccagcactctgggaggccgaggcgggcagatcacgaggtcaggagatcgagaccatcctggctaacacagtgaaaccctgtctctactaaaaaaaaatacaaaaaaattagccaggcatggtggtgggtgcctgtagtcccagctactcaggaggctgaggcaggagaatggcgtgaacccaggaggcagagcttgcagtgagccgagattgcaccactgcactctagcctgggcgacagagcgagaccctgtctcaaaaaaaaaaaaaaaaagaaaagagttttggagatggatggtggtgatggctgcataacaatttgaatgtacttaatatcgctaaaatatacacctaaaaatggttaagatgataaattttatgttatgtatattttaccacaattttaaaacttggaaaaaaataacaaagagttctctcttggtgacacatcctaaagtgtttaaggataaaacaagatgtctggaattggcctcaataaaatttggcagtgatcggagacgtaagtaaatcaaagctggccacgtattggtaagcaatcattcttggtcttgtctacctatctggattttccggctttagcaggataggactggatgctctccagacagagcagtgcactgaagtgggcctgggttttctaaattgtccttttgttctcagtttggggatcgatgttgggttaatacggtgacattctgatttcaactccaaataccaagaattggtaatcctgaataatttgtatccaatctcttgagcatagtgggttcttaaataatagtagctgagtcaagttccttatctaagagcatacatacacatgtatggcatttgaaaaaggtaaaagtccctcacaaataagacagtgttttaacaactgagaagagtggatccaaaaataagataaagactattagaatcagattaaattaagacagtagttctcaaccaggagtgctattctgcattcttcagaaatgggaaaggggcggccgggcacggtggctcacgcctataatcctagcactttgggaggtcgaggtgggcagatcataaggtcaagagatggagaccatcctggccaatatggtgaaaccccgtctctactaaaaacacaaaaattagccaggcatggtggcgtgcacctgtagtctcagctactcgggaggctgaggcaggagaattgcttcaacccaggaggcggaggctgcagtgagccaagatcgcgccactgcactccagcctggcgacagagccaagactccgtctcaaaaaaaaaaaaagaaataggcaatgggttcgggcgcagtgggtcacgcttgtaatcccagcactttgggaggccaagacgggtggatcacttgagatcaggagttcaagaccagcctggccaacatggtgaaaccccgtctccactaaaaatacaaaaattagctaggcctggtggcatgtgcctgtaatcccagctactcaggaggccgaggcaggagaacccaggaggtggaggctgcagcaagccaggatcactccactgcactccagcctgggcgacagagcgagactctgtctcaaaaaaaaaaaaagaaaaagaaaaagaaaaaaagaaatgggcaagggtagttttaatagtacaatgagtggggaactcattctctactcatttagccaggaatgctcaatacaggacaatcccacaaaaataacttttccatctaagatgccagatactactgtgagtttttctccatacgcaggaactaagtcccagaaaagtgatgtgctgaaaagccaggttttttctttctttctttccttttttttttttttttagacagagtcttactctgtcacccaggctggagtgcagtggtggcaccatctcggctcattgcaacctctgcctccccagttcaagtgattctccagcctcagcctcccaagtagctgggactacaagtgcccactaccacgcctggctaattttcatattttcagtagagacggggtttcaccacattggccagactggtctcaaactcctgacttcaagtgatccacccgcctcggcctcccaaagtgctgggattataggcgtgagccacagggcctggcccaggtttgttttttttttcactagttagtagaaataaccaaggattcctgatccctagtatattattctgataggtaacctagctacacatttttaaaaaaattttctttctttttttctttcttttgagacagagtcttgctctgtcgccaaggctggagtgcagtggtgcaatcttggcttactgcaaagtctgcctcccacactcaaccgattctcatgcctcagcctcccaagtagctgggaatacaggtgtccgccactgcacctggctaatttttgtatttttagtagagacagggttttgccatgttggccaggctggtcttgaactcctggtctcaagtgatccactttcctcggcctcccaaagtgctgagattacaggcatgcaccactgcactggaccttagctacacattttaaatggcatatataagatttaactaaagaaaggtaaagaagatgctgtctaatgatccttttcagttctcaaagcctgcaattaaatcaatcaaaattcaaatctgacaatgggggccagacatggtggctcatgcctgtaatcccagcactttgggaggccgaggcgggtagatcactggaggtcaggaattcgagaccagcctggtcaacatggtgaagccctgtctctagtaaaaataaaaaacttagctgagcatggtggcacacgcctgtggtcccagctactcaggaggctgaggaacaagaatcgcttgaaaccaggaggcagaggctggaatgagccaagattgtgccactgcactccagcctgggtgacagagacagaccctgtctcaaaaaaaaaaaaaaaaaaaaatctgacactggggaatatgcaaaaagaaattactcatctgatagtcctgtggtttctatgtataaggggcttaaggaagatgtctgcctgggaggactacaactgtgtttgtacaagagtattagtgagaacatcaactgcctacatcagtgaagccagaatgcttaagttgcactgaacatccccatgttttcacacctatgtggacaccaatattttttctttctgtatctgtctccttcccagtctcactcactgctttatccttgtgcctagcatatggatggtaaacaaatagtaaaacaaattacttgtttcagggcagtaaaatttagttcatctacagtttttaaaacatactttgagggcctggcgtggctgctcacgcctgtaataccagcactttgggaggccgaggcgggtggatcacctgaggtcaggagttggagaccagcctggccaacataatgaaaccccatctctataaaaatacaaaaatcagctgggtgtggtggcgggcacctataatcccagctacctgggaggctgaaacaggagaatcacttgaacacgggaagcggaggctgcagtgagccaagaccacgccattgcattccagcctgggcaacaagagtgaaactctgtttcaaaaaaataaatgggctgggtgcagtggctcacacctgtaatcccagcactttgggaggctgaggtgggcggatcacgaggtcaagagattaagaccatcctggccaacatggtgaaaccccatctctactaaaaatacaaaaattagccaggcatggtggcacgcacctgtagtccgagctactcaggaggctgaagccaggagaatcgcttgaaccggggaggcagaggctgcagtgagctgagatcatgccactgcactccagcctggtggacagagcgagactctgtctcaagaaaataaaataaaaaacacattttatatttgaaacacgctgggcgcggtggctcacgcctgtaatcccagcactttgggaggccgaggcaggcggatcacaaggtcaggagatcgagaccatccttgctaacacggtgaaaccctgtctctactaaaaatataaaaaattagctggacgtggtggtgggtgcctgtagtcccagctactcgggaggctgaggcaggagaatggcgtgaaccctggaggcagaggttgcagtgagccgagattgtgccactgcactccagcctgggcaacagaacaagactccatcttaaaaaaaagaaaaagaaaaagaaaaagaaacttaccaaagagcctttcctagcctaaagagggagctctgtaaatgagggcctatgaagaatgttgacactaaggtctcttccagaacttacattccaggagtaggttagttcagggatagttaactacatttatataatgctttacagaacttctctcaaattacactattacaggttttctttattttaacaccagtgcacaagactctatatttatcccagttaaatgtcaactagctggattctggcctgtcaagatatatccgattctaatttcatcactgaactttgctatcccagctttgtggcatccttcttcagcctgccaagagtgatggtcatctctctggcatggaggccagcagcaggcctcaagagaagtggaagaaaatgtgggagaagagcctgcaaactcagtaaagtctcagtgaagaagcaaaggaaggaaaaatcagacagattgcagaaagattcccccttagagaagggggtgacagggtgccagcaactactaccctagggaatactgataaacaacatgtcagatagatgcagtgatctgtctgtgatcctatgggaggatcttcagtgtgttaagttacaaaagcaaagggcagaagcatatttaaagcaggattcttttgaacatttttggaaggatatggtggcttcgtttatagtggtttcccctggggagagacagacagaggctgaactgaaagattttaattcccatcagactagcccctgcaacagaaatatctcagcagagaggaaccttgactcagatcctcctaggacttaattctttcaacccaaccaactaaaaaagcactggtttgtgtagcttaggcattctgaacatttaaatgttctatggtgaagatctgtttttccaaagagtccccattcaaattcatttactctttggtcacccacaatgccacagcggtaggtactcccacaaggctcaccctcgcagacaccctggctgaggcaggttactctccttgctttgtaaataaacaagtcagaaggcaactaactggccagtatgtatttccaataccagaagcagtggtaggccaacaggcaaaatttaacagtttacatggtatcttaaaatgacattttacatgggatgcaataattttaggatgcaatgagccaactgctgtcttagtacatcaaaaaccacttcacaaaatgagatagctacataatggcaacataaaccaaatatggactggattactatgggtacgtgtccctttttggagcatgacccccagaagcctctccagacacacacgggtgtgtgtggatgggaactgttttcagttcaagctcaatctacaccttcacagttttactttcccccctctttccttaatgattaatattgactaacatgtagaaggctgtttcacctgggctgtgtgtaagactcacctgggaaggaataccaaagctccatctccaccactcagagctttggatttaacatccagcagaaatatgtttaaggctgcaggccattctcacatgcagcctaggtagagaagcactgattaagatcttgaccatctttctcctacaattctaatgctcaaggtctctacacctgtttcaaacaccgcctcagagacactttgagggaacatgtttacgttttctgtgtattgagctatgacacatttcacagcttacaaacttggagctgcttttttgatatagctggggggaattacttagggctcaagaaaatttttatgtcaccaaactattcagccattcctcttctgaatcaagatgtcttaagtgctcagcccatcctcagatattacaaacagcaatacccttccaactctcacatttgaatatttctaaaaagttcaaatggtagctccctgagctcacaatccagcagagaaaatgaacagctacagtaccctgggaagagtgtcattataagaggaaccccaaagaggcacagaggaagaactcctaactgacaaatcagggagagcttccagagacagcgtcatttccacagataccagaaggctcagtaggagtcagtgagtaaagaggggtgagaggagaatgtgttttggcaaggacacaaagggagcggcagcagagttgagcaggtgttgggctgggaagaacaggaaagagcacgtggggatcagtcttttcatgccagaggaaacacgaaaccactccctgaaggactttaagcagatgctcatccttggagatcatgttgcctgtgtgctggagaatggatcacaggagggcaagactagaagtagaaggacaaagctagcatgaccatcaaggtggggagggatggcatagtttagggaaacggtagtcatgatgacagtggcagaacgatgccaaaagtaaacaggagaaagggacaacaggatggggaaaacacatcccaggctcctggctggacactggacaagatacacatctggggagaaagggaaccccatttatgaacactgtgtttgaggaacctgctgaccatttcctggccttcttcagtaggcagctgtcacaatggcagcaacagctcacaaggacacagtgctttacagtagtcccttcttatccgtggtttttttcacactgttacctatagtctgaaaatattaaatgtaagaccccagaaataaacaattcataagttttaaattgcataccattctgcagagtgatgaaatcttgcaccagcccacccaggacgtgaattatccctcctctgcccagcatatccacgctgtagacattgccagcccattagtcacttagtagcggtcagttaccaggttgactgttgcagcatcacagagtttgtgttcaagtaacccttaatttacttaataatggccccaaagtccaacagtagtgatgctggcatattgttattattgttctgttttattattagttatcattgttaatctcttactgtgcttaacataaattcagctttatcatacatatgtatgcatagggaaaaaaagtgtataaagggttcagaacaatctgcagtttcaggcatcctctgggggtcttagaacatattccccatgggtaaatcgggactactgtattatgtaacagttattgtttaatgctttacatttattaactcaaaaacctcacaactaccttgtgagataagaagtataccttttatccttattttatagatgaagatatagaagcacaaaaaagctacaaacattgccctaaatcacacagccagtaagtgcctgagtccacattcagtgccttcagtttggcctcagtctgtgctcttaaccaggacctgctactgcctcacacacacacagcagtgaaactgcgaaaacactcggatggcttgggaacatcaagcttatgggaatacataacatcaccagcagcatgtcctgaatgaaaaagcagaggggctcaagacagattccaagctcatgcacaagagccgcccatggggcagtgggtgtgggcagagaggaaggagaaaccctgggaaactgtggaaccaaaaacagtagagaaaggaccctcaggaggcagtaaagtgcagcatcaaatgcggctggacatcacagaagatgcgtgtggtgtgatgggctttatctcacctagctcatcgcatcttattttttgagacggagtctcggtctgttacccaggctggagagtagtgacatgattttggctcactgcaacctctgcctcccgggttcaagagattctcccgcctcagcctcctgactagctgggactacaggtgcgtaccaacacgcccggctaatactgtatttttagtagagacgaggtttcaccatgttggccaggctggtctcgaactcctgatctcaggtgatccacccgcctcggcctcccaaagtggtgggattacaggtgtgagccaccatgctcggcctgattttattttttacagcaaagattagccaactgcagcctgcttttgtatggctaaactaaaagtctttttcatatttttagaaggttaaaaaatgtaagaatatgggacagagacagaatgtggcccttacaaaaaagcctgcaggatggcttgtaaccttggcaaaaacagattcaggggaaaaaatggggacaaaagccagactgcaggttactgtggaacataaaaataatgaagcactaaagcagctctttcatgacatccagctatgagacaagagcttcgtggggacaagagcgggggaagaagtttgctggttgtacagatggaagagaggtgagcattgcccaacacaaacaggaagaaacaacaagacagaaggatgaaaatacaggaaagggaggctatgactgaacgaggctcccttatagggaagaaggataccagatccagaacatagacaagaaaggacacctacttttgaggtaacaggaaggcaggaaagggtggctgcagacaaacatctaagtctgcagccatataggtgagaaacatcccagttatggcttcagttttctccaagtcatctgctggttgcaaggcaggagtggcaggatcagggatttaaggaacaggctgaagtctcgaaatgtctgtagtgaaggcagtgtgtgctgactcagtgtttgctctacagaatgcacagcagcctcaaagacccagtcagtgttagagaccacaaaccagacttgcattcacgtggctgcccaccacaagccacaagcattttccagataatggaacatatcaactctgatggacattacaaatcctgatggacattagaaactctgatggacacctaaaatatcttgttgctttcttgccctttgaaaagaacatatttagatagtggttaagcacaggcattggaatcagacctgggttagaactcaagctttgtcacttactagccatgtaacttttgctgaaggaattagaatattaacctcagtgacccatggtagaaaacaggatatcactatctgcctcagttatcatgaggattaaattaaaccagatttataaaatacagtagtctagtgagtggcaagagaaacggctcagtaaatgataactacatcatcatcattattatgagcagcagcagtattttgctacctcaacatgactggtgctggcttagcttagtggcagaatgaagcccggacagatgtcagggcactcccacctccatacaacttccactgtgtcactaaccaagtgaccctggcaggatcccctggatatcaagtttccagtctgcagaatgaggggactggactgcactacacagttcccaaggcttttcccgtctgcatctagggctaacagtgctctgcactgtgaaaataggaactttcaagcaagcacgttcctcgatgtactactttgtggtcaaaaagacttgagtctgaatcctgttcttattgaatgaagatgagttctttaacacttttgagactcggtttcctcatctagaaaagagtaagcgaatcgcaacgaatggtagtgtgatgatttaacacagagcactcagggaggagccgctggctatccctcctctgccgcacctcccagggtaaacgtggggaccagcaccgctcccgggcagacccgcgagcggcccgcacgacgcccgacctgagcctttgctcaaagcagggggccagtccttatgtttctgaacacaaacaaatggagaacaaactgggaccttattaaaaaggcaggctttgggggtgttactgcattgaaaagccctatttaggcttggccctgagaaatttttctcttgggtcacgcatgttcacggtcctcccaggcgaagccgccctggggacgaaaaccgatcacagaggcaaactcaggggcgaataaggaccgcaggacgccaaggaggggcgtggagctgtgggatccgcgcggcccttgggttgccctgcctgcagcgggaatttgtgtgcctcctcgcgggcactgagcggggcgtcccagggggcgttggcttccacccccaccattccccagccggccccgccggtaacgggcttcggcgacggcacccaagcgggtcctcaggagcggccgccgcgcccgggacgccgcagccccagcccaggtgggaggtcggaaatcggcgcggccagctgggcagcggctcagcggggctgggggcgcggggtcaagcctggcagtccggcccggcggaggcgcggctgacagggcagccccccagcccgccgggcctcacctggaagtgctcctgaaagcgaacagggaggatctgcgccatggctggtgcgggacctcggcggcggcggcggcagcggcaggaatgaacgccgacccctcgcgcgggctgaccggtggcgacggcgcaggcgcagtgccccgagctcccggtcctggcccccgccctcctccctgaccgcgccccggcccgcaccccctttccccgccccttcccccgcccctgccccgcccctgccccgcctctgccccgcccctgcccccgcccctgcccccgcccctgcccccgcctctgccccgtcccgcctgcgcggatccctccgcccgctccgagggtccgcggaaagtagtcccgcgcgccctctgccctgacgcggtgtgtgccagctacccgagtgaaaggttttcgggggattaatcctgatggggtctgcggcggcccttgcccagcgccttccacatgtggagcgggccagtggtgctagttctgccgccaactctggacggttgagttcagggccactttttactcaggcacggatgtgacagaaagatggaaaagggtcttggaagaaccacatgtgccgtataacgaacgaccttttggtctgaggaggaccgtgtatatgacggtggtcccataacatgataacggagctggaaacttcctgtcctctggtgagggcttagctaaggacatttcctctcctgtatttggagatacacgtacaggtatgtcattaccgtgccaggggaataacgcacctcacacgcggtgcgggtttgcggcctagcagcagcggaccgcatcagctgcctagttgtgtagtggctgtgccatctgagtttgtgtaagttaccttgtgatgatcccacaaccgagacgcatgtctcagaatgcatggatgcatgggacgcgtgactgtacgtgttacagacgtgtttcggcgtgaggctcggcccctgctcctttaggaaacacctttcctggctcatgcggtttctagagaacactgtgtcggaatatcaatgtagagagtcagcgaaggtcatctagcagcagatgaccagccccaggccagtgaggatcacccagagtgcccgtggctgcacgacagtagtagcaggtggaagctggagcccacacctggtttgcccagcagccagttgtttttccgaggcaccgttggctgatgttttgcatacagatgattcagctgcataaaagatgtctgtcaggaaagggaagcccttggcattcagcacaggcactccctacggggtaatcgatagccgtctctgctgcttcccatgttgctcactggtaattttaagaaatgaacggcccaccttgaataagacaaggatggtgcaattatttgcgcaatggcttgaccatctagtagccaaaaatatgttaaggaatagaacagactgttcactttcaaattaaatctcttttccagtattagccaagacctctgcagcccgccctttctaaaatccatgtggcctcatccgctaaatatagagctgggttttgctgtggttagtactacatttcccaaatctctttattttggcaatgatgcctgtgactccaagtaccctttaccccaaacattatataaattttttagtaattaataccatcactccctaaatcaccttccccagggctttttggggattaaaactaaaattttataccctaaaagaaagaatttaagaaaatcatagttaagcaaagtgacaggattgttaatacgtcgggacctcaagtggggattaagtttcaacattaattttagaggagacacaaatctttctgtctcttcaaaccatagaagagacagaaagcacaacagttatttgaatagacagaagtgaatataagtgatagttgtagttaacaggaaataaagttgttaatatacttgtaaaaaaattaaatgttctgacttgaaagggactttaatattctcaccacttgtaggtaacttgctaagtaaccctaaaaaaacctttcaattcttttttttttttttttttttttgagacaagagtctcgctctgtcgcccaggctggtgtgcagtggcacgatctctgctcactgcaacctctgcctctcaggttccagccattctcctgcctcagcctcccaagtagctgggactacaggcgcacgccaccgcacctggctaatttttcatttttagtagagacagggtctcaccatgttgaccaggctggtctcaaactcctggcctcaggtgatccatccacctcggccttccaaagtgctgggattacaggtgtgagccaccgcgcctggcccgggattaagtttcaacattaattttgaaggggacacaaaccttcaaaccacagaagagagagaaagtgcatcagttatttaaacaaagggaactgaatataaacaatagttaacaggaagtaaatttaaaataataaaaagaaaatcccaagatatggagttacaaacataggacacagctaccacccctagagctcaaagatgaaagagaagctggaattattacagcttaaaggaagggcttgcagagctggaattcagatctctgaggaggtgtgttgaccagctggggctggggtcattgagcccagaggagagatcccatggggatgggactcagacctctgaggagggtccctacgggacttagacacacactatggatgaggggtggctgtggagctgggagtaagccctctaaagagggcactgggagactctcacccagatctctaaggagaaggcatactgaggctggttctgcaagtcttggaaaaacttaaactggattcagcttctgtgggaagaatgtgctgctgccttgttgaagaagcctagctggggtgatgctcacaggaagtggccctgtggtctccctctatcaacctatcagcttagtctaatagggaatattagatcagatcttctttatttgccaatgagaaatatgttttttagagtctcagccctggcatcagaagcagtgtctagaggtgggaagggagaatagagctgaaagacattatttaataactggtacaagaaacgacatgttatagctaaattccaattcccatgggactttcctataggtggaattgaaaagtctgtggaggcgtataatcgcagcgctttgggaggctgaggtaggaggattgcttgagcccaggagttcaagaccagcctggtcaaccccatctcttcaaaaaaatttaaaaattaacagggcatggtgatgcatgtctataggcctagttgggaggctgcaacaggaggatcacttgagcccatgagctcaaggttacagtaagctatgatcgtaccactatactccagcctgggcaacagagaaagaccctgtctttaaaaaagaaaaagtcactggaggactttagttttcagacagcttcagagaactaaaaaggcagtgaataattatgaggccaatatcagagagaaaggacatgagagaggtgagtggtttatggctgctttttcttgaaaggcatctgccaattccagatgaatgtttgagacactaggactctgagcagcacttttaacactctcattgccctaggacgacaaaatttggaggcttggtaccaccaaggaggtatcccactgtactgttttgggaccacaagttgtttgggactccattcaaatcatgtcagtccttgccagcagcaaatgtaaatcttccctgggaatgataacctcatccatggtctcaaattacttctacaattgttcatatgcagtgttcaacactgaatcaaaaataagtaggcatccaaggagaaaagacaaaatggttgcaaaaaacaagagcaagcctggacaacatagtgacaccctgtttctaaaaaactaataataataataattagctgagcatgcacctccagagtctgaggcaggaggatggcttgagcccaggaggtcaaggctgcagtgagccaagatcacactgctgcactctagcctcggtgatagaatgaggccctgtatctgaaacaaaaacaagaacagtaacagacaagtgagctctaggggatcaaaaaatggagttttcacaaagacttttaaataattatgcttaatatggttaagaggataaaagacaaggttaagaattttatcacaagcctgtaaattataaagaaccaaatggaaattctagaactgaaattgtgaaaattcaccagatagtgttagcatattacacacctctgaaaagagaaagctagtgatggtagagttaagtcagaagagtatatctaaattaaagcacagagataaaaggacagaaaataaagcatatgaataaattagatatagaggatacatgtagaggtctaacatacaggtaactgaagtcctagaagtatagagaaagagacagaagcaatatctaaagagataatggcttagggtttgaaaattaatgaaggatatcaatcttcagtttccagaaacattacagattttaattggaatgtgtaaattaaggcaaaatacacttaggcatatcataatgaaatagctcaaaactagggaaaaaaaacttaaaagaagccagagggaaaacaatggattactttctagggagagataattaagcttaactactgacttctcaaacaatgaagcagaataatcgtatcttcaaagtggtcaaataaaataatgaggttgaaactggaaaagttcccttgtcccccttgcagggcatgcgatgggggtgtagcgcgcttcttcagtgccccactgctcaaacctcgaggggagcgtatggacggacaggctgtagggctccaaccccacaacagtgtctaggagtgaatatttacagctcctgaagccccagtgggcgtgtgttacagggtgatcttttagttttgccgtctataggcgacttgtgttaaccagctcaattagtgcctctacttgtcgcatggacagagggctttctgtatcccgggttctcgccttggtgtaccagaagaatcagatcacatctgagcttggagaatgggtgcaaggttttattgagtggaagtagctcttagcagaagctgaaagggaagtcagaaggggatggagtgggaaggattttccctggaattgcactgctcaccagccctgggctctcctccaactgccccagccaaactccacgttgttcagcttcaccagcatgctggttcctgtcagtgccttcctctggatgtccagctacctgtgtgtcgctcccctcccctcaacgtccagccacctgtgtgtctgccagctagggtctctggggtttttataggcacaggatgggggcacggcaggccagggtggtcttgagaaatacaacatttgggcagaaaatgcctgtcctcacctaggtccgtggggggtggagccctagccaggggccacgccctcctctacccagcgcttcccttccccttttccatagcatttaaagggaccacatccttctctacccagcacttccatgtcaacattaggctgggcgtggtgactaacgcctataatcccagcactctgggaggccaaggtgggcagatcacttgaggtcaggagttcgagaccagcctggccaacatggcgaaaccccatctgtgctaaaaccccgtctctactaaaaatacaaaaattacctgggcatggtggcgcatgcctgtagccccagctactcaggaggctgaggcaggagaattgcttgaacccgggaggcggaggttgcagtgagctgagatggcactacttcactccagcctgggcaacacagagtgagactctgtctcaaaaaagaaaagggaagggaaaggaagggagaaaggaagggagggagggaagaagggaaaggaaaggaagaagagaagaagggaatggaagggaaaataaagaaaataatgacattggcagacaaacaagatctgagaaaatttgttaccaaaagatctaaactaaaggaaatactaatgggtttttatcaggtcaaaataaaatgttctcaagtggaagctcagagatatagaatggataaaattcaacaaaaagtatatattggtaaatctaaatgaaagttaactgcatgacacaaaaataataaagccttctgggattaaaaatatgtcagaatttaggccgggcgcggtggctcaggcctgtaatcccagcactttgggaggccgaggccggtggatcacgaggtcaggagatcgagaccatcctggctaacatggtgaaaccccgtctctactaaaaatacaaaaaattagccgggcgtggtggcaggcgcctgtagtcccagctactcgggaggctgaggcaggagaatggcgtgaaccccagaggcagagcttgcagtgagccaagatcgtgccactgcactttagtctgggcaacagagtgaaactctgtctcaaaaaaaaaaaaaaagtcagaatttaaatatataaaatctatagtaagtcagaactggggtaatccaggcatcatctgagaaaggggtataaaaaaggttagatttgtagttgattgaataattggtcccaagtcttaaggccttgtaagagttctattcctctgcactcttgccatggctttgtagtggattgagggtgcttcttcaccccttggttccaggtttcaccctgtgccttgcttcagctcattggatgttagaagtgtgatatgagcagaaatttaactgtcccacattgtttggattgcactcttgcacttctgttgtgtccgtgagtacaatttgtcccccctagccattgccttttgagcttggagctcaggatggcatgtataaagtagatctcagcccagtctgcatcttggatgcaagattagctaagattggccaaactccaactgaaccactgacctgtgagtgagaaaaaataagtaaatgagattataaactacagagatgttgaggttgtttgttatgtgaaaataagaaattcaaaatcaaagtggttggaactttaaattattttgaaccttaaagaaatgtggttatgaggcccaagtcatacaacaggcagctgtaacctaggcagctgtaacctttgttcctctaattatggattagctttttctttacctacattgttttataaaatgttgtaaaagactaaaggatgccagagaagaccctttctctcttaactgttgatcttcattatagattagcttccttctttcttctcttacacaatgacctcacaactatcacattgtctaaaataaaatgttaaatattctcttatactcctttaaattgggaaagaaaacaagctataactaataaagttgcagtaactcataaactacccttgtatgaaaaatgtaattctgttaaatttctttgtttgctgcctatataagtaagaccataacctttcagcttgggatcactgaccccattcctttggggtctgtatttccggatattcatcctcaactttgtgcttgcataaactcttaaactggattctgatgctttaaattatttcaggttgacatactagtgacccagatgggacctgaagttagcttctgccactgactcctgctgttttgctaacagataggtggtaccagtacagactgttgctggagtttatgggagccctaagtgagacccctcttgcattttgaatctccctggcttagatgagattcgtatattgttcaaatgacctgattccatactcaatggggctggaattaaagttctactttaaatctttaaggtaggagtttcatttcttatctctcgagagattctgttgtttgcaggtttacggtttcattcttttttaaggttaaggttttgtttgccttacttgctaaagtttgcaaccttttctctcatgcaaaatctggttaaaggaaaagcagtttccctttaataagatatgaatttctgtggcttaagcaaaattgtgaccttaaactagccaggttttgaagctcagttcaatttggcacatttaaattctttttttgagtgaccaaaaatttataaaagacctttattggctgggcacagtggctcactcctgtaatcttagcactttgggaggccgacgctggaggatcacttgagaccaggagttcgagaccagcatgggcaacatagtgagaccctgtctctgcaaaaaaataaaataaataaaaataaaaaaaaaataattaattaaaaaaaaatctttatgagaatgtgataagtcctgaaggcaacgtacactgttcatcctgaccaaaaggcaccttaggtgactgaggtcttgtaggagtgccagagattatcacttgtgatgagaaatggtcacacaggggatccccaaagaagaacatacagggaaatttgcttaaattcagtaaatatatataaggtactgatgtcccagtgccttaagctcccagaatttctgggtttcactgagacacataagaggaaagaactgatccaagggtaacacacgggggagctattcccataaataatacatttgatccaaaacatctttccctttcacttaagaggagaatacaaattataggcgatcagctatctaaaatagagtcctccttgtggagaggtccatctttagagactccagctggatacctgtacagtacttacggttttacttcttgtcattatttagaaaaattgtctcttgaagaactcacgaagaaccaaaattgcaatggccaaagtagggtactttgaaatgcctaaactaaattatttgtgtgctcaattagaaaaatccggttctggccgggcaccgtggctcacgcctgtaatcccagcactttgggaggccgaggcgggcggatcacctgaggtcaggagttcgggaccagcataaccaacatgcagaaaccccatctctactaaaaataaaaaaaaattagccgggtgcggtggcacatgcctttattcccagctactcaggaggctgaggcaggagaatcgcttgaacccaggaggcggagcttgcggtgagctgagattaggcgtcattgcactccagcctgggcaacaacagcgaaactccgtctcaaaaaaaagaaaataaaaaagaaaaagaaaaatcgggttctaggataaaatagaataattgggagatttatttttagaggtatttagaagcatccagaagaggttctgataaagttacttcactgcaggaggaaaataaaagattgcctaaaggctgggcacggtggctcacgcctgtaatcccagcactttgggaggccgaggcaggcggatcacaaggtcaggagatcaagaccatcctggctaacacggtgaaacccccatctctactaaaaaaatacaaaaaaaaaaaaaaaaaaattagctggacgtggtggcaggcgcctgtagtcccagctactcgggaggctgaggcaggagaatggcgtgaacatcggaggaggagcttgcagtgagccgagatcgcaccactgcactccagcctgggcgacagagcaagactccatctcaaaaaaaaaaaccaaacaaacaaaaggtagtcaactggcataaaatataaccatatatacaaaatccagagtcagttatgttatactttgaaagatgtaaaaagacttttagacaatattcaggcttatgtgaggtgagtgatgctaatcataaaaatgatactttcctgggctgggtgccgtggctcacacctgtaatgccagcactttgggaggccgaggtgggtggatcacctgaggtcaggagttcgagaccagcctgaccaatatggtaaaacctcgtctctactaaaaatacaaaaattagccaggcgtggtggcatgcacctgtaatcccagctacttgggaggctgaggcagaagaatcacttgaacccaggaggtggaggttgcagtgagccaagttgcgccattgcctccaccctaggcgacagagggagactctatctcaaaaaaagaaaaagaaaagatactttcctcaactccaactttatgaatgttctagataaagaattcactctaatagtaaagagacagtgccttagttgggccacttctcaaacccatgatttgattaatcttgctgacgggtcgttgtgtactttaaagaagaaaaagataaagaggccataccaaagaataaagtgagtaaagttatgaatttgcaactaaaacaagtatccaccaagtgtagacagtcaaaataccccaataaacctttgaacaggtctaatccttcaatctgtaataactacaataaaactggccactttccaaaaaagattactgaaaactaaaacagaaggaatgacaacagatgaaggaggaaaatacggaatagaggtgctccaagaaatttaaagggagctttccttttctgcttactaatattctgggaaaaatagaatttatttatttatttatttatttgagaggagtcttcgctctgtctcccagggagtgcagtggtgtaatctcgggctactgcaacctccacttcctgggttcaagcaattctactgactcagcctcctgagtagctgggattacaagcatgtgccaccatgtccagctaatttttgtatttttcgtagaggtgggttttcaccatgttggtcaggctgatctcaaactcatggcctcatgatcggtttgccttagcctctcaaagtgctgtgattacaggtgtgagccaccatgcccggcctcaatagaaattattttaagtaaagaacaataccaagtccttgttgatactgagcaacattatctgtaataaatctaaccttatcacaaagtcggggtaaacatttctgagggtaaacactcggtctaaatggtaggtgtcacaaatacttccatatcagcacacaagtctcaccctgcaacttctcaactaggtatcttacaagggaatcatgttttccttttggttccatcagcccccatccatctgataggaagagacttcttaaaactatataatgcctatatttctttctcccagaagtgggaaatatatttagaattagatggtatggatgacacaacagaattaacagacacaagcaaaaaatttttaaaaatttaatccagttactatccatctcaccattgaggacactgaattattaagcaatgaagaattagaaaacctactaaaggtagtacttgattgattgtggtcaaagtccttcactgatacagaaactattgtttcagctacttcaataacatctcataatattcatcaaaaccccttccaaatatcagatactatcccacgataaccttaggaggggtaaaacctatgatttcagattatataaaaagaggactgatcaggctgggcacggtggctcacacctgtaatcccagcactttgggaggctgaggcaggcagttagtctgaggtcaggagtttgagaccagcctggccaatgtggcaaaaccccatctctactaaaaatacaaaaaaaaaaaaaattagccaggtgtggtggcatacacctgtagtcccagctacttgggaggctaaggcaggagaatcacttgaacccgggatgcagagattgcagtgagccaagattgcgccactgcactccagcctagtgacagagtgagactccacctaaaaaaaaaagaaaaaagaaagaaaaagaaagaaagaaaaaaaaggactgatcattctctatacaagccctcataatacaccaattccccgttaagaaaaccaaatggtagaggatggagacttgtacagaatttgatagcaataaacgacataattccacagcatccggtagtgcctaatcctcacacattgctcatatctattccattgaatgcagaatttattattttgtgtgtgcgtgtatcggagtctcgctttgttgccaggctggagtgcagtggtgtgatctcggctcactgcaacctctgcttcttgggttcaagtgattctcctgcctcagcctcctgagtagctgggactacagacatgcgccatcatgcccagctaatttttgtatttttagtagggatggtttcagcatgttggccaggatggtcttgatctcttgacctcgtgatctgcctgccttggcctcctaaattgctgggattacaggtgtgagccaccatgaatgcagaactttttacagtcatagatttatgcagtgcattctttagcattcctatagataaaactggccaatttctctttgcctttacttgggaagacagacaatatacttggacattcatgctccaggatacactgaaagcctcacttacttttcacaaacattaataaaagacctctcagatgataacttcattgagaagcctgtctatttttttttttgagacagtcttgctctgttgcccaggctggattgcagtgtcacaatcatagctcactgtagccttgaactcccaggctcaagtgatcctcccacctcagcctccagagtacctgggactacacaatacaagccaccatgcctggctaatttctggttgtcctttttttttttttttttttttttttgtagagacagggtttgccttgttgcccagactggtctcaagaaaactcctgggttcaagtaatctgcctgccttggcctcccaaaattctgggattataggcataggattataagcataccacagctttttttttttttttttttttttggagacagggtctcactctgtcgcctagactggagtgcagtggcgctattacgtatcactgtagcttcggcctcctgggctcaagtgatcctcccactcaggctcccaagtagctggggccagaggcatgcacccccatgcacggctactttttttaactttttgtagagatgcgctcttactatgttgcccaggctggtctcaaactcctgactgatcctgagtcatcctcccgccttggcctcccaaagtcaaagtgttggacttacaggcatgagccaccatgcctggctgagaagcctgtctgaatacaatacatagatgatttacgtctttgcttagataacaaataggcttccacagtagatggaatacacctgttacaattggccctaatggatcataaagtgtctaaagaaaaacttcaattttgtaaaaacaaaacaaaaaaaccaaaacaactacttaggccacctaatatccaaggaatgactttctattaatcccgatagattgaatgcaattgtagctgttctgacactgagaaccaagaaacagttaatgttttagggactagcagaattttgtagaaattatactctaaacttttctttaaaagctctgcccttacatgctctcttaagataagacatgccagactctctagattggacagaagaaattcaactaatattagaaatgatcaaaaataggttgggcgtggttgttcactcctgtaatcccagcactttgggaggccgaggtgggcagattgcttgaggtcaggagtttgagaccagtctggccaatgtgatgaaaccctgtctctactaaaaagtacaaaaattagtggggtgtggtggcacactcctgtagtcccaactacttaggaggctgaggcacaagaatcacttgaacctcaaagatggaggttgtagtgagccaagatcataccactgtactccagcctgggcaacacagtgagactctgtctcaaaaaaaaaaaaaaaaaaagaaaagaaaagaaaggagaaatgatcaaaaatgaccttgctaacactccagctttggggcatccaaattataacatttcattatttgtgtatgaaagtggtggaaacaacactttaggggtcctaacccaaaaaaagagttcaaaatagacctatagggtattagagccaacaattagacactgtagcaaaaggactcccaccttgtatgagagccataacagccaccatttgttcattagggcaactgaagaaattgtcatgggaacaccccttactatcttcatcccttattctgtggaggtattgctatactcacgccatacttaacattattcagttagtagactggcttcatatgagatgttgcttattttagcttctcatatcatcatctctagtgtaacgatgtaagccctgcattcttttgccttcatttttacatgaaatgccacacaactgcatagctctaagtgatcaacatttttcttctaggtcagacctccaagagactccctttatgaatactgatgctatttggttcacagatggatgttacttgaaggatgaatcttgaatctaccaagcaggttgcactataatgtctttaagtgaggaaatagaaagtgcctattttctgaaagccatctcagctcaataaaaggaattaatagcattgaataggcctgtcaattggcaaaaagaatatgtgctaatatttatacagacagtagacatacttttggagtagcccatgatttggaaatgttatagaagcaaagagtgttcgtaacctcttaaggccaatccataaaaaacaaacttcttatttcatgactactagaaaaaatccctggccattattaaaattttgggtcattccaaatcagatactccagaaagcagaggatatcagctagctgataagtagcaaatagagctgctctaaacacatctaaacaagagaaccaacctgtgttaacttttaaggaaggacctgaatttgacataaaattagctcaattcagagccctaaaatcagaacaaaaagattgggaaacaaaagggggggaatagattccccaaaagatgaggtatggtatgggccaaacaagttgcccgtactttctgctgaattttagttgttattattattttttttgagacagagtttcactcttcttgcccaggctggagtgcagtgatgtgatctcggctcactacgacctcttcctcctgggcttcagcaattctcattcctcagcctcccagtgaatggagttttgctcttgttgcccaggctggagtgcagtggcgcagtcttggctcactgcaacctccacctctcaggtcaagcaattctcctgcctcagccaccacacctggctaatttttctgtatttttagcagagacagggttttcatcatgttggccaggctgatctcgaactcctgacctcaggtgatccacccgccttggtctcccaaagtgctgggattacaagcatgagccactgcgccctgtcatttccacattttttaggtatttcttacaagcagcaccccactcctcacgttaatctcatctagaaatgcccttacatacacagccagaataacgtttaatcaaatatctgggcactgtgtgacccagtcaagcaagttgacacataaccatcataaatatcaaagtatttgtggaaatattttaaaaactgctacaacatgtatattggcctggtgtggtggctcacacctgtaattccagcactttgggaggccaaggcaggcggatcacctgaggtcagaagttcaagacgagcatagccaacagggtgaaaccctgtcttgactaaaaatacaagaagaagattagccagccatggtagtgcacgcctgtagtcccagctactcagaaggttgaggcacaagaatcgcttgaacctggaaggcggatgttgcagtgagctgagatcgcaccactgcactccatcctgggcaacagagtgagactctctctcaaaaaaacccaacactgctacaacatgtgtataggtttccttgtgatatatttatatttacaaaatacatacttacaaatatatacatctgtatttactaaaacgtgattttttaaagacagaatctcactcacattgcccaggccggagtgtagttgcatgatcatggctaactgcagcctcaacttcccaggttcaggtgatcatctcacctcggcctcccaagtagcagagacaataagcatgcaccactacacctgactaattttttaattttttgtagagacagggttttgccatgttgcccaggctggtttcgagctcctgggctcaagccatctacctgccacagcctcccaatgcgctgtgattacagccatgagccaccacactcagcctcaaaagtattttaataagagagactagaaaatatcttcatggaacagttaaccataagaaatgacccaacgagccagacatggttgttcatgcctgtttattgatttggtatcctgctactttgctggattcacttcttagttgtaaccactgtgtatgcatgtgtgtgtgtgtgtgtatgtgcgtgtgtgtaatccttgatttaagattgtgtcatctgtgaacacagatcatcttttttcctttccaatttgcatgccttatatttctttttcttgtctaactgctgtggctagagattccttcctatgtagaatagaagtggcaagagtaggcatccttgtcttcttcctgattttagtggaaaagcttgccattattgtgttgaggcaattttcttctattactagtttgttgagtgttttatcataaaagactgttgaattttatcaaatgctttttctgcatcattgagataatcatgtagtttttcccattcattctgttaatgtcatgttttgggtgaagtaatctgtttacgcctgttaggtttaattggggtttattgtgttaagtcctctgtttctttagttaccgtctcatctgattgctctatacctatcattgaaatttggcagttgaaggccgggcgtggtggctcacgcctgtaatcctagcactttgggaggtgaaagcgggtggatcacgaggccagaagatcgagaccatcctagctaacatggtgaaaccccatctctactaaaaatacaaaaaattagccaggcatggtggtgtgtgcctgtagtcccagctactggggaggctgaggcaggagaatggcatgaacccgagaggcggagcttgaagtgagctgagatcgtgccactgcactccagcctgggcagcagagtgagactctgtctcaaaaaaaaaaaaaaaaaaaaagaaagttggcgattgaagtctctaacaattattgcagaactatctttttcccttcatttctgtccatttttgcttcatatatattgagggtttgctattaggtgtgtaaatctatatgattcttatatcttattgatatattgaaccgtttgttaatatataatattcttatcttttgtaatctttttaatttaaagtttattatatctgatattagcatagccagtccagctgtcctgtatttaatatttgtataggatatctttttcaatccttttacttttaacctatttgcatctttaatggaaagtgaacatctcttataggcagcctgtatttaaatcatgtgtttctagccaggcatgttggctcacgcctgtaatcccagcactttgggaggcctaggcgggtggatcacttgaggccaagagtttgagaccagcgtggccaacatggcaaaagcacattggtactaaaaatataaacattagctgggcgtggtgacacgcaccttcagtctgagctactcaggaggctgaggcatgagaatcgcttgaatctggaaggcagagtttgcagtgagtggaaatcatgccactgccagccagcctgggcaacagagctagactctgtctcaaaaaataaataaataaataaataaaataaaaatcatgtgtttcgattcttctgctaatctctcatttaactgggaattttaattcttggtattttgctatttgttttctatatgccctacagttgttgtttttttttttttttgtacctcatttccttcattactatcttctttgtttagtttattttaaatagtgaaccattttgattcccttctcatttcctttttttgcttttttgagacagagtctcactctgtagtccagtctggagtgcaatggcacaatcttggcttattgcaacctccacctcccaggttcaagtgattctcatgcctcagccccctgagtagctgggattacaggcgtgtgccaccacacccggctaatttatatattttttagtagagacagggtttcgccatgttggccaggctggtctcaaactcctggcctcaagtgatctgcctgccttggcctcccaaagtgctgggattgcaggcgtgagccactgtgctggcttctttttccccacctttttttggagacggagtcttgtactgtcgcccaggctggagtgcagtgatgtgctcttggctcactgcaacttccacctccagggttcaagcgattctcctgcctcagcctcctgagtagctgggactacaggtgcccaccgccatgcctggctaattttttgtattttagtagagaccaggttttgctgtgttgtccaggctggtcttgaacgcctgagctcaggcaatccacctgcctcggcctaccaaagtgctgggattacaggcgtgagccacgacgcccaggcttttttttgttttttttttgagacagtttctgtcacccaggctggagtgcaatggcatgatcatggctcactgcagcctcagtcttcctcagtctccttgaggtgatcctcctacctcagcctcctgagtagctaggactatagacatgcaccactacacctgattaatttttgtacttcttgtagaaacagggtttcacgttgttgcccaggctgttctcagactcctgggctcaaggaatctgcctgtttcagtctcccaaagtgttgagattacaggcatgaacgactgtgtctggccttcatttccttttgtctacaatttatagattttttgagataaccatgggaatttattttaacatcctaaatttgaatacaattttaacttcaatactgtataaaactctgcttctgacagggcgtggtggctcacgcctgtaatcccagcactttgggaggccgaggcgggtggatcctgaggtcaagagattgagaccatcctggccaacatggtgaaaccctgtctctactaaaacatacaaaaatttgctgggcatggtgacacacgcctgtagtcccagctactcgggagactgaggcaggagaacagcttgaacccgggagacggaggttgcagtgagcggagattgtgccactgcactccagcctgggagacagggcaagactccgtctcaaaaagcaaaaaacaaaaaacaaaacaaaacaaaaaaactctgcttctatacagctcattcctcctactttcttttattgatgttacaaattacatctttatatattgtgtgctcagtaacattgactaataattgtatttatgcatttgtctcagaaatcatgtagaaaataaaaagtggagttattaaccataattataataattacccatgtatttacctttaccacagatatttatttctttttactttttatttatttatttatttatttatttttgagacaggttctcgctctgtcacccaggccagagtacagtggcaccatcatagctcactgcagcctcaacctcccaggttcaagtgatccgatcctcccacctcagcctcttgagtagctgggactacaggtgcatgggaaccacacccagctcattttttttgtatattttgtagagacaaggttttgccatggtgctcaggctggtctcaatctcctgagctcaagcagtccactcacctaggccactcaaagtgctgggattacaggcatgagccaccatgtcttccctgtttatttctttatacagctttgagttgctgtgtagtattccttcatttctgtatggacttcctctgtcatttcttgcaggacagctctggtgttaataaattcactcagattttagttatctgggaatatctcaatttctggatcacttgaggtcaggagttcaaaaccagcctggtcaacatgataaaaccccgtttctactaaaaatactaaagttagctgggtgtggtggcatgcaactgtagtcccagctacttgggaggctgaggcaggagaactgtttgaactggaaggcagaggttgcagtgaaccgagatcacgccactaaactccagcctgggtgacagagtgagactctgtctcaaaaaaaaaaaaaaaaaaaaaaggccgggcacagtggcttcatgcctgtaatcccagcactttgggaggctgagagagctgatcacgaggtcaggagatccagaccatcctggctaacgtgccgggtgtggtggcgggcacatgtagtcccagctactcgggaggctgaggcaggagaatggcgtgaaccgggaaggcggagcttgcagtgagctgagatggtgtcactgcactccagcctggatgacacagcgagactcctctgtctcaaaaaaaaaaaaaaagttaaccttcttacttagcaattctgtttcaaagcaagctgaaagatggaaataaatatcagaacataaatcaatgaaaatagaggccgagtgcagtggctcatgactgtaatccctgcactttggggggctgaggtggatggatcacttgaggtcaggagttcgagaacagcctggccaacatggtcaaagcctgtttctactaaaaatacaaaaattagccggccatggtggtgtgtgcctgtagtcccagctacttgggaggctgaggcaggagaatgacttgaacccgggaggcagaggttgcagtgagcagagatcatgccactgtactccagcctggaggacagagtgagactccatctcaaaaaaaaaaaaaaaaaaaaaagaaagaaaattgaaagcagaaaagatttagaaaattaaactaaaagctagttctaaaagatcaataaaatcgacaagcttctagcatgactgacaaagggaaaaagagtgaagaaaaaattaataggagttatcagtacagagcgtgcagacatcaaaaagataaggaaatactacaaacacctgtacaaacataatttgacaagtgagatgaaatggacaaattcctcaaggcaaagcaagacaaaacaaactcccactacccatctataatgaaatagataatccaattaatcatataactattaaagacattgaatttgtagttaaataatttttgaaatagaaatccacatccccagatggtttcactggataattctatcaaatgcttagataattaacaccaattctatataatctcttccagaaaacggaaagcaaatcacttccaaatttattttaaagttaagaaaaaatagtacatgctgggcctggtggctcacacctgtaatcccagcagtttgggaggctgacgtgggcagatcacttgagctgaggaatttgagaccagtgtgggcaacatggtgaaacaatgtctgtacaaaaaacaaaaattatccaggcatggtggcatgcacctgtagtcccagctacttgggaggttaatgtgggaagattgcttagacctgggagacagaggtttcagtgagctgagatcacaccactgctctccagactgggtgacagagtgagactctgtcttaaaaaaaaaaaaaaaaaagaagaagaaaaaggaaaaggaaaacaatacaaagaaagaaaactatagaccaacatgagtcatgaatatatgtgcaaaaattcttaacaagatatcataaatggaattcagcgatatataaaaataattatacaccattaccaagtggagtttatcccagaaatgtaaggctggttcaatgttcaaataccaatcaatgtgatccaccatattaacaagctaagtaagaaaaatcacatgagattatcaattgaattctgcagaaaaggcatttgacaaagtccaacacccattcatgataaaaaccaccagaaaacttagagaggaatttcttcaactgaataaaaaatatttaaagaaaaatcatgtggctatcatattcaataaagactgaatgctttttctctaagatcaacaacaaggcactcattactactattcaacaaaacactgcaagttctagacagagtctcactctgtcacccagtctggagagcagtggtgtgatctcagctcaccgaagcctctgtctcccaggtctaagcaatcttcccacattaacctcccaagtagctgggactacaggtgcatgccaccatgcctggataatttttgttttttgtacagacattgtttcaccatgttgcccacgctggtctcaaattcctcagctcaagtgatctgcccacgtcagcctcccaaactgctgggattacaggtgtgagccaccaggcccagcatgtactattttttcttaactttaaaataaatttggaagtgatttgctttctgttttctggaagagattatatagaattggtgttaattatctaagcatttgatagaattatccagtgaaaccatctggggatacagatttctatttcaataaggaaaaagaaatcaaaggtacaatagccaagatttggaatcaacctgtgtatcagcagacaaatggataaagaaaatgtgttatatatacatgatgaagtacttttcagccatgaaaaagaatgagatccagtcacttgcaacaacatagatgaaattggagaacattacgttaaatgaaatagggcaggcatagaaagacaaacttcaaatgctctcactcatttgcaggagctaaaactttaaataattgaactcatggagaatagaatggtggttaccagaggctgggaagagtagtagcattggggttggggggagtgggaatggttaatgggtacaaatttagttagaatgaataagatctagtatttgataatgcaacagggtaactacaatcaataatagtttattgtacatttaaaaataactaaaagaggccaggcgcggtggctcacgcctgtaatcccagcactttgggaggccaaggtgggcggatcacaaggtcaggagattgagaccatcttggctgacagggtgaaaccccatctctactaaagatgcaaaaaaaattagctgggcatggtggtgggtgcctgtagtcccagctacttgggaggctgaggcaggagaatggcatgaacctgggaggtggagcttgcagtgagccaagattgtgccactgcactccagcctgggtgacagagcgagacttcatctcaaaagaattaaaaaaaaaaagagtataactgaaatatttgtaacacatagaaatgataaatgcttgaggtgatgatggatatcccatttactctgatgtgattattacacattgaatgcctgtatcaacataaatatatggaccccataaatatatacaccttctatgtcctcataaaaattaaaaataattaagtttaaaaaagagtctaggcacggtggctcatgcctgtaatcccagcaccttgggaggctgaggctggcggatcacaaggtcaggagttcaagaccagcctggccaacatggcaaaatcctgtctatactaaacataccaaaattagctgggcatggtggcaggtgcctgtaatcccagctacttgggaggctgaggcaggagaatcgcttgaacctgggaggcggaagttgcagtgagctgagattatgccattgcactccagcctgggcaacaagagcaagactctgtctcaaaaaaaataataataataataattaaaaggcatactaatcagaaaagaagaaaaatttgtccctattttgagatgacgtgatttaactatatggaaagcccaaaggaataaaacaacaaaaacaaacaaaaaactcctaaaaaactaataagtgaatttagcaaggttgcaggatatatcaacatatcaaaattaattgtatttctatatactagcaaggaacacgtgggcactgaaattaaaatataatactatttataattgctccacaaaaatactttggtgtgaatctgccaatacaggtgcggaacttacatgatgaaaactagacaatgctgatgaaagaaatcaaacaagatctaaataaatggaaaggcatagcatgttcatggactagaagactcaattgtaaggacacccgttttccccaaatggtacacagttttaacacaattactatcaaaatccaagcaactttgttgttgttgttgtagatgcagacaaacttatactaaaatttgtttggaaacatacaagccctagaatagctaaaaagttttgaaacagttctgaggtgggaattaaagaaagaaagaaaaataaaattaaaaagagaaaaatatgttcaaaaaaacaagctttctgtattaggctggctcatcccaaagtcagtaacaggcaaagcccagacccaggcaaagtctcgataacattatctaagaagccagggctcaaaggaatgtgctctggagactctcccagcactccctccacataaggagaagaaaaacaaattttccttattttcctttcccctatggtatgagtacatttatgactttatagattcccgttttcttttcttttgttttctttttctttttttttgagatgaagtctcgctctgtcacccaggctggagtgcagtggtgcaatctcagctcactgcaagctccgcctcctgagttcacgccattctcctgcctcagcctcctgactagctgggactataggcgcccgccaccatgcctggctaattttttgtatttttagtagagacggggtttcaccttgttagccaggatggtctcgatctcgtgaccttgtgatccacctgcctcagcctcccaaggtgctgggattacaggcgtgagccactgcgcctggccagattcctgttttctgtaactagtaacctcaagtattctgttttttatccgagcagcacagcaaaggtcatgagacatgcctgagcaggcataatctaactgtcatagtttgattaactgcctttgttctgcttctatacacttgctttcacaccactacacttcgcatcactgtaaccttgtttcaaactagccaaccccttttcagaagtgtgtataaaagtcaagttctgtctttgttctaggcccggtctttggatgttaatccactaggccagagtgcactcaataacatccccctgttctacctattggtctctccagtctcctgattcccacaacagttccactggatctttcactgtctttgtagttttaccttttatagaatgtcacttaggtggggcgtggtggctcatgcctgtaattacagcattttgggaggctgaggcgggtggatcatttgaggtcaggagttcgagaccatcctggccaacacggtgaaaccccgtctctactaaaaatacaaaaattagccaggtgtggtggtatgcatctgtaatcccagctattcaggaggctgaggcaggagaattgcttgagcctgggaggtggaggttgcgataagcagagatcatgccactgcactccagtctgggtgacagagtgagaccctgtctcaaaaaaaaaaaacaaaaaacaacaaattgtcacttagttggaatcatacagtatgtagccttttcaaattggcttctttcacttagcaatatccatctaaggtcttccatgtcttttcatggcttggtagctcatttcttttcttttcttttttatttttctttgagatggagtctcggtctgtcgcccaggctggagtgtagtggcacgatctcagctcactgcaacctcaacctcctgggttcaggcaattctcttacctcagcctcgcaagtagctgggattacaggcacgcaccaccacacccagctgatttttgtatttttagtagagaaggggtttcaccatgttggccaggctggtcttgaattcctgacctcaggtgatctgcctgtcttgacctcccacagtgctgggattacaggcatgagccaccgtgcccggcctgagccactgcccccagccggctcatttcttatcattgaataatattccaatgtatgaatgtgtcagtttgttcattcaccaattgaggggatatcttgatttcttccagtttttgcagttttgaataaagctgctataaacattcatgtgtaggtttttatgtgtatataagttttcaactaattttggtatatacctaggagtgaaattgctgggccatatggttaggctatgtttagcttggaaggcactactagatcatcttccaaagtggctgtattctcaagagcaatgaatgagaattcctgtttttctatgtccacatccttgtcagcatttgatactgtcaggtttttggattttagcctatctaataggtgtatagtggtttctcattgttgtttttgttatttatttatttatgtatttattttagagatgggttcttactctcttgcccaggctggagtacagtggtatgatcatggctcactgcagcctcaaactgctgggttcaagaggtcctcctgtttctgcctcctaagtagctggactacaggcatatgccaccatgcccagctaattctcattgtgttctgaatttgtaattccctaatgacatatgatgtagagcgtcttttcatatggttatagccatatgtatatcttctttggtgagctccgttcagatattttgtccatttttaaactggaatgcttattttcttatttttgcattttgggagttattcgtatatattggatacaaatcctttatcagaaaagttatttgcaaatattttctccaagtctgtgggttttcattctcttagcaatgatgttctcagagcagcagttaaaaatttctgtctagattcttttttttatgtttgcatgtgtaaaatgcaaaacttcctgagtagaagggactacaggtgcatttattagagcagtatttattgaaaagactaatatttttctattgaattgcctttgttccttcatcaaagatcagttgatttcatttgtttgggtttatttatgggttctctactccgttcctttaccaatgtcacactgtcttgattactgtagcttcatagtaagtctcaaagttgagtagtgtgagtactctggccctgcttgtcttcaatattgagtgggctattctgcatcttttgactttccatacaaactttagaatttgcttgtcaatatctgcaaaataacttgctggaatcgttattggaattaaattgaatctataattggtaagcgctaacacattaatgttgagtcttcctacccatgaacatggaacttatctccatttattaatttagattttttatttatttcatcagagttttgtagtttccctcatataaagcttgtatgtattttgttagatttatacctaagtattttgattatttggtgtttatgtaagaggtattaaattttcaatttcaaattccaattgttcagtgttggttaaagaaaagcaatcaacttttgtatgttaaccttatatcctgcaatgtaactataataacttactagttctcagagttttttgttgattctttgggattttgtacatagatagtcatgttatctgcaattttttatactttatttccttcttcctaatttttatacttttatttccttcttttgtcttattgtattagctaagacttctagtacaatattgaataggagtggtgacaagagacatccttgccttttccctgatattaggggaaaagcatataatttttcaccattaagtagtgtatgatgttagccatacatacatacatagtggaattattgtagatgttcttcatcaattgagaaagttcccttctattcctagtttgctgagagtttttatcatgaataggtgttagatttgtcaaatgcttcttctaaatgtattgatataatcatgattttcttttttaacttaattgatgtgattgattacaataacttatattcaaccattaaacaagtatgcatatctggaatacatcccatttggtcatgttgtatttttttcatacaatgttggatttgatttgctaatatttttatcatggataaaaggggcattactatcgggtaaaattcagcccccgatatttcacctgggtccttttctattttccctaagtgttggctggtctgagaaataaagggaaagagtacaaaagagaaattttaaagctgggtgtctgggggagacatcacatgtcggcaggttctgtgatgccccccaagccgcaaaaccagcaagtttttattagtgattttcaaaggggagggagtgtatgaatagggtgtgggtcacagagatcacgtgcttcacaaggtaataaaatatcacaaggcaaatggaggcagggtgagatcacaggaccaatgcgaaattaaaattgctaatgaagttttgggcatgcattgtcattgataacatttatcaggagacagggtttgagaaaagacaactggtctgaccaaaatttattaggcgggaatttcctcatcctaataagcctgggagcgctacgggagaccggggcttatttcatcccttatctatgcccataaaagacagacgtccccaaagcggccatttcagaggcctccccttagggatacattctctttctcagggatgctccttgctgggaaaaagaattcagtgatatttctcctatttgcttttgaaagaagagaaatatggctcagttccacccggcccacaggcagccagactttaagcttatctcccttgttccctgaacattgctgttatcctgttcttttttcaaggtgcccagatttcacattgtttaaacaatttgtgcagaaaacgcaatcatcacagggtcctgaggcgacattcatcctcagcttacaaagatgatgggattaagagattaaagtaaagacaggcataggaaatcacaagggtattgactggggaagtgataagtgtccatgaaatcttcataatttatgttcagagactgcagtaaagacaggtgtaagaaattacaaaagtattaatttggggaaccaataaatgtccatgaaatcttcacaatttatgttcttctgccatggctttagccggtccctccgttcagggtccctgacttcccgcaacacattacatcacagtggaaagtgagatagtaaaggaatattatgaagtactctatgctcaaagggggcatgatccctatgacaaagggatccattcttcgagaagacataacaggctgggcatggtggctcatacctgtaatcccaacatttggggaggccaaggcaggaggatcatttcagctcaggggttcgagaccagcctaggcagtgtagtgagatcccatctacaaaaaaaaatttaaattggcctggcatggttgtgcctgcctgtagtcccagtacttacgaggctgagctgggaggatcacttgagcttggagggtaaggctgcagtgagctgtggtcacaccactgcactccagcctgggtgacagagtaagactgtctcaaaaaaaggggaaaagacatgaaaattactatatttcactgaagatttatgaattgcaaataagcacatgaaaagatgttgaacatcattaggtattacggaaatgcaaactaaagttacacctgtcaacatggctaaaattaatagtgacaacaaatgctggtgagcatgtggaaaaacttgatcactcatccattgttggaatgtaaaatggtacagctttgtggaaaatactttgtcatcttgaaaaaaactgcacttgcagctaccataagacccagtagttgccctcttgggaattgcttccacaaaatcaaatgcttatgttcacacaaaaaatttaatatcagggcttaactgtaatcaccaaaaattgaaactagccctgatgtcctgagcagatgaatggttaaatcaacagtgcagcaaaaccatgaaatactcattagcaataaataaaaactaatgaagtaataatatacacaacaacttaaattaactccagataattattctgagtgaaaaaaaaatccagtaggttaggtaagcatgacattgacataacattgttgaaatcaggaaattacagaaatggaaaacagattggtggttagcatgggttaagaaagtggaatggtgaaagggaagtggtgtggccatacgtgagcaacacaaccccacttaggtagaatacacatcttctcaagtagacaaggaacattctccagggtacagcatatgctaggttgtaaatcaaaccttagtaaatgtaaaggatagaaataatacaaagtatttttaaaaacacaacggaatactattagatcaataacagaaagaaagtcgagaagttgggaaacccacaaaggtgtggaaatttaacagcacactctaaatgaccaatgggtcaaagaagaaatcaagagggaaattagaaaatactttgtgggccgggtgcagtggctcacgtctgtaatcccagcactttgggaggccgaggcgggtggatcacgaggtcaggagatcgagaccatcctggctaacacggtgaaactccatctctactaaaaatacaaaaaattagccgggcatggtggcgggcacctgtagtaccagctactcaggaggctgaggcaggagaatggcgtgaacccaggaggcagagcttgcagtgagccaagattgcaccactgcactccagcctgggtgacagagtgagactccatctcaaaagaaattttataaaaaaactttttaattaaaaattaaagaaatactattatatatagagaatgagggtttaaaaaaaaaagaagaaatactataaacaattgtagcttagatgaaatgaacaaggccgggtgtggtggctcacgcctataatcctagcactttgggaggccgaggcagatggattacctgaggtcaggagttcgagaccagcctggccaacatgatgaaactccgtgtctactaaaaaaaaaaaacaaaaaattagccagtcgtggtggcaggcgcctgtaatcctagctacttgagaggctgaggcaggagaatcacttgaacctgggaggcagaggttgtagtgagccaagatcacaccactgtactccagcctaggcaagaagaatgaaactctgtttaaaaagaaagaaagaaagaaagacagacagacagacggaaagaaatgaatgaacaaatttctagacagacacaagcttccataactgactcagaagaaacagacaatccaaatatgcctataataacaaataatgagattgctttagtaataaaaaaaaactacccaaaaaaactgcgggcccaaatggctttactattgaattccaccaaatattttttttaaataccaattcttcacaaactcctcaaagaaaaatagaaaaggagggaatacttcccaactcattcacggattctataaggcaacatcaccctgacaccaaaaccaaagacctaacaagaaaagaactctttagacaatatattttataaatgtggacccacgaaaaccctgaaaaatacaatgacatgtaaaagtattgtataccatagccaagtgggatttatctcaggaaggaacagatggttcagcataaaaagtcaattaggctgggtgcagtggtcacacctgtaaccccagccctttgggaggctgtggcaggaggatcacttgagcccaggagttcgagaccagcctgggcaacatggtgagacctcacctctacaaaaaaaatcacattagcttggcgtggtggcacaagcctgtagtctctgctgcttgagaggctgagcaggaggatcatttgagcccaggaggtcgaggcggcaactgagccatggttgcaccattgcactccagcccaggtgacagagcaagaccctgtctttaaaaaaaaaaatcagccagccacggtggctcatgcctgtattcccaacactttgggaggctgaggcgggtggatcacctgaggtcaggagtttgagaccagcctggtcaacatggtgaaaccccgtctctactaaaataaatacaaaattcagccgggcatggtggtgagtacctgtagttccagctacttgggaggctgagacaggagaattgcttgaacccaggaggcagaggatgcagtgagctgagatagcatcactgtactccagcctgagtgacagagcaagacaacatctcaaaaaaaaaatcaattaagtagaattagaagggaacttcttcaacctaataaaggacatctgtgaaaagcacacaattaaatataatacttaatggtgaaagactggatgctttcctcctgaaatcagtattaagacaaggatgcccactcttggcacttctattcaacattgtactaaagggtttggccacagcaattaggcaagaaaaaaaaaaggcatccaggtaggaaaagaagtaatactatctctattcacagatgacatgatcttatgtaaagaaaattctaaagagtccaaaaaaaactattagaactaataaatgagttcagcaagattgcaggatataagatcaatatacaaaaatcaatgtatttttatacacttgtaatgaaatggaagtgaaattttaaaaacacttccttagccaggtgtgatatgtggacttggtagtcccagctacttgggaggctgaggtaggaggattgctggagctcaggagttctagacgagcctggacaacatagcaagattccatcttttgaaaaaaccaaacagctccacttacaatagcatcaaaaagaataaaatacttgggaatgaattttacaaaagaactataaaacttatattctggaaacttcaaaacattgttggaagaaatgaaagaaaacctaactaaatggatagatgtttatgttcattgattggaagacctgatactgttaagatagcaatctcctcagattaatctatagatcatcacaacccctagaactgcagctgatttctttctagaaattgacaaattgaccctaaaatttataaggagactcaggggccccagaatagcaaaaacaaccttgaaaagaacaattacattggaggactcacacttccttatttcaaaactttctataaagcaacagtaatcaagacagtgtagcatagacatatttcaacacaatacaactgagagtccagaaacgacccaagtgtctctggtctcctgattttcaacaagggtgccaagaccattcaatggggtaaaaatagtctttcaacaaatgatgctgggacatctggatggacacacgcaaaataatgacattgaactcttcacataatatacaaaactttactcaaaatggatcagagtattcaatgtaaaagctaacattatgaaactcttaatagaaacataagggtgaatgtgtatgaacttggatgtggtagtggtttcttaaatatgagatcaacagtgtgagcaacaaaagaaaacatttgagatagggccttagtctgtcacccaggatggagtacagtggtgccatcacagttcactgcagactcaacttccggggctcaagtgatccccccagcttagcctccctagtagctgaaaccacaggtgtgtaccacgattctggctaattcttttattttttgtagagatggggtcccactatgttgtccaggctggtctcaaactcctgggctcaagtgatccacctgccacagcctcccaaagtgttgggattacaggcacgagccatggcacccagctgataaggaatattttttatgcagaatagataaaaactctcacaaactcaatgataaagacaatccaattgaaaagttggcaaaggatctgaaaaataagacacacaagtgactaatatgcacatgagaggttgagcaacatatcagtcactagggaaatacaaatcaaaaccactctgagatatcatgttatacccactaggatgcctttacttaaaacaacctgataggctgaatgtggtggctcacacctgtaatcccagcactttggttggccaaagcaggaggactgcttgagcccaggagttcaagatcagcctgggcaacagcgagacccccgtctccataaaaaagtataaatatacatacatacatacttggtaataggaaatgttggcaaagatgtggaaaaattggaaatctcatacactgctgatatgaatataaaatggagcagccacactggaaggcagaatggtagtttgttaaacagttagttatagagtgatcatacggctcagcaattccactcctaggtctatatattatatatccgagagaaatgaaaacacatttccacataaaaacttgtacgctgatgtttatagtaccattatgcataattgccaaaaggtggaaacaatccaaatgtccatcaacagatgaacaggtaagcaaaatgatgcatacaatggaatattatttggtcataaaaagaagtggaatagtgatacatgctacaacatggatgaaacttgaaaatattatgctaagtgaaagcagccagacaagagcaatattctgtgattcaatttatatgaaatgttctgaataagcaaatctatagagacggaaagcaggttgatggttgcctcagaatgatggggatcggggatagggcatgataaagtgtatggggtttcttactgaggtgatgaaaagattctaataatggctgtggttaaagtgtatggggtttcttactgaggtgatgaaaagattctaataatggctgtggtgatggctgcacatatgatgtgactacactgaaaatcattagattgtaaatcgcatgctgttaactatttcagtaaagccgtttttttttttttaagcaaaacatgagccatccttttctttttttttgagagtctcgctctgttgcccaggctggagtgcaatggcatggtctcggcgcactgcaacctctgcctcctgggttcaagtgattctcctgcctcagcctcccaagtagctgggattgcaggtgcgtgccgccatgcctggctaattttttgtatttttagtacagacagggtttcaccattttggccaggctggtctcgaactcctgacttcaagtaatccgccggtcttggcctcccaaagtgctgggattgcaggcgtgagccactgtgcctggccataatcttttcttttttgagatggaatcttgctctgtcacccaggctggagtccagtggcacaatctcagctcactgcaacctctgcttcccaggttcaagcgattctcctgcctcagccacctgagtagctaagactacaggcacctgccatcacacctggctaatttttttttttttttttttttttttgtagttttagtagaggcagggtttcaccatgttggccaggctggtctcgaactcctggcctcaagtgatccacctgccttggcctcctaaaagtgctgggattacaggcgtgagccattgcacctgtcctgagccatcctcctgaggaaaacgtactccatcttgagaaaaaccaacagacgtaggaatagagtacctaggttatagagcaagtatatgtttaattctatgaggaacgatcacactgtttatcaaagtaactattcttcctaccagcaatgcatgagagttccagttgctccacatcctcactaatacacattattgtctttttaaaaaatgtaagccattctaatagatatgtgttgttactgttatttcttttgctgtacagaagctttttagtttgtctaatttgtctacttttttgttgtatttgcttttgagtccttagtcataaattctttctttctttctttttatttttttattttttttgagacagagtctcactctttcgcccaggccggagtgcagtggcgctatcttggctcacttcaagctccgcctccctggttcacgccactctcctgcctcagcctcccgagtagctgggactacaggcacccaccactgcgccaggctaattttttgtatttttagtagggacggggtttcaccgtgttagccaggatggtctagatctcctgacctcatgatccgcccgcctcagcctcccaaagtgctgggattacaggcgtgagccaccgcgcccagctttttaaattttttttgagacagtctcgcactgtcacccaggctgaagtgcagtgacgcgatctcagctcactgcaacctgtctcctgggttcaagcgattctcatgcctcagcctcctgagtagctggaattacaggtgtgtaccaccatgactggctaattttttgtttttgaggcggagtttcactcttgttgcccaggctggaatgcagtggtgcaatcttggctcactgcaacctctgcctcccaggttcaagtgattctcctgcctcagcctcccaagtatctgggatgacagccatgtgccaccatgcctggctaattttgtattttagtagagaggaggttttactatgttggtcaggaaacagtgtgatcattttgggtcttgcttttattttttggtaggtggatctgaagcagtgctgccttagtctccttggactctcagctccatttcctcagctcaagtagtccactgggctctacctcagttctgcctcctcttgctgtggcctagaaattctctctggatatcagaaaacaaaggacagtaatccctgccaagatgggatacaaacaaggtgagccccatgattgcccaagcgtactacctggagtgtcttcttctgtttttttctttttcttttttttcttcaagatgggatcttcctgtgttgcccaggctggagtgcagtgccatgatcatggctaattgcagccttgaactcctggcctcaaatggtcctcccacctcagcctcccatgtagctaggtctccaagcgcatgctactgtgcccagcatggtatccagtgtcttgaaaccaccattgcatgtatttttgacgggctcctttggttgtttcaggtagaagggtcaacctggtccctgttactccatcttgtctgtaagttgaaggccttgatgttttctgcttatctcttcatcatctccaaacggtggtggtaaagtcactcacgactgctgtttccttcaagggaggaaacgtgcgaagactttgcccacacaatctcaatttgtcctcataacgttgcagatttttttttttttttttttttttgagacggagtcttgctctgttgccgaggctggagtgcagtggcgcgatcttggctcactgcaacctctgcctcccgggttcaagcaattctcctgcctcagcctcccgagtagctgggattacaggtgtgtgccaccacacccagctaatttttgtatttttagtagagacgggggtttcatcatgttggtcaggctggctcgaactcctgacctcgtgatctgcccaccttggcctcccagagtgctgggattataggtgtgagccactgtgcccgaccccagtgcagatttttttagtctcaatctctatttgacagctaaaaaactgaggcccagatgtttgctggtttggagcccagacaggcctgttggcatatattgcttcctggagctccacaaagctcgcaatgtcttgctgcatagttgctaagggagctgcctcacctgcacagcaagtctctggctcttcattccttaagagtcccacttgcagcctggctttttatgtgtacacacacacacactcacacaaactatcctggctttatttggcatgaacacatgcctgggtctcatccagccacttgacatccgagtgagacatggagtggaatggctgctaggccagagatcagtggtcagttaccccggcctctgactccaagtccaaggctccttctccaggctcagacccacacactgggtggtggtgacaaagatcaggacccaggagtgggtggtactcagccctcactgtgcttaaagattctgtgattctgtttcttctcctgtagatcaacgtctggatcactttctaataaaattccaactttgctgataattctccaatatacccaagactgtaaatactgatttcctttcatgaaattgtccaaacagctgcagcccttggtgcacagtatgatctggacctggggcacagcaagaccagaaccatgaaccaccatgaaccatgactcctcacttgtgagatgacgtgtgcaaggtgacctatggtgcttcatgaccacagaagtgaccactctacactgtgaaatgaatttctgcatggggggtatattagggttctctacagggacagaactaatagatatatatgaaagtttattaagtattaacttacacaatcacaaggtcccacaataggccatctgcaagctgaggagcaaggagagccagttcgagtcccaaaattgaagaacttgggagtccgatgtttgagggcaggaagcatccagcacgggagaaagatgtaggctgggaggctaagcaagtctcatctcttcacatttttctgcctgctttatattcgttggcagctgattagatggtgcccacctgattaagagtgggtctgccttccccagcctgactcaaatgttaatctcctttggcaacaccctcacagacacatccaggatcaatattgcatccttcaatccaatcaagttgacacgcagtattaaccatgacaggggggaatgagatgacacaaaggatcccttctggctctcatgttctgtcaccatctacttcaggagagagatgcactgtgtggggaggatgaaagttagaaggaaaaggcaagagaaatcaggagggtttggtattcaatgcgtgttcatttattttacacttacaaaagaaatcgcccacccctttgccccattcccccaaaacagtctctttttacaaacatttaaaaattaaaaccaaatgaagatagacaagttaatttcagtacaattatttttcagtgtagctgtcataattagagtttaaatttcctacaagtgaccaatgtccaagtgacttatagggaaatcctgattatcggccaaaggaaattcaatattacaagttagcaaattctagtacaaaaatagtccgtgtgttggaacagctttccttttacataggtcttaggtcagtctgctgtaatacctaacgcttccggattctctctcacaaatggctcaatcgtcactgctgaagcagcatggtgcctgcagcagcaggggctagtgtccaccttggggccgtgctggagacggcaggcctgggactgccttgctggccccagggcacctgggcagagctccagccctagctccgcatcgggggcttggagggagggatgagcttccccctcctgaggcaatgtcagacccaggacacagggcacatctgcccagggagctgggctggcgctggtgcaggacagcacatctcctgccagtgtctcctccccctacagcctggtcaggtgagaggcggtcctgcatgtcatcagcggcgagagtgtggccctgcccttgctgcagccagggcaggctggggcaggctacttgtccctcaggatgtcgagctgttcctgacactcggtgaagaggcgctggaatcggaggttctgcccgatgactggtagcagctccttcagcagctccctcttccgcagaccctgtggacacagagtgacagctgagtgcaagtgtcagtgaagagacctagattgtggggactttcctggcctggcagagaaccttgtgtctgctcacgggagaaggaaagaacaattcctctgcaggtgagaaactgtgagagagctgtggggcaaatgtgcaggatgaagtggcaggtggaatgggagcaacacagtgtggggataaaggaggatgaggccaatgcagggtctgctcctccatccgtgggcacagccactgctgaccttatagtgactgagcagttccctgaccatccagggcaggatgagagtagaacaaggctgagggtcaggtggctggccattcaggaggggctgttccctcatgctgatgtttgccaggggtttgaggtcaagccccagggcaaggatgcacctggggggcagtgactggctttagttttccagcaacacaaatgaggtgccagtatcccctgatgtggaggatgttcggatgctgaccaaactatgcttagttgcctaaacatcctccacgtcaggtcatattggcaccacagtctgaaacaagcattgccagttggggtctctgctgcacagaccaaaagagcagactcctgagcagtacggctgctccaaagggaaaactaccagccagacaactttaacactggacgagaaggtctaagatcttgaattaacggtgacagatatacctgcaacaagtctagaagtgacagtaaagaataagtgtaactattaggtttgagtaacacagaagttgttagagatgggataagcaggagaatggctgctgttggcgaccaagtttgatggaggagcagcccacactccaacagggaggctctgacaccagagtgccatagtcagaacagagatggtatggatttgcaaaggctgaaatgtttactatctggtcctttacagaaaagtttgtcaactcctaaaatagatcatgttttctaactaaaataattgagtaaaactcataggtcaaaggggaattctaattaagtgaaattaaaaatgacttgcaagagaatggtaaaaaaaaaaaaccaacacaaaatactccaaaagtggtaagattcagcaaaagtgggcactttagaggcatttagaaacaacagcttatactgtattagagaacatgaaagaatgacaagccaagactccaacctaaagccatcaggggaaaggaaaaaaaaaaagactaaagaaaaaaaggacatgagaaaaaaacattttttttaaaaaaaggagataataaaaattgaaataaataaaatagaaaacaaagatttaatagagaagatttagaaaaacaattttattttatatatttttttgagacagggtctagctctgttgcccaggctggagcgtagtggtgcaatcacagctcgctgcagcctcaacctcccaggctcaagtgatcctcctgcctcagttacccgagtagctgggactataggtgtgtgccaccatgtctggctaatttttatatatttagtagagcggggtttcaccttgttggccaggctgatctcaaactcctgagctcaagtgatcttcctgccttgttctcccaaagtgctgggattaaaggcgtgagccactatgcctggcaaaagtcatttcttgaaaagactaatggacaaacgtctggcaggattaatcaagaaagagagagaaagcttaaagaaataatattagaaataaaaagagacataactacagatatagaagaaagaaaaagatatgattactatcaactttatgctaagaaatttgaacatttagagaaaatggagaaattcctagaaaaatataatttatcaaaactagctcaaaaagaaatagaaaggaaaagttaattattaccataaagaaaacatcaggaatactattttaaaactgacatcaaggatgagattttctttgtctttcctttcccacagtttgactaatgtgtctcagtgcaggttcctttgggattttcctacttagagttcactgaggctcttgtattagtagacccccgtctttcctcaaatttggaaaatttccgccagtatttcttcaaataagctctctactcctttctctctcttacacttctagaactcccattatggattcatgggtatacttggatggtgtctggtaagtctcttagactctgtttgcttttcttcattctattttctttttgctcctcatacttgataatttcaaatgacctgttttcaagtttgctgatttacccttttgtctattcgagtctgctgttgaacccttctagtgaacttttcaattcagttattgtatttttaaactccagatttctgtttagctctttttttggaatttctatctccttgttgatactctcattttctttttttttttcttgagatggagcctcgatctgtcgcccaggctggagtgcagtggtgtgatctcggctcactgcaagctccgcctcctgggttcacaccattctcctgcctcagcctcccgagtagctgggactacaggcgccggccagcacgcctggctaatttttttgtatttttagtagagatggggttccaccatgttagcaaggatggtctcgatctcctgaccttgtgatccgcccgccttggcctcccaaagtgctgggattacaggcatgagccactgcacccggccctcattttcttcatatatagttttcctgattttgtttagttgtctgtattctccttgagcattttttaagacatttattttaaagtcttatgtctgatgggcacagtggctcatgcctgtaatctcagcactttgggaggccaaggcgggcagatcgcttgaggccaggagttcgagaccagtctggccaacatggcgaaaccccatctccactaaaaatacaaaaattaggccaggcgcggtggctcacgcctataatcccagcactttgggaggctgaggcggctggatcacttgaggtcaggagttcgagaccagtctggccaacatggcgaaaccccatctccactaaaaatactaaaattagccagtcctgacctcaggtgatccacctgccttggcctcccaaagtgctgggattaaggcatgaaccaacgcacccggcagtccttttacttttaagccattgtgttattacatgtaagctgggtttcttataagcagcatacagctggttgttattaattctaatctgataatctatgccttttagacctatatttaatgattattgatatattagggtttaaatctaccatcctatgtatgtttttctgccttcttttgaatgaatgtattattttctatcattcaattttatctatttgttagttttttagctacgattctttttactgctttgggatttgtatgtgtatgtgcatgagttttattttttggttttggtggttgctctagggcatataacatacagtatatgcctttacttatcatagtctgtcttcaagtattatatcactttgcataatgtgtaaaaatcttttaatggtatactttcatatccccactcctggcgtctgtgatactgctgtcatgccacttcacttctacatatgttataattacaaactacattttcattatttggcttaaaaaggcagaactttttgactttttttttttttgagacagggtcttgcgctctgttgcccaggctggagtgcagtggcgtgatcttggctcactgcaacctctgcctctcaggttcaagcaattcttgtgtcttcgcctcctgagtagctgggactacaggcatgtgccaccacacccggctaatttttgtatttctagtagagatggggtttcgccacgttggccaggctggtcttgaactcctggcctcaagtgatctgtccacctcggcctcccaaagtgctgggattacaggcgtgagccaccgcgccgaacgagaacttttttacattttgacatttagatgaacacttttgacatttaattcttaaccctttggaggtatatttttatgaactgaagatctgcttttacttagttacatataaataaccagtttcctaaactccatttattgaatagccccccctatttttcccactgtatctgttttgtcttctctctcatatagcaaagtatctaaattactccggcttcataataaacccaaatatctggtagcatagtgaatgtcttaactattcttggctttttactgctccatataaattgttgaattagcttgtcaagtttcattgaaacctctagtgggcatttgattagagaggcattgagtcagtaggtctgtttagaaacggttggcgtcttttactgtactgcactttctcatcgtttgtccaggttttctttaatgactttaagtaaacgtttataattcttagcatataggctatgtacatcctttgttagatttattcttagatactttataattctcaaaagagacaatcttgaaagtggcaaaaaaaaagtgactcatgagagggatttgaagtttgtgaagaactacacgcacaattgctggcttaaagatggaggaggcaggtggaaagctaacaaggaaatgaattctgctattccaataacgactgagcttggaagaggaccttgaaccctaggtgatctcatctggccagtaatttgagtagagaattcaggaaccactgcaaaagcacaccaggaagaccgaaagaaatcacagatcctttgaaagaagtggcaggctgctgcaaattccacaagacaggtgaaaaactctggtgctctctcaaaagtgccatctcctggctggaggccaattaactcaggacattacagcaattcataacagaacaaccctgctccaaggaaggagaaaaacaacagctaattccactgcctgcaacatcctttctaaccagtggtcctgagtgtgtccacatgatgacttcactggtagcataaccagcatttgagaaagcctgcacactaaacatatctacaaacaaggactctcacagagtctacgccattcccctggcaccaccaccacagcaggtgctggtatccacagctgggagatctgaagatggatcacatcaccgggttctttgcagacgttccccagcatgggcccagagcctggtagccccactgggtggctagacccagaagggcaataataatcaccgcagtctggctcataggaatctccatccctaggggaaggggaagtgcaccaaatcaagggatcaccctgtgggacaaaataatctcaacagcagcctctgagttccagatttttccactgaactagtctacccaaatgagaagtaatcagaaaagtaattctggcaataatgacaaaacaaggttctataatacctccaaaagaccacactagctcctcagcaatggatccaaaccaagaataattacaaagtacattttcattatttggcttaaaaaggcagaactttttggctttttctttttcttttttttttgagacagggtctcgctctgttgtccaggctggagtgcagtggcgtgatctctgaattgccaaagaattcagaaggctgattattaagctactcaaggagataccaaaggtgaaaatcaacttcaagaaattttaaaaaatatataggatatggatgaaaaatgctccagagaaatcggtatcataaagaaaaaatcaaaaaatcaaaaatcaaaacttctggaaataaaagacacacttagagaaatacaaaatgcactagaaagtttcaacaatagaatcaaagaagtagaagagagaacttcagaattcaaagacaagactttgaatcagacaaaaacaaagaaaaaataattttttaaaaaaatgaacaaagcctccaagaaatttgggattatgttaaatggccaaacctaagagtaagaataaatggtgttcctaagaagagaaatctaaaagtctgaaaaacgtatttgtggggatagttgaggaaagcttccctgaccttgctagagatctagacatccaaatacaagaagctcaaagaacacctgggaaatttatcacaaaaagatcatcacccaggtacacagtcatcaggttatctaaagtcaagacaaaggaaagaatcttaagagctgtaaggcaaaagcatcaggtaacctatacacgaaagcctatcggatttttttttttgagacagagtcttgctttgtcatccaggctggagtgcagtggtgcaatcttggctcactgcaatctctgccgccctggttcacgcaattctcctgcctcagcctcccaagtagctgggactacaggcccctgccaccaggcctggataatttttgtatttttattagaggtggggtttcaccgtgttggccaggctggtcttgaactcctgaccttaaatgatccacccaccttggcctccctaagtgttgggattacacgaatgagccactgcgcctggccagaatacctatcagattaacagcagatttctcagcagataccctacaagccagaagggtttgggttcctatttttagcttcctcaaacaaactaactgccagccaagaatttagtatccagcaaaattaagtgtcatatatgaaggaggcataaagtctttttcagacaaatgctgagagaatttgccaccaccaagccagcactacaagaaatgctaaaaggagttctaaatcttgaaacaaaaccttgaaatacaccaaaatagaacttccttaaagcataaaactcacagggtctataaaacaataacaaaatgaaaaaaaaaaaaccaacaaaaaaagaaggtattcaggtaaaaacaagcatggtaaataaaacagtacctcacatctcgatactaacattgaatgtaaatagtctaaatgctccacttaaaagatacagaatggcagaatggatacaaatccaccaaccaaatatctgctaacacatatggactcacataagttgagggtaaaggggtgaaaaaagatattccatgcaaatacaaaccaaaagcgagcagaaatagctattcttatatcagacaaaacagactttaaagcaacaatagttgaaaaagacaaaaagggacattacataatgataaaaggatcagtccaacaggaaaatatcacaatcctaaatatatatgcacctagcacgggagctcccaaatttataaaacaattagtactcaacgtaagaaatgagatacacagcaacacagtaacagcggggacttcaacactagacaggtcatcaagacagaaaagcaacaaagaaacaatggacttacactataccctagaacaaatggacttaacacatatttacagaacattctacccaacaactgcagaatatacattcttttcatcagcacatggaacattctccaagaaagaccatatgataggccacaaaacaactctcaataaacttaagaaaatcgaaattatatcaagtaccctcttagaccacagtaaaataaaattggaaattaactccaaaaggaaccctcaaaactatacaaatacatggaaattaaaaaatatgctcctgaatgatctttgggtaaacaatgaaatcaagatggaaattaaaaagttttatgaactgaataatgacacagcttatcaaaacctctgggacacagcaaaagtggtgctaagaggaaagttgatagcattaaatgcttacatcaaaaagtatgaaagaggccaagcacggtggctcgtgtctgtaatcccagcaattttggaggccaaggcaggaggatcacttgaggtcaggagttcaagaccagcctggccaaaatgccaaaaccccgtctctatcaaaaatagaaaaaaattagctgggtgtggtgacgcatgcctgtagtcccagctacttgggaggctgaggcctgagaattgcttgaacctgggaggcagaggttgtagtgagccgagatgcaccactgcactccagcctgggcgacagagcgagactccgtctcaaaaaaaaaaaaaaaagatccaattaagctaaattagaaacaaaatgaaagatattacaactgataccacagaaatagaaaagatcattcaagactactatgaacacctttatgcacacaaactagaaaatctagaggaaatggataaattcctggaaatatataaccctcctagattcattcaggaaaaaatagaaactttgaacagaccaataataagtagcaagactgaaacagtaatttaaaaattgccaacaaaaaaacagtctgggaccagatggattcacagctgaattctattgaacattcaaagaagaatttgtaccaatcttactgaagctattacaaaagacagagaaagagggaatctccctaaatcactctatgaagccagtatcaccctaataccaaaaccaggaaaggacataacaaaaaatgaaatctacagaccaatatccctggtgaacatagatgcaaaaatcctcaacaaaatactacctaatcgaatcaaatggtgtatcaaaaagataatacaccatgatcaagtgggtttcataccagggatacagggaagacttaacgtacacatgtcaataaatgagatacatcacataaacagaattaaaaacaaaatcatatgatcatctcaatagatgccgaaaaagcatctgacaaaatctagcatgccttcgattaaagccctcaggaaaaccgtcatagaatggaaatacctcaaggtaataaaagccactatgacaaactcacagttgactttataccgaaaagggaaaagataaaagggttccccctgagaactctaacagacaaggatgcccactgtcaccactgctattcaacattgtactggaagtcctagccagagcaaacagacaagagaaagaaataaagggcatccaaatatgtaaaggggaagtcaaaatatcgctgtttgccaatgatatgatcgtatacctagaaaaccctaaagactcatccaaaaagctcctagatctaataaatgaattccgtaaactttcagggtacaaaatcaatgtacacaaatcagtaacactgctgtataccaacaatgaccaagctgagaatcaaatcaagaacctcttgttacaatagctgcaaataaaataaaataaaatacttcggaatatacctaaccaaggatgtgaaagatctctacaagaaaaactgaaaaactgattgctgaaagaaatcatagacaacacaaataaatggaaacacatctaaagctcatggtaggtaaaattaaaaatgaccatactgctaagagcaatctacagattcaatgcaattcccatcaaactaccatgattattcttcacagaactagaaaaaacaaccctaaaattcacaagaaaccacagcagggtgtggtggctcacgcctgtaattccagcactttgggaggctaaggtaggcagatcacttgagcccaggagttcgaaaccagtctgggcaacatggcgaaactctgtctctacaaaatatacaaaaatcagctgggtgtggtggctcacgtctgtaatcccagcactttgggaggctaaaatgggcagatcacttgagcccaggagttcgagaccagcctagacaacatggtgaaaccctatctttacaaaacatacaaaaattagccgggtgtgctggcacatgctgtagtcccagctactcaggaggctgaggtgcaggatcacttgagccttggaggcagagtttgccatgagccgagattgtgccactgcactccaacctgggtgacagagtgggaccctgtttcaaaaaaaaaaaaaaaaaaaaaaaatcatatggaacaaaagagcccaaatagccaaagcaagataaagctggaggcatcacattacccgacatcaaactatactacaaggatatagttaccaccaaaacagcatggtactggtataaaaataggcaaacagaccaatggaacagaatagagaacccagaaataaagccaaatacttacagccaacagatcttcaacaaagcaaacaaaaatacagagtggggaacaaacaccctattcaacaagtggtgctgggataactggcaagccacatatagaagaatgaagctggatcctcatctctcatcttatacaaatatcaattcaagatggatcaaagacttaaatctacgatctgaaaccacaacaattctagaagataacatcggaaaaactcttctagacattggcttaggcaaatagttcatgactacgaacccaaaagcaaatgcaacaaaaacaaggataaagagatggcacctaattaaacttaaaagcttctgcacagcaaaagaaataatcagcagagtaaacagacaacccacagagtgggagaaaatatttgcaaactatgcatctgacaaaggactaatatctggaatctacaaggaactcaaacaaatcagcaagataaaaacaaataaccccattaaaaagtggacaaagaacatgaatagacaattctcaaaagaagatatacaaatgaccaacaaacatatgaaaaaaatgctcaacatcactaattatcagggaaatgcaaatcaaaaccacaatgacataccaccttactcctgcaagaatggccataattaaaaaataaaaaaaatagatattagcatggaggtggtgaaaagggaacacttttacactgctggtgggaatgtaaactagtacaaccaccgtggaaaacagtatggggactcgttctggagatggagtctcactctgtcacccaggctggaatgcagtggcacgatctcggctcactggaacctctgcctcctgggttcaagtgattctcctgcctcagcctcctgagtagctgggactataggcatgcgccaccatggttggctaattttttgtatttttagtagagacagggtttcaccatgttggctgtgctggtcttgaactcctgacctcaggtgatctttccgcctcagcctcccaaagtgctgggattacaggcatgagccactgcacctggccagagattccttaaagaactaaaagtagaactaccatttgatccagcaatcccactactgtgtatctacccagaggaaaagaagtcattatgtgaacaatacacttgtacacacgtttatagcagcaccatttgcaactgcaaaaatacggaaccagtctaaatgcccatcaaccaatgagtggataaagaaaatgtggtatatatacaccatggaatactactcagccttaaaaaggaatgaaataatggcattcacagcaacctggatggagttggagaccattattctaagtgaagtaactcaggaatggaaaaccaaacattatatgttctcacttataagtaggagctaacctatgaggatgcaaaggtataacaatgatgtaatggactttggggactcagggggaagggtgaagagggtgagtgataaaagactacacattgggtacagtgtacactgctcaggtgatgggtgcactaaaatgtcaaaaaaagaaaaaaagcaactcatgtaaataggatattcaataagattatcagcatagtcagtgggatgacatattcaaaagaaagaaagaggccaggtgcagtggctcacacctgtaatcccagcactttgggaggctgaggtaggtggattgcttgagctcaggagtttgggaccagcctgggcaacacagcaaaatcccacctctaccaagaaaaaaaataaaaataaaaaatttgccaggcatggtggcgcacatctgtggtcccagctactcaggaggctgaggtgggaggcccacttgagcctgggaggtggaggttgaagtaagtcgagattacaccaatgtactccagcctgggtggcagagtcagactctgtctccaaaaatctacaacatcgtggaagttggaaaacacactgttattttaaatttcatgtatttttataaaaacagatggagttggttgggtgtggtggcttacacctgtaatcccaacactttgggagcctgagacgggtggattgattgagcctaggaatttgagaccagcctgggcaacatggagaaaaccccatctctacaaaagatacaacaattagttgggtgtggtggtgcacgcctgtaatcccagctactcgggaggcagaggcaggaggattgattgagccagaaggttgaggccacagtgaggggaaaaaaaaaaaagagagagagagagagagtcttgctatgttgctcaggctggtctcgaattcctgacctcaagtgatcttcccacctcagcttcccaaagtgctgggattacaggtgtgagccaccacgcctggctgaaaaaacacactattaaacaaagtgagacaaatgaaaatgaaaatacaacataccaaaacttacagtatgcagtgaaagctgatctcaaatcaataatctaacattacaccttaaggaactagaaaaagaactatacctaaagctagcagaagaaaataataaagataatgggacaagataaatggaaaataatagagataatcaatgaaaccaaaagttgattctttgaaaagatgaacaaaattgacaaacttttagctagactacataataaaaagagagacaagatccaaataatgaaaatcaaaaatgaaagcagggacattacaaccaatgccacaaaaataaaaaagattataaataagagaacagcatgaacaactatatgacaataaatctgataacctacataaaatggaaacaacttaccaagactggctcataaagaaattaaaaatctggacggatctctaatgagcaagaaaactgaatcaataaaacaaaccctctcataaagaaaagcctaggatcatatagcttctctgatgtattctaccaaacacttagagaattaacaccaatcctccttccaaaataggtaggaacacttcctatttcattctatgaggacagcattaccctgacaaagctagacaaagatactacaagaaaactattagatcaatatcctttgtaaacagtgacccaaaaatcctcaacaaaatgccagcaaacagaattccaaagtacattaaaagaattatacaccatgaccaagtgggatttattccttgaatgcaagaatggtttaacatatgaaaaccaatcactgtaatacatcacattaatgaaataaaagaaaattttaaaatgacacgatcatcttaatgcagaaaaagcatctgagaaaatgcaacattctttcttgataaaagcactcaacaaactaggaatggaagaaaactatctcgacatagtaaagaccataaataaaaagcccacagctaacatcgtacttaatggtaaaagactaaaagcttttcctttaatatcaggaacaagagaaggatgcctgcttccagcactaatatttaacgtagtattaagagtcctagacagatcaattaggcaaggagaagaaataaaaggcaaccaaattgggaaaaaagaagtaaaattatttctgttcacagatgacatgatcttatatatggaaaaccctaaagattcagcgaaaaactactataaacaaagcaaaacattctgcctgcctgtggtactaggaagaagctgcaagaggacttgccctctggcctgaaggcaatgtaaagagcagccaagtattattgatatttcctcacccttcggctctcagtaaaggatggtttttccactctttcaggatgcgatgtatagctctttgtacagcctgcaacacacaacttaatcaccacctctctggccactgccacaggtcttacagcagcagtccccaaccttttcggcacccaggactggtttttttttatggaccagtgggggaggggaagacggtttcaggataaaactgttccacctcagatcatcaggcattagattctcataaggagcacacaacctagatctctcatatgtgaagttcacaatagggtttgtgctcctatgagaatttaatgttgctgctgactggtctgtggcccagaggttggggacccctgtcttacactgaagaccacagcaaagggaggcttcctaagaacagggcctggctggggaggctggagccagaacaaagcccaggaacctgaaaggtgtttgcttagtgccccaaccttctgcttctcattttcctcccatgcacactgaaccatgcaaaggatccttgaagttgaaagaaatctgaacctttggtgtccctgtggtgcactggcagctcaaatcagagtatataaagagctcctataatatacatagagttcctacaaaccattgagaaaaacaaatggcaacaagtatttcaatagatagttcaaaaaagggaaacacaagcggctcttaagcatgtgaaatgatgctctcctaacaagccttcttgggagggctgctgagtcagcatggctggttggaagtccaccctccaaccacagctatattttcccagttatttgaaggatcagttccacttgaatgaccaattctcaccataaatgttgataaataaggccaggcacggtggctcacgcctgtaatcccagcactttgggaggctgaggtgggccactgcattccacactccagcctgggtgacagagagagacttcgtctcaaataaacacataaataaaataaaagagtgttgataaataaacccaagaagagcacagaaggctcatgctcactcatctcctctgccccaacatctagatgaaaagacagtaaacatacagaaaaaaaggaacaaattcagaatagtgttgagatcaggagaggacctggcagaagacactgggattggctatgtctacgtctgctctaaatcctcttctcttacatattctttgtacagagggagaaaacctgctcattttcccagcctcccttgcagcagaggtgggtgcccaagtgatttaatggttgcctgtgaggcacagactagtttctgggagagcgtttcttttctgatgagagggtgaatgttgctgttgccagatttctcctgttctctctccttccctgatcttggacatggaagccaccttgtaaccatgagggaagggctaggagacctttacagagggtggtaagcgggtggtacatactgacaggtgactctgggaggggaaccacagattctcttaggcagagcctcagtgaagtgtcctgtttggagttggtaagaataatcagcaggaaggaggggagaagaagaaatcatggccatcaaatggtagcctgtttgtggctccttctgtctataccaccacggcccagagtgcttactttcaggctgagaaagagaactactatggtgagctttggcgggcatcttgggctaaggctgacagaatgaagctccacaacctgcccatgagggggactcactgggcaggtttctgcctgcctcccactctagtagatggctcatcggcctgtcctggaggtgagatgtgctaagctgtgctaagcgaacagctgtactcttgaaaaggaaacctgaggccactatcaatctgggttcttcacttgtaactacaacctgataaccaaggatttccacatagggtaaaatgtcctcaagtaaagaccgcaatgaacaaatcaaagattgaacccagaaaagccagataattcagggaacaaattattttagaaaatgttagcatctgcagctgatatctgagaagatatcacaagcctttccttccattaatagaccatgcaattcagaacagccttcctcactgacaacaaagaaaaaaaggtggacaaatagcagcaaacttctgagagctaatgtgttaatgataaatgactgagccatgctgtggggaagacagagatccaaagagggatgcctttgctttggaaatatttatccatgaggaagaagctaggcagaacttctaccaaacttgagggcctgggttgggagcggtggctcatgtctataatcccagcacttcgggaggctgaggtgggtagatcacctgaggtcaggagtttgagaccagcctggtcaacatggtgaaaccccgcctctactaaaaaaataaaaattagctgggtgtagtggtgtgtgcctgtaattccagctacttgggaggctgaggcaggagaattgcttgaacccaggaggcagaggttacagtgagctgatattgtgccactgtactccagcccgggtgacagagcgagactccgtctcaaaataaacaaacaaaacaaacaaacaacttgagggcctagggggaccatagcaggggctagggccctgttaacttacccctcctttgtcctggtattccaaaggtacgcaacctagaataagcgtcaactggaagtaaactagcctctataccagctggcacccagctttgagttccaggcagcctagaaaacctcagtccctgaacgggatcatggagtccctacagtgctactcccaagaagttggcagaagcaaatagaagtgttctgtagaagaagataacatcatcttaggcctcaaactatttctacaataaatttttcaaatactatgtccaccagatagtaaaaaataaccaggtacataaggagataagacaatctgaatgagaaacagcagaaatatttataggcaacggaaatagatctgcaaaggctcctgatactagaattatcagacataaaactttaaaataactaagattattatgctaaagtagataaaagcctaaattaaaaatctggtgaagaattgaaagcatgaaaaatgatacagctgatttttttttttttgagacagagtctcaccctgtcgcctgggctggtgtgcaatggcgcgatctcggctcactgcaacctccgcctcctgggttcaagtgattctcctgcctcagcctcccaagtagctgggattacaggtgcccgccaccatgcctggctaattttttgtatttttagtagagatggggtttcactaagttggccaggctggtctcaaactcctgacctcatgatccgacccccttggcctcccaaagtgctggaattacaggagtgagccaccacgcttggcctttttattttttattttttgagatggagtttcgctcttgtcgcccaggctggagtacaatggcgtgatcttggctctgcctcctaggttcaagcgattctcctgcctcagcctcccgagtagctgggattacaggcacatgtcaccaagcccagctaatttttttttttagtagagtcggggtttcaccatgttggctgggttggtctcaaactcctgacctcaggtgatccgcccatcttggcctcccaaaaggctgggattataggcatgagccaccacgcctggcctgatacttgattttacttttttttaaattttccttttcttgagacggagttttgctctgtctcccaggatggagtgcagtggtgtgatcttggctcactgcagcctcctcctcccggttcaagcgattctcctgcctcagcctccccagtagctgggattacaggagtgtgccaccacacccagctaatttttatttttagtagagacgggatttcagcatgttggccgggcaggtcttgaactcctgacctcaggtgatccacccatctcggtttcccaaagtgctgggattacaggcatgagccactgtgcccggcgatacagctgattttaaaaagagaggatattacatctctcagatgatggggaaaatgaaagggaagaaataatcaaataggaaaaccgaagaaaatcactggtctctgtctctgtttctacagaatgaatgagctttctgaatcttcaaaacaccaagataggatcccaaagtacttacaaagcaatggaaattagatttacaatagatttttttagcaataacactggatgcaaagtctatggaacaatgccttcagggacttaaggggatttgactttgaacccaggattcaaagtacctagtcaattaaggtacaccacagtcaaatttaagaatggaataaaaaattaggcctctgtacacaccaaggcctgtgagggctgaccctctggccttttgatgtcaactcctttcacccttctgctaccatcccgttgggctgttccttttaaactccaagctctcccacctcaggcctttgcactttccctctgcctggatgttcttctcccaaatatatgcatggtttcatccctcaccttttctggtctctgcttatctgtttgtttggcctttcctttttcttttctttttttttttttgagacggagtctcgctctattgcccagactggagtgcagtggcgcgatcttggctcactgaaagcttagcctggcctttcttaattgcccagcatgaaatagcagcctgccagtattctatatctccctgcccttttaatttttttcccatggcatccatcaccactcaagacactacagatacctcttctcatttgcttagtctgtctctctccataagaaagcagatccatgaatgcagggactcagtctgccttattcactgctgcctgccccattcactgctgcctgccctatgcctataacatgcctggccaggggaggtgccccatcagtaattgctcaatgattgaatgaagctgtgagctaactcttagatccataccttctcccatcccccaccaacctgttaccttcttgatttaatgaatggttctggcatccattttttgcagctgaacctggaggtgccacatgttcattatgctttttccttccacatccaaccacccatcaaatcttattggttctgcctccaaaatacatcttgaatctgtctcctttcccctctccatggccaccacactgatccaagtcaccttcatctcttcctgggactgttacagaagatactccctgactgtttttctattttagttcatgacacctctgtgccaactctgccaagaagaaaacgctagctcctgtaaaggtctctgtggtccacctcctgcctcatttcacaccaccctctccttttgccttctatgtgccagccacagtggctccaaacagatcaagcactccttgcttttactctcacttctactaggaaacactttctccaggtctctgtatggctgtctcactcttctccttgggtttcatccgcagtgtcctctcacaaggccttcctggtcactccttcccaggcactctcatctgaagaccctgcttacttccttcttagtctgaatctagtctgaaaatattttgttgacctaactgcctccctgtttatgtgtgcatccctaccagaccgagctccacgaaggcagggaagtaccttccgtcttttgtcttcacaaccaagcccagagcccctgcaggcagcctccctcagcacaggcacgtggcggagcactccgtggctcctgatgtccagggcccagctcctgccaggttgtggagggccgtcggcatgtcaccctctcactgatgctgggacctgaggctgggtgctggagaagtctaacgggacacaatttcaaagcactttggcttatttaaaaaatctccaccttcatgtttcaagaaagaattcttgcagcaacaatgaaagaagcacctaccactactgttgactcccactggcttccagtggagtagtgaaccggacccagtaagtccttgcatatttctcgaagtcggtattcaaaccctaattacagaaaaacaaacaaacaacaacaacaaaaaacaaaacagaaataggaacacattacaaaaagaaataaaatcaagaatatgttgttgtgtctatcaaatcagaataaacacatgcgtattttattgcctactatgggcaagacgcccctgcatgtctctcagcggggggcactgagacccataatcacagattttcactcacttgctcactcccctgacatctgtagtgcctcctctgtgtgttgggcccagaggaaaaacgagatatggccagttctgtgataaactccttaaggtgatgggaagatatgggaaattgtgggctggtgagatctgtctttgagaagatgcgctggcagctggtgttgaggggaggtcaggagggtgggacggccagcccgcaggaggtaagagatggcaaaggcatgactgaagaggggcaactgagtggagggggcataggtccattaactcaagggttatgggcaccacccagtagggctgctagaaaggctggaggtagagtgtcggggtttgtcagcacttggggcagctaaagcaatagggaatggattaaactgtccaaagaaaagggtggagtaagagagatgaaactggaatctgaggaattttggaagtgaatggggtccacttttatactagattcctccttttacagccaaggaaacaagggacagaatggagggtgggtaactggtgtatggacactagaacaggcaggtggaagatggagaaagagaagcaagcagcagaagtcatcccaagatgggtggcggggcggagaggaggtggggacttgatgcagggcatcagagcaagtcccagtcaacacccaggatgaagcaaaccagagtggagtaagaggaggggctcccagggaagacgtgactagagcaccacaggagaggtatgagagcctgggaaggctgagtattcagaaaagctggggaccacacataatggcaaccacatagacctggtgggaagagtaaacatcaaattcatcatcgtggtctgcagggagggaggggaggcttcaagttgatcagtaatatttgctgtcgtttacaagtgtatgtacacacacacacacatacactcgtatttacacagccagaggcacatgtgacatgttagttctgggaattacatccgtgaaggtctgattatgattttctctgtcttttctgtacttaaatttttttctaaattataatcaaaatggggagggtgatgacaaaaataaagcaaaaagcccaggaagctgcacagagagagctctgggagggcctgccccatgccgcaccctgaaggctgcactcaagtgggaggaaaagttggtaaggctattggagtcactgtgaggacagtgcagccacctcttccagcacacctggctttctgcaagggaggcagcagagtgagagctctggcgggaagtgccagaaatggagggcctcagtaagtgcaggacatcaggcaagcctgtccagggcaggaagggctgggaggaggaagagaaccactgctacaagatgccctcactgattagcagcactgccaagttgtggtgcagggcaggagccagaacatagaatctgctccttcagaccatgtctttccacccaggcatctattcctccgtcctgctgcctgtcctgctgcttctctgcgggaacaccctcagggtcactctattcagagcctcagagcctataaggggctgggtgcctgctgagctgccttgactgcagctcaggctgggaggtagaggctgctgggccatcacatcttttccctgatttcacagggactaagtgaggcctgggaggatggaggggcagaaggagaaggctgctcagggctgccaggagcctcaccttcgtttacgaggtaccgtgcgtagacgaggagccaatggcggtactcgtggctggactgcagggtgagtgctgctgccacctggttctctaggtaggccagggtggtctcttgctgcaccacatgaggcacggagaagagccgggcagcctgccttcccgagctgcagagaccaggagagtttccatgatggggcagcaggcactacacagagtcaggaactgcccccgtgtgcaacaggcaaggagctggcaggaggcaggcaccagggctgccaaggcctcccgtccactagccagtctgttggcagatgccagatctgttgtctgcccatccccacgccccagccatgtgcctcctggcacccttggggtatctcacccagcacctgccatctgggcccctgaagtgacagggccagtgattgctgcccccaaccccaagatattacctgatgcaggaccactaccctcagcacccctagtccgtcctgcccagcctgcctgtgctgaccagcacctggggcacaggggaagggcaggtggagaccaggcctgggcagggactgtgcgtgcactgacccaggcacttccccagggcaggactaaggacagtggccatggcattcaggtcacgtacttggaggtgcggccctggattatggctaacggtcctgagcacagcatggcgtcctgggatggcaggctgctcctaaagtctgcacactgagccagtgagtcctgcttgtcagaaaccaggttcctggggaggcaaaggcaggagcagagctcaggaaaaccaagagatctggttggcctctttgccaaccagagaaggctggcaaagaggccacagagaagcagcccctgccgacacagaaagccagtagaggctgagcgcccctgcacttccgcacaggcgcctatcactgacaggtttcatggtaatgggtctgatagatcactgttccaaaggaaaaatgagtgaagtgaaggctgtggatagggcccttgctgggaacacttcagctccatatgttggttcctgatgactgcaggcctctgtgtgcagtgtgctctgatgctcagctcaaacactgccatggtctgcccacagggccacatggcctgggccctgtagctagcgagcaatgccaggcctctacctgcctgtatttctacaactatcccagactggcagtccttccaccttctctggacccttctcatccttgtgaagaagactcttcacacacttttagaacagctagatgtctttgtaaatgtgtccaaaatacaaagatgcctacagagagtcaatatttctcttcttaaataatcagcttatttccattattacagcaatcatatataatagacaacattttgcaatttgggggagcaggcagtggagattttttttttcctttgagacagggtcttactctgctgcccaggctgaagtgcagtagtgtgattacagctcactgcagcctcgacctcctgggctcaagggatctcctgcttcagcttcccaaggagctgggactacagatgtgtgccactgcacctggcttatttaaaattttttttttttggtagagacagggtctcactatgttgcccaagctggtctcaaactcatgggatcaagcaatcctctcagcctcccacagcgctgggattacaggtgtgagccatcgcacccagcagattttttttttccaaattcaagaaagaagtctcagtgtgaatgtagacttctgcatggcagttcttaacagaaaaggggctaggaggtagcaagctttggttcttaaggaccaaaggtatagacagaagaaaagaacttggagtggctggaacacaacgtacataattcacgtgtctgggttaagagctctgatgtataaattattttgcaagtacaaaaaagggctccaaattcctgagtggacagaggaaaagtacagaccatcatgcctgggtaagtggataagcatccttactaattcactgaggaagtctgaagtgcttactaagctcacagaaattgactagtcctgttaaggctcctgtaaagcccactaacctatgctcatggtggctaagggggccacagcaaaaaccataaaaattttggggctttttcaaaaagtgcctcctgaaaataatgcaggaggacagtgctcctgcacacaggctctgagggcagaggccataggctgcagtgtcctgctgggacaggggagcatgcacagatagtcaatgcagcctgcactccagggcctgactctcaggaaaagcagggctaggcagccctgtaggccacgaccctttgctctgctgtctagagcagacagacactcttccagggaataggactgggggtcagcttgcttaccatgtggaaagtgacggattaaagcagtacgccttcccatcggacaggttcattactgggattccatgctgcgtcagcaagatctgtgataccgtcatatcacttcctgaggacagcatgggaatgagttctgggtgtgctctgatcagcaagtgttttcaaacatatcaaaggagaaatctgtactctaggctcccacagtcccagcagcaaatgcatcaacactgccttggcaaatagggagggcaagccattctccttgccacacaccaggcttttgtcacctcttggggacccattcaaacatgcccccaaaaagtgtgtgtctcctgcagcgtaaccacacctcctgcctcactgagagccctgggctgaggccagagcctggctctctgagcggggcccttctgcagcatcagacatgaacttgggcccccaaaagagtagggacagcctgttgcctgcattacctgccaggatggagtgtagagactcttctttcaccacaaccacctgtctgtgaacatccctaggagggagacagggaacagtttactcaccaacccaggtaaacacatcagagtgtgccttggctgctcagacaccctggccctactgcatgcgaccctaaccctggcctctcctagtgagaggggctctgggctacgagtggcttctgctctccatgtgccactacactccctctgcattaaggctgcagcacaaagcccaggcaacagagccatggggaaccctcagcgcccacaccactttgggggaagccaggccacagcagccacatcaggaacatggccacattctgccagctaagactccatttctgatgaatcttgcataggaccctggcagtgcaactggtcgcatgggctgctccagtaaggaaataatcgagcaggcaagctgcctccatcccccttgcacactacccctcagccctcagcctacccagggcacccaacacaagcaatatcactaactgctcagggcctcttctggggcctgatggccagccttgtccactgccttccctgcccctgcagtgaggtggggcctacacagccctgtcctgccctggctgaagcccaccccaccctgtgcctgcctctcaccagacagagagtgtggctgcagcggtgagcgccatgacgtaggagcctgtgcaatgcaaagtagagatcggggatggcaggaggatgggagagaggagacggcgaccacaggtggagaacactgacagcatccttttttcacaggcgacacacaccacgtcactgagaaggcagagtgggggcaggtgtcatgggggctgagtgctgcagccaagacagtagccctggaagtgtgggccttccctctgcctgggcccaacaagggcctcccctgagcaggtacagccagaagggaaggtggattgggtcagggtagggctggtggggctgttggagcctccctgagatcttggatgaaagaggcttctgtcctatttccacaggctgcctgcgctttcctgagctcatgctgatgctgaccaaggggtgtgggggctttggagagccaatgcctctgatgatcacccaggaaacatgccttgctcatcagataaggccacatagtacccacaggacagtctcctggctgcaactagtcagaccagtcctgagaaggtctctaacaaggcaggctaagagaagtatggggatgacagcatgcacctctgtgtccagggggctgtctggctggcgtgggagatgtgtgtcgctcccaaacaaggagtgcgttacagaacagtctggacactgtccagcttctcccgagtgaccaccaggcccctgggtgggccctgcacgagcaggctgctgccttcccagacagagccccctaaggcacagccacaggcccagggtgaggctggagctcagacgcaggcaggggtagcagatgtacagccagtacagtgagatcctggccacagtaggccacccagagccctgctttgtgtcacttctatcctggtgagccagtcactccagcaggctcaaggaggtcagttaaggaaggagctctgccaactgccttcctaatgagccactattgctactggctccaaaaagggagaggcaagtgagatgcttttgtttacaaatgtttacttggagagtatgaatcagagaacactctaagcagcacgggcaacaaggagctctctgcagtgctgtgactgaattcttattttttctgagacagagtctcggtctgtcgcccaggctggagtgtagtggcgtgatctcggctcactgcaacctccgcctccccagttcaagcgattctcctaccttagcctcccgagtagctgggattacaggcacatgctaccacgcctggctaatttttgtatttttggtagagatggggtttcaatatgttggccaggctggtactgtgactgaattctatctgcccatctctggtggtcagagcctggctcaagccagcccactgcaaagaaagccatcatttttgggctgtaacactggggaacaggtctgcaggctgggcctgaactgggcaggactaagcaggaggagaggtcccacgtggtccagcaggcttgccccacagctgccatgtcactgtgggagaggctgtgccgacaccccttagccctcagctgggcaagccacctgccttgaggggagggacagagagtgggagcctgtggaagcatctgatacacaggtgcctgggactgggaatttaaatggctcatctggagggggaatttgagggaggaacagaacaaacagtggggtcccctaggcctaaaaacacaaaactcactcagggcccacgagaattgtggtctaagacctaaggccatgtgctttgacacaagtaaaagcatttacatgggacctcatggcagatgattaagggtgtaattatgatgactgtatctggtcctgactgggatgctacatcagacaggaacctgaggagaaacattggttccccttccacattgaacacaggtagggacagggctcacgtacagttctaggaacccaggggaagatactgggtgactaatcactgaatcaaggtccccctcacagtgcagaatctggcatgggctgggatggggacttcagggacagtcagaaatccatcctgaccaacttggatggaaatctgggatccaaaaaaggaaccagcccaggtcaaggtgagccaggcacacctcagtgtggaattcgagactttggggatctggctggacaagggaatcaggccatcaggttcaaagcttggcctgggtaaccctcaagggctcagtttccccatctgtaacacggggatactgatgctgaccttgctgggtgctgcagggactgagatgacaagcacatatgcttggcctggagtgaagcctggtgtgagtctctgtgggagctggtgctcccagggtcatgcacctcccctagacaggcccaggcccagaatgatggcatgtgtgcctgtgtcacctgggccggctaaggacctgcccacccttaccagctgcccgcagcagtgaggatccggctggtgagtaccgtctcccactccttcccttcccggttgcacttcaggcggctcagcttcacgccccccaccactgtcacttcattctccacctcaatgtacatggaaggatcggagctgacctggatgaagtaaacacacgggtctgctcagacaagggccgcagcccaggtgacatgctccaaggctctgtagcctggggccccaaggcagcagcaggatacagaggcagactggctggccaagagaggagagggagggcaggtagggcaaaggggctgagcgggaggcccagagggccagacatgtggcccccaaggcagggagaatgctgggagctggtttctaccctgtcatttgtgtagttgaacagccagagaagagaagcagtgccagggttaaagaccccaaagtctcccaaccctgccacttcatctcacaagggagtaacgtgcccaaaagcacactgcaaaggaccgagctgggagtgagacttgggtttctagcctcctacttgaagaatcttcaaagatggcagtgtttggcaagattagagaccatgtcagtgcttggagggaatgtttagaaaacccccaaaggggctctccagttcctgtggtggtgagacttggtctgctcaactgagactaaactggcaggggtgtttatggcacagcatgtatgaaaagcacctaattcagtgtctggcaccaaatgggctcagccacacgcgtgtgtggggagctgaccaacagattttccctgtggtaaaataggcagaaccaccaaacagtctgtgcttgtgtggccactcaagtgggtgagctgggccgagggctgactgcccccttcacagacccagaaatgacagtcccaagcagtgcttggagggcaagatgcctaggggaagggctggaggagtttgggagagttctgtgctgagaagcagggcacccaggagggaacctaagtcagaacacctctgagtgcaagagcacgtctgaacgctgctgaccactggagggcccctgcctccgttcacaccagcaataagaacaaaccctatgggttcctaccctttggcttccctgcttcattcctctgcactgtggcccagaaggacctatggtaggaagggctgacgcctgctctctggtgccctgtgaggaccaacctgggctcagagcagtgtgtagccagtgggaagtgacccgcaagcagggtccaagaaggctgctcgaggacacgcacctgagctgaggtacaagggtatgcagagaggcagcagtgtgtgtgacggcaccatggcaggagaggcctagatactatgctgggccaagtgaccaggagggctctgggtataaaggattatttactccagaattgtgttttggataaccacatgcttacaagcttccattccaagagctcaaacaactctgatgattgactgtgccagacactgagaagacaaagctagcaggatggttgggagatagattatgaccacacattcccacagacaccaagcctgaggctgcccagggctgtgtgtggaggtggaggtggcttccagccaggacacctgagaggagtcctgaagagcaccagaacatgtggtggtaatggcagccccagcagctggaatcccaagggcaaagccagacagaggctatgggtgagtgagagtggaggctggcaatttcgctaagagttggtgggtaccccgatctgctatgacttctcccagaaggtgatggagagccactggaaaccaatctccaaggaagtgacaagataggatttgtatgcagtaggggacagagaatgtctgggtgtgcctgagggagaactggcagggtcctagaacttacctggagggtgaatgctctctgggggcttggaattggcagcttcagtgcaagtgctggtgcagacagacacatggcctccttctctgcggttagggcagctggagactggaagagccagaaacgttcctgagccttgctctaacactacggggtagcatttggtaaaggcaggtcacccagaagtgaggctgagcctgcgaccagagcatttccaccctgggagggaggaagcagaggggaatgctacaaggatcctaacctcatggacaagccagttgatgccagggaacctgctcaagggccctgggtgagtcaagggcacatctgagggagagcgtggcctccatgctacattccaggggctgcatgtctaagccagctggttcccaaggtgacccacccagctgaggcttaccatgcacacagggccttcaagctctaagtacagaaaggtgggctaaagaaggcaggatgggcccactggcctcacctggacagacagagacacaggcatgagacgagagtccttccgaggccgccctttcttcttcttctctactgtctctacctcaagctcaagttttcgcttggacagtgaggaagccttagccaaagggactttctcatcgctgtcactgctgctctccaggaggtctcggggcctcagctctttcacaaggttctgctcttttaacctgcacaaaaacattacatcacacttcccttcagaaaccattcatgcaagaaagagtgaagtgaaatatttaaagtgcttaaacaaacctcttgccaacctagaattctgtgtccagtgaaattatgcctcaaaagtaaaggagaaataatgactttgtcagacaaaaataaacaaagagacaccggaatctgttgccagaagacctgccttgcaagaaatgttaaaagtctttcagagagaagataaatgatgcaggccagaaactcacatctgcatgaagaaaggaagagtgatgttagagaaaaaaaacaatgaacataaaatagaatcttttgtatttcatattcccaactgatctgagagacaactttctgttcaaacaaataacagccaccatgtcttgaattactatagtttatgaatgagtgaaataagtggtaccaatgtcatagggcatggaaggaaagagtggggaactctttctactacccatgaagtggtataatattatttgaaagtagagttaggttataaatgtttattgtaaactctagagcaatcactaaaaaaaattttttaaagcataattaataatgctgagaggagagaaaatttatttttattttattatcattttttttttggagatggattttcactcttctcgcccagcctggaatgcaatggtgtgatcttggctcactgcaacatccacctactggggtcaagtgattctcctgcctcagtctcccaagtagctgggattacaggtgtgtgccaccacgcctggttaatttttgtattattagtagagacagggtttcatcatgttggccaggccagtcttgaactcctgacctcaggtgacctacccgcctcagcctcccaaagtgttgggattatggtcgtgagccaccatgcctggctgagaaaactgaatcatataaaatactcagctaaaaccagagaaggcagaaaaagaagataaaaagaagtgaagattaaaaaaaaagaataaggccgggcacggtggctcacgcctgtaatcccagcactttgggaggctgaggtgggtgaatcacctgaggtcaggagattgagaccgtcctggccaacacggtgaaaccctgtctctactaaaatacaaaaaattagccgggtgtggtggcgtgtgcctgtagtcccagctactcggcaggctgaggcagggcaattgcttgaacccaggaggcagaggttgcagggagtcaagatcgtgccactgcactccagcctggtgacaaagtgagattccgtctcaaaaaaaaaaacaaaaaaaacaaaaaaaagaaatgggtttatgtttttaaaaatttaattttaactacaaaagacaaagacagattaatagtaggtggacacagtggctcatgcctgtagtcccagctacttggtaggctgaggcaggaggactgctcgagcccagaggcttgagagcagcctgggcaaaataatgagaccccatctctaagaacaaaaaataagtaaataaataaatacaagaaaaggggtgattctaactatatgacaacctggaacaggcaaaaccatggagacaataaaaagatcagtggtttccaggggttggggaaaggaaggtaactatatgaagcacagaatttttaaggcattgaaactattctggctgggtgtggtggctctttcctgtaattcctacactttgggaggccaaggtgggcagatcacttgaggtcaggagtttgagactggcctggccaacatggtgagaccccatctctactaaaaatacaaaaattagccacgtgtggtggcatacacatgtaatcccagctacctgggaggctgaggtaggagaattgcttgaacctgggaggcggaggttgcagtgagccgagatgcgactgtgccaccgcactccagcctgggcaatagagcgagactctgtctcgaaaaaacccaaaaaactattctgtaagatatataatgatgaatatatgtcattatacattggttaaacccgtaaaacgtacaacatcaagagtagacccaaatgtaaactttgggtgacggtgtgccccactctggtgggggatgctgaaagtgggggatgctatgggtatgttggggaggcgggcatgtgggaactctttgtatttcctgttcaatttagctgtgaacctaaactgctctaacaaataaagtctattaaaaaaaaaaagcgaggactggagaaagacatgccatgataacactaatcaaaaaaaggtggtgtagttacgtaagcaaagcaggcatcagagacagtaaagttatcaaggataaagagggacattacacagtgataaagatgaaggagtcaattcttcaagaagacagaacaattctgaataagtacacaggcataccttgtgttattgtgctttacttcactgtgcttcgcagagactatgttttttttacaagttgaaggtttgtggcaaccctgcatcaagcaagtctattggcgccatttccccaacagcaggtgctcatttcgtgtctctgtgtcacattttgataattctcacaatatttcaaacattttcattcttattgtatctgttttggtgatctgccattagtgatctttcatgttagtattataactgttttggggcactgtgaaccacacccatgtaagatgctgaacttaatcaataaatggcgtttatgttctgactgctccaccaactggttgttctcctgtctcccttcctctccccaggcctccctattatctgagacaaaacaatattgaaattaggccaatcgataaccctataatggcctctaagtaagtgttaaaccaaaagctaaaaatgattaagcttaaagaggaaggcacattgaaagctgagacaggccaaaagctataccttttgcaccagttagccaaggtgtgaatgcaatggaaaagctcttaaaggaagttaaaagtgctactccagtgaacacatgtttgaaaagaaagcaaaacagccttattgctaatatggagaaagttttagtgctctggatagaagatcaaaccagccacaacactcccttaatccacagcctaatccaaagcaaggctctaactattttcatttctatgaaggctgagagaggtgaggaagctggagaagaaagtctgaagctagcagaggttggctcatgaagtttaaggaaagaagctgcctctataacataaaacggcaaggtgaagcagcaagtgctaatgtagaagttgcagcaaggtattagaacatctagctaagatcatggatgaaggtggtaacactaaacaacagattgtcagtgtaggtaaaacagccttctatcagaagaagatgtcatctaggactttcctagctagagaagggaagtcaatgcctggcttcaaagtttcagaagacaggctggttatcttattgaagtgaatgcagctggtgattttaggtggaagtcaatactcattaactattccaaaaatcctagggcccttaagaattattctaaatctataaatgcaacaagaaagcctagatgacagcacatctgtttagagcatggtttactgaatatttgaagcccaatgttgacacctactgcttggaaaaaaagattcctttcaaaagattgctgctgactggcaatgcacttggtcaaccaagagctctgacagagatgaatgttgttttcataccaactaacacaacacacattctgcagcccatgaacaaggagcattttcatctttcaagtttcattatttaagaggtacatttttgcctgtggtcccagctacctggaggctgaggcaggaggactgtttaagtccagaagttctgagttatagtgcgctatgccaattgggtgtccacactaagtttggcatcagtatagtgaccttctgagagcaagagaccacaccaggttgcctaaggagaggtgaactgcccagtttggaaacagagcaggtaaaaactcttgtgttgataagtagtggtactgtgcctgtgaataacactgcactccagcctgggcaacatagcaagacactatctcttaaataaattaaaaataataattaaaaaattttgtgggccaggtgtggtggttcccgcctgtaatcccagcactttgggaggctgaggcaggcagatcacaaggtcaggagaccgagaccatcctggataacacggtaaaaccccgtctctactaaaaatacaaaaaattagccaggtgtggtggggggcgcctgtagtcccagctacttgggaggctgaggcaggagaatggcgtgaacccgggaggtggagcttgcagtgagccgagaccgcaccactgcactccagcctgggcgacagagcgagactccgtctcaaaaaaacaaaaaaacattttgtaagctatatcagattcctctggcagatctgggcaaagtaatctggaaagtattcaccattctagatgtcattaagaacatcagtgattcatgggatgtcaaaatatcaaccttaacaagagtttggaagaagcggattccaaccctcatgaatgactttgaggggttcaagacttcagtggaaaaagtcattacacatgtggtggaaacagtaagagaactagaagtaaagcctgaagatgggactaaattgctgcaatctcataaaaaacttgaacaaatgaggaggtgctagttagggaagagcaaagaaagtagtttcttaagatggaatctcctggtgaagatgctgtgcatattgttgaaataataagggatttatttatttttattttgagacagattctcattctgttgcccaggctggagtacagtggcacaatctcagctcgctgcaacctccgcctcctgggctcaagggattctcatacctcagcctccccgagtagctaggactacaggcatgcaccgtgacaaccggctaattttttgtatttttaatagagatggggtttcaccatgttggccaagctggtcttgagctcctgacctcagatgaaccacccacctcggcctcccaaagtgttgggattacaggtgtgagccactgcacctggcctttattggcatacattgaaatatcatgccatcgaaatcctttttgtaaggttggtactaatgcctcctttcatttctgattgtatttatttatatactaatcatactttaatacaactgtatgtcgggcttttttcaaataacattccatctgaactatttttccatagtacagtcatcctttggtatctgcatggggattgattccaggacccccaggagatatcaaaatccaaggatgctcaagtcccgtatataaaatgatttagtatttgcatataatgtaggcacagcttccaatgtaccattttttttttttttttgagacggagtctcactctgttgctcaggctggaatgcagtggtgtgatcttggatcactgcaacctctgcctcccaggttcaagtgactctcctgcctcagcctcccaagtagctgagattacaggcacgcaccaccacgccccgctaatttttgtatttttactagagacgaagttttgccatgttggccagggtggtctcgaattcctgacctcaggtgatctgcctgccttggcttcccaaagtgctgagattacaggtatgagccactgagctgagcccggccagcctcctatatactttaaataatctctagatcacgtatacatagtacaatgcctaaaaataacttcatttgcatggattcaaagtagtacttggcatgtagcaaattcagtttttgctttttggaactctgtggaatttcttttcccaaatatttttgatccatagttggctgaatccatagatgtggaacccatggatacagaggggcgcctgtactttggtccttataaacattaaagagaggcacaacataatgaatagcttacttcctcaacacctctcttttgaagaagttggtaaatgtttctcataatgctgtgttaaacatctctaaatatgacagactccctggatcacaggtgctatcactgatcttatttcctcaaggagttcaccatgagtgaactcctgtctagtatccaagagccctcatccctgcctgccttcccactgctaaccagcctctggcctgttagcccctcctctgggcactgtcttcagctgttttccctgctagtcacctgggtcaaagaaatgtgggcagatacacacaccagcgtgtagaatcctggattcttttcatttgtatccatgtgaaaaactgggaagacaagaggcccatgacgctgctctgtgaaactgaagtgtctgttcccctttcttctaatgtcctacaacagggcaaagcatccatctgtgggtgtagcttaatattctggaagtcctgagtcagtgctcctcaaaatcctttaaaaatttttttttttttaaatgtcagacatttgcctcttcaaagagcttgttttactatgttgtaaaaatcagatcatgtacattttcatattaaattttttgttaaataagcttttggaacagtcaaaaatgctttctctcagatgttctgaatatggaaatggaatattagcttgttctaattttttctaacatgaattttcctggttcagactgatctgaaagggtttcatgtattaaaatgagagaatcctattgtgaaacatggaaaaaaagtcagacttttatgtaactatcgttttgtaaaatacagcgagaatgtcacagcaacgtccaactatcatctaagtttctaaggcgggcggtggcttcctgagctcaccacagcactggcccatgacatacacttgcttggcactgccgagctccagctgctccaccctctctggttgggacccctgagagcccttaggagtctccccacctcctgcctctgccagatgccccattcagggactctggggccagtggcccactgggaactgcacctccccagcctgcatgtgggcttgtatcagttgttacaatatccctgggagcaccaggtaaatcgatctacagcagttgcccaatgggtctagacatctgtgaagcaagagcacagctggccagggctgccccccttacaaatgggctccatcctaggttctgtctgctcaggcctacttgccctgtagtcacttacctcaggtccctacgtgcttctgcctgacacctggccttaggagagggtggagcagaagacccacagtttcacccagggctgctaccctgtacctgggatgctagcatttggctcccaatccacctgaggctcttggctaggaagtgccagtcaggttgcaggggtctcactgcccaaccactgtgacgcacaatgaaggaacaacagcaggagctgacatgtgctgctcaccgtgaggcaaggaccaagatacggctttacaggcctaaggttaagggatacctcctatgaggagagttttcctgggaggtccattctgcctgagaggagatggactcagaaagaccatgtgtctcaagattatccctcctccctctctgaggaagtgggggacctgggcctaacttgcaaggtgtattactttgcgcaccacccctaaccactgcatgacactgtgcctcaaagaaaatctccactgaaggccaggtgcggtggctcacacctgtaatcccaacactgggaggccgaggtgggcgcatcacttgaggtcaggagttcaagaccagcctggccaacatggtgaaaccccatctgtactaaaaatacaaaaattagccgggcgtcatggcatacacctgtaatcccagctactagggaggctgaggcagaattgcttgagcctgggagacagaggttgcagtaagccaagactgcgccactgcactccagcctgggcgacacagcgagactctgtctcaaaaaacaaacaaacaaacaaagaaaatctccactgatgggtgttttcttgtttcgttttgtttttgttttttgagacaagtcttgttcaggctggagtgcaatggtacaatctcggctcactgcaatctctgcctcctgggttcaagcgattctcctgcctcagcctctcgccactacacttggctaatttttgtatttttatagtagagacggggtttcaccatgttggccaggctggtctccaactcctaacctcaggtgatctgcccacctcggcctcccaaattacaggcatgagccaccacgcctggcctgttttgtttttattcttgttttgagacagggtctcactctgttgcccaggctgcagtggagtgatttctgcttactgcaacctctgcttcctgcgtttaaggaattctgctgcctcagcctcctgagtagctgggactacaggcacgcaccaccatgcccagctaatttttgtattttcagcagagatggggtttcaccatgatgaccaagctggtctcaaactcccggactcaagtgatccacctgcctcggcctcccagaatgctaggattgactacaggcatgagccactgcaccaggcctccagtgatgggtgttttaaagggctcctcctggttttcattgagaatcaatacaagaaaacagccacatcaagaaagtatctgcattttctgtaaggcctttgttaaagatactgggacttgttttatttcattttcctcatataaggatccaacccaacctgagaattcagcaccaggctcctagaagctcactatactcattctggctggaaagcaggaagctcagccccaagtgaatgctcactcactgccactttcaagtgagaaactgaggatgacaaatgtgatggtggccccttattatacagatcttgctacagctgtatttatggctggacggtcttgtgagaccctgtggacatagctgctgaggaaccaacccttgtggcaccaggacccaggatatacagtcaagattctgtctccagaagccaatctaagggctatcctcctggcttctcattcagggtatgcactacatgagagataagggccacagaaagccacaaagcaaacatgagtgtcttcctcaataagcaggactgtctgtggcacactgtagtttctctcaggtggggaattcattttatttattttgttcagaacttgctccatttcaaaatctgaggtttcttcaccttctggtaagcctcttaactccctcttgacaactaccccgcagcacatcctcctggggggactcctctctattgccctgtcttcagctccacctcctcacctctgtgccactctggccaattttgtagactgaatgttcttttcagctggttctgatctgctctctgaaatgcttgttgacttttaaactgcaatgattattatttttcttttctaaaagtattttttttggttcatttccaaatctggtttttttttgatagtgtattattcttttaatttttattgagatatatatatcataaacttcgccactttaaagtatagaatcattagcttttagcatattcataaggttaagcaaccatcatcactatctaatgccagaacattttcataattccaaaaacaaactctgtacccattggtactcactccttatcctccctccctcagaccctggcaaccactgttactctactttctttatggattttccattctggacatttcctatcaatggaatcatacaacctatgatcctttgtgactggcttctttctcttagcataatgtctttaaggtttatcgttattgtagcacatgtaagcattccattcctctttattgttgaataatattctattgtatgggtaaaccatattttgtttattcatcacctgatggacttttgggctatttccactttttggttattatgtacagatgtgaacattcatgtatgagttattgcatggatatatgttttcaattctcctgggtatgtatctaggtgtgggaactgctaggtcagatgataactctatattttaccatttgaggaacttccagactgttttccaaaggtgctaaaagactttacattcctaccagcatgtatatgagggttccctttagagctaatttttgtttacagaatagagtattaatctttcctcacattttgttttagctttcatgtccttcaagacttaagcatactttatagtgccatctgacaattctatgatcacaggtttataggaccaacacttattatctgactatctgatcttttaattacagacctccaaatgggtatgaagtatttcattgaagttttgctttgtatttccctgatggctaatgatgttgattgaatttttatgtacctgtgctttgtatatattctctgcagtttctcttcagatcttttgctcatttttaagctgtgttattcgtctttttattgttgaattgtaaaagttatttatataatttaaattctggactttaattagatgggatttgcaaatattttctcccattctgtaggttgtctttcaattctgatagtgctttggaagcaaaaaagcttttaattttttttttttttttttgagatggagttttgctcttttgcccaggctggagtgaagtggcgtgatctctgctcactgcaacctctgtcccccgagtttaagtgattctcttgtctcagcctactgagtagctgggattataggcgcctgccaccatgcctggctcatttttgtatttttagtagagatggggtttcgccatgttggccaggctggtcttgaactcctgacctcaggtgatccacccacctcagcctcccaaagtgctaggattacaggcgtgagccaccgtgcctggccaagcttttaatttttaacatggttttgtaaagatgaggtcttgccatgttgctcaggctggtctgaattactgggccttctgtctcgggcttccaaagtgctaagattataagcatgagccattgtgtccagccaaaagttttaaattttgatgaagtccaatttatcgattccttcctttagttgtttgtgcattaggtgtcatatctaagaaacagttgcctaatccaaggtcacatagatttctatctatattttcttctaagagttttatagtttttgctcttacatttagttctttgttcccttttgagttaatttttgtttatagaatacagtattaatctttcctcattttgttttagcttttgttccaattttgttttagctttcatgtctttcaaaatttgttccaattttgttttagctttcatgtctttcaagacttaagcatattttatagtgccatctgacaattctatgatcacaggtttatagaaacctaagtctcccagtaagtatgtctcctgacatttgtgcatgacaggctctttcttcttgtgactgtggattttatgatcatctaaacagtgctttatcagtggtaatgctgtacaccctggcccaaggaatgtcactgcatggtggatacgcatctctgccaagtgcctctgaacgtcaattagaccaggatttcgtttgtgttcatttctcggcttggcgatttctatacaacacaagtagtattaaactggccctgaatccacatgagggcagacctgtggttacacagtctcaagggaagactgttatcccaacccaaaaacaggctgagacattccaacttctctgctagttcttgtgctgtcagttgggttttcccaggtctgcctcagtccttttttaagcagcttgactttatgctggtgacttaattccaactcctacatggcttagaccccaggccttgtctcaagtcgatgtggtcattaaaactcaaggtcctcagtcaagacccctagccttgcacccatggtgcagttctgctcactgctctggcttttttgttcactcttagattttagactctgggtactgctctttcctgtgaactagttattcattttagggacgagggttgcatttaatccagcatttcaaagtatttagaagcatggagaccgcgcgcggtggctcacgcctgtaatcccagcactttaggaggctgaggcgggtggatcacctgaggtcaggagtttgagaccagcgtggccaacatggtgaaaccccatctctactaaaattaccaaaaattagccaggtgttgtggcaggcgccagtaatcccagctacttgggaggctgaagcaggggaatcaatcaaacctgggaggcggaggttgcagtgagcagagtggctaggacaatagacataagccacaacacctggataatttttctggtagagatacgggtctcactatgttgcccaggctggtctcaaactcctggcctcaagcgatcctcctgtcttggcctcccaaagcatttgggattacaggcatgagctatcgcatgtggcctgcattgagttaattatgaaacaagcatgattagattacagagcagactacaagattccacaccaagtttatagatacagcatcaaacttgcagaaagggtcctcccatgctagcttccaggaactgttttccaaggagaataaatcctgtccagacatgcagttctggacagggcttttcataagcaaagccccagaggtagcatgctgtggctttagctccaaatcaccatctactgcaaggacaggtcacatacaaatgctcctttcattgggcacctgctggctgtgtggctactgcaagtttctgaccagtgtccttgtacttggctgatggtggcacaggctagggtgtgtctgcccagggctgctgagccctataaacctcgcagtggggtgcaactcttaagggacagctcttaagcccccaaagtccagcccacatctgcctctcctctcctaggctctgactcactgggatgtgaacttagctccttgtcaagctaggcttggagggaggggccctctcaggaggcagagaacttcagtgccaatggcagaggctgcagacattcgctctggccacctcaggaggatgcactactgcaaaactccaagaaataaagaactacaacctgcgtgatgtcacagctgtgtttgaggggagacccagagaatggataagcagcatagtgtccacaagagctcagaagccaatctgacttgacaaagacctcacttacatcatttttattgcagctctctacctctggtcagtttctgagtggaaggccgtcacttccatgatgtatcaatatcagagtcttccacctctccaactaatctcatgctctcttccgtgcaaactctgggctccatccaaacaccattattctcagttcagcctctgcactgaccaatccttgtgcctttgaccttgtggttcttttgccgcgtcctcccccatgactccttccagccaccttcccacttcaaggaaccacctctttctcctggtggctcactaagggctctgcagtcttgctcccatgtattgagtggctagagtcttttccccaacaggaaggcaggttgcttggtgggaacactgccactgtgctgttgacccatgcctgcaccctgcctggtccttcagggtcctgcagctaccacctacctttccacagctgtcggagtcatgctggtcagggcaggagcacctggtgtggctttggaccgctctgtgaaccgggagtcaaacgctttcatgggttcgatcttggacggggtcgttaacacagaaggtgacaatgcagcaggagtagaggtagcattcatactggggtgaagaagaggggaggcatgtcaagcgcaatcctgaaaggatctggaggtctagtatttgcattatttggagcctactaaaaaaggcacaaatatcaaacttccataaacacaaaaaatgtcaagatacaatctactactcccatttctttaaaattttcatgtgtcaaaattatggacacctagaaggttgtgagcaaatgcattcacatttccccctttgcactgttctgagagcttttgcgggtagaatgaggcctagaacatggttcttacaacccttttctctagtcacactgccctatctccacaacttaaatacagcacctctaccccaaaccactccagccactcacctttcccactttgacaatgagtctcatgagataagcctgcacctggggtcctgaagccatggtctgcttttacccttagtcaggcatcctccatcctgagcggcccctcccatatctccctgtgacagtgtcacattcttagcattatgctccaagtgctcatcacacaactttcatcttctattccacagagaaaggagaggccaggcagaagcctgcctggtccatccttcatgtccaagcccacaccacacgctttgggaccatggccactggacctcctcctaagcacacccaggctaacaccttccactcctatctgcccagacaccacaccacatgcctggtagtcaccctggacagccccattcttctcctccatgatctgtggccactagaatgggccatccccacagagttctcagatctggcatggtctgtccttcccaggctcccttcgtcctggcatgctttgcttcctcactggtcttgctgctcagtcttctcttcctaccctctcagggtccccccagggcagtgacctaatgtttgggcatgccttcacagccatggtgctagcacccagaagtaggaggctgaagtaacataagactccattccaccaatggagaattgctctgacggtatcagctgtatcccagaagcagggggctgcagtaacacaagactccattccaccaatggagaatcgctctgacggtatcagctgtatgtgccagggagtggcctatttggggcaccaccgcctaacagagtcactttcctaaaatggagatctcaaagccttctacgtctccactctggggaaaagcccagactacctgatccagcacagacaccttggccttctccctcttcttggccttcctcaggggactggggggctgctgcccctaatccccaggcctcatcccctggtaggcctgtatgagtcctgtggagggtaccctctgaggcacctccctgatccctgagataccagcccctctttggatggctagccatttctatccaggggacctgaggggccacctgcaaccctgtggctacctctcccccaccagcctacacactccctgaggatgaggacccacccattaagcccctgcgatgcctggggcctagcagggtgtataacccagagcaggtgctgagcaaacgttcactcctggctttcatttgtgcttgcctggttctttctgatttctaatttggtttccaagtaacaatgggtgaggacacaggctctgtgagtgaatataattctgagagtataaggggagtctgtgccctcccacaggagaaccctgcctaagatgaatgctgtgtgatgtgctcagcagagtgaagtggaagctgaggccccagaaatgtgaagcacctccagtgtagagctgccaggtggggctgaccctgcagcacgtagcatttcactggtagttcccacccttagcagcctgaccctcggtcagccttgatacactctgtgaaatcctcaacagtcctgtgcatcagagactcactgaacaagtcctcccctctgagaagtccccatttcaaatcacgcatttttttctttcttttttgattgaaggggccacaaagtgcaaacagaataaaattctctgtcctcaaaactatgtgcaaacctgaactttccccagggacaggaacaagccttggcacccactaacctgtctttattgacagaatcgcctgcaggtctggcactggcagccaccacaggctctgtgcaaggcttcgaggcgccgaaggagttaggggtactggagtccagtggcagtagctgtggactgctatgagaagagagcatggtgcccgccagggagcccgagagggggatgctgttaaagaatgccgtggagaagtccctgtcatcaagtaagaacaaaagtcagccttgaaagtcaggtgccacatccagtactttatacattcaaataacttttttctaggtccaaaggcagtatgttttcatgatagaaaatctgcaaagttacagaaaagtaaaaagaaaattaaagccacttaatatactatatttaattgaatctaggatttacaggttctatatgtactactaagaaagaaaacaatgctactaattgtcagatgccattgactgtacaacacacccaaatctcagaggtgttaaactgtgcaaacacatgtcttaggaggaatgaaatgcagcaatacagaaagggcctccctttcatgaagggccatggggcatgccactagatgggtgtgccataatatacctaacccagcctctactgagggaccacaagactgtctccagctttttctagaacagatgctgctgcaccaggaagcaaggtattgcagtgtcagaactgaggattctgggacagccaggtctgactcctctgccatttgttagcttgtgacttgctctaactactcttgtgcctccagtcatgtctgcaaaatacaaagtgccaggactctccccatggggttgctgtcaggactaaagcagttggtgtaggacactcttagaacacacattggctgctcaaagaattatgaaattctaataattgtcattacacctaagattcacataatatatgggataaattcttagaagtggaattgtagcagcaaatgaaatgttcactgatgatttggaataaatatttctaaagtgccctcctcagaggtttaaattacaagccatgtatgagagcgcctatttctccacataggtgcttagtaacacttttatcaaatttcttgacacttaacaatctgacagaagaaaaatggtatcttattttgatatgagtgacgttgacattttttctttttcttttttttttttgagacagagtctctcccgccgcccaggctggagtgcagtggcgcgatctcgcctcactgcaagctccgcctcccgggttcacgccattctcctgcctcagcctcccgagtatcccgccaccatgcccggctaattttttgtatttttagtagagacggggtttaaccgtgttagccaggatggtctcgatctcctgacctcgtgatccgcccgccttggcttcccaaagtgctgggattacaggtgtgagccaccgtgcccggccggcagtttttcaaagtagaaatacttgatttccggccaggcgcagtggctcatgcctgtaatcccagcactttggcaggccgaggcgggtggatcacgaggtcaagagttcgagaccagcctggccaacatggtgaaaccccgtctccactaaaaatacaaaaattagccgggcatggtggtaggcgcctgtaatcccagctacttgggaggctgaggcaggagaatctcttgaaccagggaggcagaggctgcagtgagttgagatcacaccactgtactccagcctgggcaacagagtgagacttcgcctcaattaaaaaaaaaaaaaaagaaatacttgatttctttttttttttttttgtgaactgcttgttcatatgctttgtctactgttttgttattggtctttattactgatttgtaaaaatcatttacatattaaaaaaattccttatatggtaggaaatattttacctgggatgttgtgtttcaactatttatggcctttttttttgagacgaagtctcgctgtgtcgccaggctggagtgcagtggcgcaatctcggctcactgcaacctctgcctcctgggttcaagtgactttcctgcctcagccttccaagtagctgggactacaggggcgtgccaccacgcccagctaatttttatattttttagtagagacggggtttcaccatgttggccaggatggtcttgatctcttgaccttgtatccatctgcctcagcctccgaaagtgctgggattacaggtgtgagccaccacgcccagacagcctatcttttaaatgcactaaaattttaaaatttttgtgtactctaaattgtcatttacagaaaacacttttttgacctctgagattataaaaaatattcttccagggaatcttctaaaattttaaacaaaaatattttaaataacaatttaaaaagaaacaaactataagctgtttagaatgtatgtaatgataagttatgaggctgggacccaacattgtttctaggaggtgccatgtagtcctgtcttccatttaccgaattagccaatgttttatcactgatgtgaaatgctacctttaaaattcccataaatattcgggcctgtttcctcatattctatcatattccactgcactatctactcatgtgtcagtatctcactgttttgagttatgacagcttttaagtcttaatttctggtggggctagtcttccctggctaatcttctttttcagaaatatttcggccattcctatttatttttccagataactttattttatttatttatttatttgatacaaagtctcactctgtcacccaggctggagagtggcactatcttggctcactgcaacctcccaggttcaagcaattctcctgcctcagcctccaagtatctgggatacaggtagtagctacagtagctacaggtgggcaccaccactcccagctaatttttatatttttagtagggacggggtttcaccatgttggccaggctggtctcaaactcgtgacctcaggtgatctgcctgcctcggcctcccaaagtgctgagattacagttgtcagccactgtgcccagtcgatttttccacataactttatagttaccttgtctgattcccaaaattcctacggttatttgtactggttaaatttataggctacaagagagctgacatctttatgatgccatcctagctaatcaatggtatgaatttctagttatttctttgagttttctttgaagcctctcagtagggtttttaattttttcttcattaagatatgcatctctggttgcatcctagttattttatttgtgaatatgacttatttctttatgtgctctgagggtagttggtgctacctgacttcatgttgattgtatcctgccatgtgactatcttctttcattgcctatggcagcttttccagttgattctcttataaaccatatcatccttaaataattatcctttccaatttgttctttcctttgactaactacatgggctaggacctatagaacaatgttaaattatagttgcaagagtaggcatttgtttagtttttgaacttaatttgaaataagataatttatcaagttaaggaagcatccacctattcccatttaactgagttttaaaacaacgttgaattttaccaaaacgcctattaagcatcgatgagagatcatataattttttttcttttgatctactgatacgtagaattaaatagttacctaaaatttgaacctccttactttcccaaaacaaacctcacttggtcatggtatattagccttttaacaagcagtaaggttctgtttgttactattttacttaggattttgcactgacattcagaaatgagaatgatcttgaatttattatgttttatccttgtaagattttgatatattatgttcatttcaaaataaaaatttgcacatttcttctccatgcactagaatatttaaaatggtattaacagttacctgagttacctgttccttaaaagttcctgaagtttccctgtgaagccatcttagtccggtggctttggtggggttaactctgtcctctatttcttccacaataatttttcacttttagtaattttattttcttcaaaaaccatccactttctgtgcaaatttatttgcacagagttcagcaaagaagtctctcatctttttgatttgtctattatttctcacttatacctactttgtatatttatgctttttctcttctttcttgattagctaagctaataaggacctatcctgttgctacgtgttagaacgtgggaatcaggagggcaaaaagcttttaataccaaaaggatcaggtcctgatgctagaaatatgcatcctatgtcagaaagttggccccagaccagttaggaagccacctacaccttctcaccaggtaacgcctggaaggatccacagaacaaagtgtcaccatcaccaccaccacctccccatcccacaggcccagtatgttcagagctcaaccacacactgggtctcacttggtctcaataaaaggtaggtaggggcattaccccctacagggtcacaataggaaaaagacttagtcaaaagaaaatgagtgctctgtggggagccagcagacctggttcttgctctactcgtggggacctcagagcctgcacatctaacatgaggagactggatctgtacactgtacgagtgaaggtttctttagacaccaaggaagatttggaatagctcgtggatggacaactgcaaaacgcagaggcctaaagtgtgtggcctccatgaagggcttacaaatgccctgagcagatagacggaatgagaataaaacccagagtgaactgccttgacagtgggggtctatttctttcacacagtgctttatcatttttctttctttttttttttttttttgaatcaacacacatcattttgggaagattaaccaattcaaaaacaatcttcactatatacactgggacaacagcaagtggtgaatgagtctcttcccccttctctgtcccccacagggaaatatgtttgggagccctactctctgcccagtaattccacttctagaagttatcctgagagaacaaccacaggtgagctcaaagactcatttataatcacgagaaactggacacaaacacaagtctacagtgagctggctaagcaaatcctaggatgggaatctggataatcagatagcaaacacctcagaggactagttattaaaatggatgaatgggcatgaaacagtaacgagtggggaaaaaaaagactggaaatacagatataaaaacattaacagtgactgtatctgattatggataatgtttttttcttctttgggcttttactattttctaaatttaaccatgtgtaaatatacctttcataatcataaaaataactttatgaaagaaaaaaaagaaaaaaaaaatcagcctgactgactgctttccttgtgcgtcctctggtgccctggcaacagtgaagtgcagcagatgtgctggccgccttagcactcccacccctcacatgattcaggtgtgcacaagggctccaggaggagtatgggctttgagactgcgggaagctgagcttcacttccttgcttccatgttctaccagtcaggttgtgaaggacccgtgaagatcctcactgtgaaagtgttaaccgctgaaagaagacaggaagatctcgccagataagaccatgaaaggggaatgaaccagtacccagtgtccagctgtgctatgcagagaggcgtgattcttctccggccatctgctgtccgagtctcaacttgtttcttcaaaagattctggcaaagcagagttacataaatgaatgcaaaagttttggccaactatttccaaatattaaaaaataaagtctctttttttcctggtgataagaacactaagcataagatccaccctcttagcaaagttttaagtatgcaatatcatattgtgaactgtaggcactatgctgtaggggagatttctaggacttattcatcttctataacttaaactttataccctttggctaataactcccattttcctctgaccccagtattcaccattctattctctgtctctgtgagtttgactattttagattcctcatataagaggtatcaggcaggccaggcacggtggctcacgcctgtaatcccagcactttggggaggccgaggtggacagatcacaaggtcaggagatcgagaccattctggccaacatggtgaaaccccgtctctactaaaaatacaaaaattagctgggcgtggtggtgtgtaactgtaatcccagctactcaggaggctgaggctgaggcaggagaatcgcctgaaccagggagtcggaggttgcagtgagccaagattgcgccactgcactccagcctggtgacagagcgagactccatctcaaaaaaaaaaaaaaaaaaaaagagagatatcatgcggtatttgtccttctgtgtctggcttatcattaatttgtacacactaagtatgtataactttttatatgtcaattgtacttcaacacggtaggtttaaaaataataaggcttctaaggaaatgtattctaaattgccctcctggtacaactaaataagacacccaagcaaagaacaagcagtgggtacatgccacactggccgcctcgcacaacagccatgggaccaatgaaagggctaaaggactgagctctgtacccgtgaaccacacatctgtcactaagctagggattttctttctttcttttttttttttgagacagaatctcactctgtctcccaggctggagtgcagtggcgcagtctcggcacactgcaatatctgcttcccgggtttaagcaattctcctgctcagcctcccatgtagctgggattataggcatgcaccaccatacccggctattttttttttttttaagtagagacaaggtttcaccatgttggccaggctggtcggaactcctgacctcaagtgatccgcctgcctcagcctcccaaagtgctgggattacaggggtgagccactgcgcctggcctgaggtagagattttcaaactgactttcaaaatagaatccttccttccacagaaagcttgtaactaggggttttctctcatactttatatctgaattgcctggaggaggtttgtcagcctacacaggctcctggagatggtttatactccccaggcaataacgttccctacccttttcccgccccatttccaaccccttcccatcaaacatggcttccagatgaagaagggggagcccatagaagtctcctaagggcagagcctgaaatccactgttgttagcatctaggatttttagaaagaccagaaggataaaattcgtaagttcttacaagagatgacctcctctgggctcctggggataaggaggcctttgataaagaggatccaggccccattactgcatcatgcagcagtgggcaaggggccaacaggcccgaggctggctaacccacagatcccgtaccactctaaacaaaccccttccttaccaccactggtgtctgcccctcaccctgtccctgggcatatgtccatgtctttagcgccaccaggcagggctctcaccttcctgatatcttcaagactctccccgttgacaacgcctgcgactgaggtggctgagcccatctccctggtcgcagcactcttctggtccagctgctgctgctgctgccttcgctggtacttgagcatctcagggttctcaatgacggctgtggagagctgggcctcggtcatgatggctaggctcttgccataggtggactggtgaatgcggctctggggaagcaaggagaggcatgacatgccagcatgagtgccagtgtggccagtgctgcccaccagcaggcaaactacagcagggctctcctggctctgagtggagaagggacccaaggccaactccccatcgcctcccatcctattctgcctgtccctcattcgacagctctgttgatgtctcatgcccacccttgatttttatggcctcccttgtatctgtagctgggatgacagtaaatgagacagccaacaagacaacacctgccccacagtctggtggagaacaaatgacaatccacagtgcttcagtggaaaggaagatactcaaggtgctaacttaaggctcttaaatcactcctaggacccaaatgattttgggaatcagatcctagaacaaaagtctactttcacagctcatctgcagccataagccctgtggttggaagtccccattggcctgcttagtgtctctaagagtatgggaaggcctggcacagcagggctggggagcctcctttactcccacccctcctagtatgtcatcatactcccctccttctaggccctcatagtcttgtgccctaacaagctagacaggagcctcatgagagcagagatggtgtccccagcacactgtagtgactgctgtacatgaaagtgcatgaggaacacacttccatgggatgtgcaaatgtccaatgtgggattctgctcaagaacagggactgtggttaacaggacatctgctttacagcagagcatgggttgagaggcagcgttccaagagaggtgccttgggacctgctcctgcagggcttgaatgtggccaggaacctccttttcttgccatcttggctcctgcccttctctcctgagtctatcccctggaatctcgaagcagaattcagtgtttggccagggtttccctagtgttcctccaacatggagtcccagcctgacttgggaaatggtaagcagatgggttattaggctcccagagtgactccaagggagtgcatagtgatcccaggtacctgatgacagtgacaaggttggaggaggacctgaggcctctgagatactcattccttcatggaaaaatgatggggtggcaggccccattctaagtgtagtcattaaggcagacctctcccccaaaggggttcacattttagtggggaggtcacactgtaggttaagaggaagcttccaccagcaaataaggtcatgaggagagctgccagcctgctctgggctttcacagagctcccttcagacacatacacacaacccaccaagtgggggcaggtttctaagcctctggtaggtgaagcagggcttttctcaaagcctggcagaagggcagagagaccccatcaccccagcagagcacagaggggaggcagcctggcccagaggcagcaggccttgttcactcttctgacctaagggtcacatacagtctgggcaaagagccatgctattttctgaggcttagtttccatatccacgaaatggatgagccttgccttgaagggttttgtgcaatttaaatgaaatcatatgtgcaaaacacattcccagagcctggcagacaatgcgttctaagaaatgaccaatattactaccatgaaggtgaaagtgacatgagcaggggcccctgaggagtcacttcagctctttcccagggcaaaaacctcccagtggatggcctattatcagctcaaaaagagatgcctaaaatagttctactcttaactccaggacttatttctgaaatggggactcgttttttaattaatctattttgtaaagaaggattacaagatataaaagatgaataccccattacatgttaagaaatgacttgtctgtgtatctcacaagaagagggtgtagtcaaaggggtctctcagagctattgtggcaatggccacagagcacccagcagcacaagagccgtcagcctaccttctcctcctcgctcaggggatcgccaagctcatcctgggagaagtcgaggaatgccacagagccgtccatagagcataccaagatgcccagcccattcagagtcctgaaagacatggccatcagcagcctggtagcaagagccccaggcagacacatgtgccgcagtagctggcctgtgaggatggtgggcagtgttctagggagatgctggaaactcctggttcccttctgtggcctggttcccttctttggcctgggcgggggggggagggggcgacaattgtatcccaaagggccctggtgttctttagctctaagcaggtgtacaaaatatctcctttaccatatgttctgtaagaattttcaattttacttatcttacttttgaaactattaaaataaaaaaaacttgacaaagtatacatataaatcaggtcactgagaagcagaaagtgtgcttctgactttggttcatgcactgacggagtaaagtggaacatactaggatcacgtcattctcctcgtcttagacaaatcctgaaaaggcattttccagtggcaaattctacacaggcaggacattctcgcagcagcaggtacaccgctgccagttcccaaatcacgtgcaaacagcactcttggtctgcgctactatgacacctggggaggggccactggccacctgaccctagtcacacccagaaggcctcatgttccaatgtgtggcttctcctttcttaacctattcctgtaagtagaatccaccttaccaggaaatatccatgatggatttgtcaaacagttcatggatgaccaccagcggccgtttcagacatgtgagctggaaggaaagacacagtcaaggttaatgaaattactgaaatccccttctgtattcagctcagttaacataaccaacctagaagcctgggtcaaagtggctgctgatatttaaggcatcttcaactctattcaaactgcagctgcagagatcccaaactgtgggaaccaaagcctgccaaaaatgtgcatgctacctagagtggaccctgcctccagggcttgctgtggtctgacaggggaaatagctttatacacagataactagcaacagagaaggcagagtgggagtgggtttctgaagggctatggtcggaggagagggacagccccagggtggacctctgagagggtctatggagcaggagacacgatgccaaagcctagacaggggatgaggcaccctgagagagaacacaacacatcttccctgggcccaagggactctggtacacatttatccaaggctcattctacactatgtgtaggtagtacagaaatacacacctgggcccttaatctgggcctagttaccgactattaatactttgatgaattattatcttctattttgtgcaaatatttattttattcttcaaagtaagaatttattttattcttcatagttgtgtctgttttttcatttaacacacaataagtatgtcattaaatatcctgtaaaagtctcttctggatgactgcatagcatgcactgtgcatattctctatcgagtcactcaattgctggcatacactctgactccacgttcccacaactatggtaggcctttccacttgtgcacaagtgcctggctaccctgctggctggccctgaactgcaggacaatgggcagggaagaaacacacttcctcacgggatggtgggctcccataggtgctgctgcagcttctgggaggctgtggggctgagcgtcccagtgcagcctgagactgctatgtggggaaggagaagctgtgtctaccctagtggtggagagggggctgaagtctgaacgatctggaacccacattaagaatctcgcctccaccttaattccacttctagaaaaagctgccttgtccctcctctcataaatgtgcctacagacccctcagaaatctacaggccgtgtgactgcctaacctgagcattctaagaaatatgggcatcacagtcagtgatgttttggttgcagcgccacaaacagggcctctggctgggaggaaacagggaaggtcccctgaacggcaatctgtggtactgtggttcaggttccagaatgggtgttaagtgaatacttggcctaaaaaaaaaaaaaaaaatcacaacgcacacagtaatatatttctctataccaaactaataaatgcagccagaggataaccttcaaacccagaacttccaacttgctctgcttatagggacacttttttacaaaatgaaaaaaaaaaaaaattaatgtgtgtgcactttgctttatcaaactttaaatatattggcaccttgatgctcagcaccaagactgctccctgcactgcatgcggaggtgtctcttaccacacagtcaggtcacagcacaccagcccctggcagtgagaaacttaacccttcaggagccctcacttagaaaccgccacagttcttacccttgggttctcactcgccaactaccattgagtatatctgctgagaacctgctctgtagagggcactgagttaggaaggtgaggggaacaatgaaactgaagacacatcgggctgggtgtggtggctcacacctgtaatcccagtactttgggaggccaaggcgggcggatcacctgaggtcaggagtttgtgaccagcctggacaacatggtgaaaccccatctttactaaaattacaaaaaaattaaccgggtgtggtggcctgtaatcccagctattcaggaggctgaggcaggagaatctcgctcgaacccaggaggcagaggttgcagtgactcaagaagccaagattgcaccactgcactccagcctgctgggcaatagagggagactctgtctcaaaaaaaaaaaaaaaaaaaaaaaaaagaagctgaagacatcgcctcatctcaggggatccagcgagtgaggagtactaggctcacaaccttacccatcacagcatcacccaggggtgaaatggactaataaaggcgtcagctttctgtgtgtctttttctgtggacataagcacttatctgtcttggttgtatgcctaggagtggaagtgctctaggtcatatgcttagctgtggtagaaactgccagacagttttcccaagtgctcatgccagcgtaaacacctgtcagcaacacgtgtcagcaatgtatcagttccagcttatcatgtccttgctgacacttggtactatttttttgtttttttttttaattttagaactctactcataggtatgtactcataaatgaaaacgtacatccacataaagacttatacaagaatgttcatatcagctttagtcataatatctcaaaactggaacaatcttaatgtccatcaacaggagactgtataaacaaattgtggtgtattcatacagtggaatgctacaccgaaattataaggaataaaatactgttaagtgcagcaacatacacgaatctcaaaaacactgtgccaagcaaaagaaatgaagacacaaagaagcaagtaccacacaattgcatttatatgaagttcaagagcaggcaaaactcatcagtgtaacagaggccattagagtggttgctttggtggtgagggaggtcttgactggggagggacaaagggacaaaaaggagtgctctaggcagtgatgacactggtgtgtaaacatgtatgacaactcaccaaactgtacctttcaggtgaatacactttatataaagatttttctttttcttttttttttttttttgagacggagtctcgctctgttgcccaggctggagtgcagtggcgcggtctcagctcactgcaagctctgcctcccaggttcacgccattctccgtctcagcctcccgagtagctgggactacaggcgcccaccaccacgcccagctaattttttgtatttttagtagagacggggtttcactgtgttagccaggatggtctcgaactcctgaccttgtgatccgcccacctcggcctcctaaagtgctgggattacaggcgtgagccaccgcgcccagccatataaagatttttctaataggaagcaagcccaacatgctgctcatggcattgaccactgagggtgctgcctgagtctggacacaagagctggtctaggtgggggtcaaggtggcctctcctggctgggcacagacccagtcttcagcacttccttctgggagagcaggagagcctgtgagcttccaaggaggggctgaccccaggtgcagaatagaaatacactcttagcatcacccaaagcaggtctctttcctccacttgctactttaccaacctacacctcccgtcctgcaacaaaagctcaggatagcaggctcacccagacagaaagcgagcggtccttgctgccaacagcacagcagcagtacgggcagctaggcttcgcagaactcccattcttctgcttctttttgaagatttttgggttgaatttctaaagccaaataacagatgttaaaaataattaatcaagcatcaggcatgtcccctgtgcccaagtcccagcccactgaagggagtctcccacagacattctctgagcccaggcactgagcatgcatttcatcttcccgaccacctatgaggcatctggctgatgatggaaaggaagcttagggaggtcagaaagtatgtgcggaggcaccaaatgagtaagctgggaaatgcagatttgaaactagagctaccaaactctccatttctggagcttgccaagtagaagggatgcgtagctactgaaactagccttctcaattccctctggccaggcagggccagccctaggacctgcagaaaagctgagcctgcaagggggcttcagaaacaaagacctactcactccctatctcctaagggaggccaaggggatgggcaggaggggtgtgaatctctgaattccttattgcctcactgcatttgttgttcagtcataaccgtctagcagagatctgctcagtcagagagtcatttgtgatctccctgggccagtgaccatggcaatatcacacaaaggtgcttggttggctgcttagtccagggaactaccccgagagtaacttgtctttgtttctgcaaaggatgaaagcactcactgagctcccagacaccctcctggatttaaaggggtgggcgctctgggaatccccaacctaggacaactgagggcagaagaaggagggttcctgaaagcctggtgtcaggtagcctagagatgttttaattccagagggcaggcaggaatggccggggtgcacagagactggagaagatggaactcagaggcgtgtccctgggcttgctgtctctaacaccaatgaggctgcagggccttaggagctctgtgagccataggcaggcgtcgtgatctcccagagctgctaataaagtggttgtgaggactgcatgggagaatcacgtagagcactaaccatgaagcactgatttccaaagactttagcaacaaagctctggttcaaacaaaaccctacatgaactccaaaacaaaaaaatttaataagtaatattttattcatataaaatttgtgttttaaggtacaatatatgatacttattatctttttttatttttatttttgagacggagtctcgctctgtcgcccaggctggagtacggtggcgcaatctcagctcactgcaacctccgcctcccgggttcaagtgattctcttgcctcggcctcctgagtggctgggattacaggcgcatgacaccatgcccagctaatttttgtattttcagtagagacggggtttcatcatgttggtcaggctggtcttgacctcctgacctcatgatccgcccaccacagcctcccaaagtgctgggattacaggcatgagccaccgtgtccggccgatacttattatctatttaaacacgggcaaaagtgagtctattttcatcagggtcttggatgatccttcacttttatcaaccttagtccaccaatctgtttattttatttggctgcccagtgttgagaaaatcctggttctcacagattattcgcaactacttaacagcttgccttgggctctgtcaggacactatttaattaaagtcatggagaagcataagacgagtggccagacaactctcatgcctaaggactgacagcagttcacgcctctgagctcttcacctgccgcagcaagatctggcagcagctcccaactcagtgatccatggcatggccttgcacctgtggttgatgctgccaggtgtggggacaagcacagtgcttggtgggtataccagaattgtacctgtattcactggagccaggtgagggtggcaccgtgcttgggcaccccaagcatacctgagtgtgtaaaaggctgatgtggagctacgatgttcctaacccaagactgattttggtgatgttcacatgtaaagtttgccaataaatcaaccaagtacatactctattttgtaaaattagcttttaaatatttaagtataactattcaaaataaaccaagaattaatatttgctgaatcttggagcccatctccctttagttccctgggcactcaccacgacagtcacagctttccggtgcccaacaaagtccatgttggtcttccatccctcccgttcgatgatctgggcagtggggcctgagttgttcatggcatgggcagacaccaggtaatgcccatcaggtgaccagctgagccgcaacacatgggtcgttcctccacactgaaagaagcatctgcacttgaaaggagctcaaggccacctttgtgaccaaaactctggcctcgaggataaagttaaacttcaatttataaatgtgtgatggtggagcatgcaccccaagcttctggctacactgacagcttctgtctcaccagatggcccaaccaaaaagggctctgtgaaatgaatttggaaactgcagcatcctacactcccccagaggagctgaacaaagaaatatagtacagaagtgtatgccctgaggagatctgcaggaaggctacctgtttgaaccatagcctctgcatgggccaaatctctctggccactgacccaattcttctgtgtagcacctgttaacccacagcatggcatctgcacagcatcctcaagatatactctggtggagaaaaagccctttttaacccaggagcctggcagaagcctgtgtctgtaatgtagctgatgactgtgaggcaccacctactctcttgagcctgttgcctcacccaaagggtggtgaggatacccgcaagggagaagaggtttgtaacatccttataaactataaaaggaacagtagaaaggcactgctcccccagtctggactgggggctgaggcagagcatccctccacattatccctcctgcaaaaagagatgacatgggtccagagccagctccttgaagctcaaggtgggcccagggcagctctaaagacttaagggttaagatcatgacctcacagctctagagcaggacatgacaaaccagagcctgagtatagtgaaatcacccacctcagctctcagcctaggtgacagaaccaccccctacctggaaggatgggcccacccagtagaggctgaagagtactaccacctcctgctggtactcaagacactcctaaagccgtccctaggagtccacctcatgggaccccactgcctggcagtcagagccctgaggaactccagaaggagcaaaagctccttagggcaagactaagtaaggtaaaaaccagtactcatatacctagcccaggagctggtgttgtgcgggaagaactgaacatatgactatcactttacttttgcagccatcctgaccagtgggcaaatgcgtgctcttcctgcaaaccttccctcatgtgtccctcgctctgtgaagtctttcctgatgcactcacctctcctgggctgtttctgcactctggacaactccattatcatgcaactaatgggaatgcctgtctttcctatggggctttaagcttcaagaggagagactccatctcaatccacttttatttccctgtgcccagttattgccttctatacagtagacacttaataaatgtctaatgaacaatggtgatcttgagctctcattccatttgaaatcagaactcaaataacggaagagagattaaaataccagagaagctactgcagtctgatctccaaacatgtgcaaactgtactgctaactccagccaggaaaaaaggcccctgaactgcagggtgcatatcaacaagcacagcacagtcgaggatggcacaagagtctcctccatcctccccaacaagctgctctgcgggaggctcagagtaaactccgcactataagaagcagttttatccacgtctgtgggagtgagctgggtgacagaatgatgtggagacatctctaaggttcacttcaactttaaacctataaatccgggccaggcgcagtgactcatgcttgtaatcccagcactttgggaagctgaagcgggtagatcacctgaggtcaggagttcgagaccagcctggccaacatggcgaaaccgcatctctgttaaaaatacaaaaattagctaggtgtggtggtgggcacctgtaatcccagctactcaggaggctgaggcaggagaatcgcttgaacccaggaggcggaggttgcagtgagctgagatcgtgccactgcactctagcctgggcaacaagagcgaaactctgtcgccaaaacaaagcaaaaaacaacaaaactataaatcccttttatttcaaagttggaaattaaacagcgtctcagaaatgaaggattctgtattatctgactcttagggccagagtcccaccccagagagccttggtgaatccgctcaggcccccggactctgtgcattccccaggtggcctggcccatggccagctccctctctgtacacagaagtcaggaagaggctggggcagctgcgggggctcagctccctgagctgtccccacttacctcatcaaaaggcttggtgatgctggtctccaactgccagtccagcgtcctccacacctttaggctgcggtcatcagcttgagaagctatgtatttaccaacagggtcccatgtcaaccctttgaccaagccagaatgacctctcagagtagctagaatttctgtgaagaaaaaaggaatgtggagaggtgttgtctgagggaaacatgacctgcaatccatgggccatgggatggatatgcaagagaggggactcagcagtctgccatggccagcccccacaccagacagaagcagaagggcctcctcatttgatctccaccaaggcaaaagccaattgaagaaatgacagcatcaaggaggcaggcaccaaggggctagttctgatccaggtcttatctgtatctagcggccctgcctatggctgcccttcctgggctgtgacaccagcacttctgacgttagcctccctggtagctccctgataaggaggaggcctactagctcaaagggcctgactgtggctgagtcttttataagttatggctgaagacaaaggtgtgtacgacggtaccccatatagatctgtaatccaaatgctactccggtctctaaagcttccctctccatagccagactgagtgtttccacacatgctggtggctttcaaagagttaaaatgacctggatccataaggaaagcatacttcaaatacagagctgaaatatgagaagaattttactagttataaactgcagcactgtgccaggttatgccatctgttgtgactttaaacacaatgaataagaaaaatcaatcttttgcaaaactgggtttgtgttagcccgtatctgctcaagggtttcacagaggagatggtgactgagctgagcccagagcccagtggtgggggtgcacacagcaggtttaggagcatcagggtccccaacaacagctgcccatccattaccctcctgatctgtggcatgccatgctagcactcagttaccatttttcttaagcatgaatctctttttaaagcttaaacaaatgtaactgacaaagaaaaactgacaagacacataaatcctaggccactgtgacacatctgttgccaccaagactaaggagacagcccaacccctgctccagaaactgacaggcagtactgcttgctgttaaccagtcagaggaggccccagacctgggaactttacagcattccagatgacgacagtgttatccacgctgcatgaggctagccaggcatcgtggggagaccatgctacatccatcacatctgaaagaagacagagggttctggtgagatctcttacctggtgatgcccttgtctattagcttggccagtgcccctgggacctgggaccatcataaccactctggtattttttaaccaacctgaaaaaactccccccagaatttttcaattggtcataaatttaaagcatctaaccgaccccagtgcctcactccttttacagacgaagcaactgagggcgtggttcagagcttgggcaccatatggcaccacacccatgcatgagagcctgctacttcgtgggtctgtggcctggagcatgctcctcagccctgctgacttgctttgccaatcataacagggccttcctccgagagccttctgagcatgagacacagtgggtaaagcacatggcagaatgcctggcacagtcagaactccagggctgctgacaactgaacacaagtcatcttgaggccctcgtctggttcatggactgggtctcatctcccagaccctgacaggagtaccccttcactatggagcctccaaacagaattattcacattcacttctttgtgactccattttatcatttgttaagtgcagattaaaaaacaaaatctaggccaggtgcagggactcacgtctgtaatctcagcattttgggaggctgaggtgggcagatcgcttgagcccagaggtacaataccagcctaggcaacatggcaaaaccctatctctacaaaaaattggctgggcttggtagcacatgcctgtatccccagctacacaggaagttgaggtgggaggatcacttgagcccagggaggttaaggctgcagtgaccatgattgcaccactgcactccaggctgggcaacagagtaagaccctgtctcaaaaaacaaacaaaaaaaccaatgaaacaaaaaaccccaaaacctatcctcatagggtcactgtaaggattaaatgtgataaactgctgcaacaccatgccaggcacacaccaaggcatcgatgagggtccgctgtgacgatggtgccaaccttgcctatcctgccatcaggggtgaagggcgcagtcttagttatttctctaacctcagcgcctggtgcagtgctaggtatacagaagaatgattggtgagttgaagaaacaaacatagcagcaaggtaatagctatcaagtcctttctttgtacaagaggtttaagcaaaatattccaaatatctattgtattttttccagttaaaaaaaaactatagtaacagcttaacaggtttttttttttttttcaaattgtctcacatgctgtggttcacattttgtattctaaatgcctatgtgatcttcacagcttctttccttttttgccctgcattctatgtggttgagagtattcactactattaattgacctaatttaacactgaagattaactggattctggttttttgggcccgtgtgtatttgtcactctccatactccagattattactctgagacgcataccctagagtgggaatcctgggcagaatatctgagcatcctcataggtctggattctcataaaactgtagactgcttttccaagatccctgtggttttacatttctacatgcagactgtttgcttcaaaactcccttattagcattgaggatgatgactttttccccttccgacttatttattcaatacaattttatatttaaaatttttaattagattattagtgaaagcgtttgtctcttatctaatgtgtttttggactgatttgctgacttattgtgaccatttactgggaagtgtttcgggcagtgggtctaacaacataaatgcagtgcctacaaaaatgaagaaaacaacaactttctctagtaactgagagtcctggaggggcacacatgcaaacgccaggacagcaggggagtgcccacatcctagaacagagaatatgtggttaggtgggagcccagaaaggagaagggattttcttagcaatctccacagacacatataatgcagctattaactgcaaatttcacctctctacttttttatactgtagtagttttatggagtaaagtctgttattctcctttgtgatttcttctattgccttgttaaccttgaaaaatattctctctgctagaggtctggtaaatattcaattctattttttccttgtgtagttatttagaatgtttctctctttagtatctggtttggtgtgtgctgtatttggtgaggattgaaattaatttctcctcactaactgcttaacagttactatgctccatgtgaggaagaatccattttgataagcgatgcctcctttcacaacacaccaacttcttaggtatactgtagcctctttcagtgttacgagtttaccctcaaacccatgatgtttctatcactggaactttgaatgttttcatccgtaacattcttatccttccagatacgatcctttagaatcactgctgagtaaatccacatacatgacataattttctcctaaactcccagtttggagtttctgtcttcagactatatagcacctcctttttatggtgcatctacacacacaggagaccctcccctcacttgtagatttacatttctggccactgttctcaccatcattcttggtgactccaagaggatgattcttctaacactccaggctcttggttccttaaattcctccttcccttctgatgaccgtggcttccactactttcaccccacggtcatgtccagaggccttccatgacaaatcactgcaatctgtctcaattccaaccttcccacaggccaaccatcagccccgtgctcctagctcaccctcagctccaacagcactttcacgccaccaggaactccgatctactgatgctgccgtcccctcaccacttgccaaccacctggtccttacctctctcctccagctgagagcccaccaccactcccccttttcttctcctccatcttcctacacgcctgacaaagctcagctcctctcctagtgttttttgagtactctccaatgacacctttggcccaatgacaccacatgaatattgcacttgcctaggcccccagcaccctccatgctgtcaagcccagcagtctatccttggtcttcactttgcccctcagcaataagcaatacgctgcctgttcccctctccttcaaatactctcttcactgtccgttttgttgttgttgctgagacagggtctcgctatgatgcccaggctgttgagctactggcctcaagtgatcctcatgcctcgcttcttttcactgtcttaactggcctctccttctagcttctttttctggtttcagctctccaatccctaggctcatccttggactctgctcatacccagaacctcatatttccaagattcatatttccaaatgtctacacagtatgtccatttacactggcaaacttaacatatccaaaaccaaactctgaaaacacttcccttaacaaacatttctgtcccacctgcagacttcctgcttcaggttacagccactgcatcctttccactgtttggaccatagtccgggaagccatcctgactcctctgcttatctcacatcccatattcaatgcaccaggaaatccgcctctgatcacttctcaccacttctgtgttatgactccaaaccaccattgtctctcccttgtttttcggagcggctcctttactagtcttcccagtgcagccctgagacccccatggtagaatccacactgctgccacaggtctcaactcctctgcctagatccctgcggagacttcatattcttgctcagagaagagcctctgccacggtctcaaaggcacactgcctcccgcaccctcctcccccgccccagctcccaggggttcactgggcacagtaagcacatgtccatgctccaaggccttcgcactggctgtcccctcactgccgtccagtcttccctcaaatgtcatctcctcactggcccccagcactcatcttccaactccttacaggactctgccttctaggctcatcttcaaatctcctatactactcactcgtctgtctcttttacaagaacaaatctccttgagagaagaacagtgcctggaacatggcaggcactcaataaatgtttggtatgtggacaagtaaatattaatttgggaaaaaatgtatttcatctagcctttcaatttaggaagccattttctatctctcaatgtcattttgtatcttaaaacgtttgtgatttaagtcttacaaaactaattcatttcttggtaagattacttattcctggatatttataacttttgatcccactctgtataattctctttttatcattagatattctaattggctattagtagcaaaagaccaataatttaaaattgttctgttatgaggccaatataaagactcattttattagttctaagtatttttcagtgctttatttgttccaagagctttatccccctatggtttttcctaatatgaaataatgtcaccttcatttcctttttgccttattttccagtttctatttaactgtgttgcagaaattccagagcaacaaattaaatgacagcacccatcattgtcttttcttgatataaaccgcaaccaggcttaactgtgaactgtaatatttgccactggtttgaaaaagactaaggactctaccatgttaaggaaatagctttaggacaggtgtggtggcttatgcctgtaatcccagcactttggaagatgcaggtgggaggatcgcttgagcccaagagttcaagaccagcctgggcaacatagtgaaaccccatctctacgaaaaaaaaaatcagccaggtatggtgatgtacatctgtagtcctagctactcaggaggctgaggcaagaggatcacctgagcccaggagttcaaggctgcagtgagccgtaattgcaccactgcattttgcctgggtgacatagtgagacacagtctcaaaaaaaaaaaaaaaaagaaaaagaaaaagaaatatcttcctatgggcattttaaaaaaagcatttttaataggaactgatgttgaattgtctaatgttccttttaaaacacctaagatgactgtagcttttcccatctaacttcctagtatgtaaagttatattaatagattcccttgtactacacttacaagtcacatttaatcataataaattactattttctggccggtcatggtgactcatgcctgtaatcccagcacttcgggaggccaggacaggcagatcacgaggtcaggagatcaagaccatcctggctaacacagtgaaaccctgtctctactaaaaatacaaaaaaaaagtggccgggtgtggtggcacgtgcctgtagtcccagctactcaggagtctgaggcaggagaatagctggaacccgggaggtggaggttgcagtgagctgagatcgtaacactgcagtccagcctgggcaacagagcaggactctgtctcaagtaaataaataaataaatgagtaactgctttcaagtgttattatatttactagtattgtttctgatttttctatctttattcatattattctatgcttttgttacattatttttcttaggttttcttgtattttccagatacaataaccctggcttatatcttcctttcaattataaatattgctattgttctgtataatttttcttaaaagctcaaaacaatgcacctacaactaatttagaaccaagaagcatttctgaagacagcctttcatttcttcattggttactattctgttcagtttttcctaatcctatggtatcaattatgaaagttcctattttctagaaaattattttttagtattttgttctttagcttaatagtacaaacattatattgtactgtttgatgatttttttctgtctgggttaaatgtttttctagatctttaaactctaattttgtctaggttttttcttcccaacccccaattaaatataccaagtatatatttctcacactttgcttttcaaagatccggttctttcttattcatttacttctgcttttcattgatttttcttcttgaatggttctgcctgcacctgctaccaggaccagtgagtaatgagtgtcaggtccccagctgaaggtggtcaactctacttgtctggtaaaggagccccactgggcggtgggtaggaaagagaatgcaaggctctggttagggccttgtaaaagtcctcacttgaggcctaccccacacttgggcaccctcatagacatgtgcaccaagttccagaaaagtccaactagacttcactgttagtactgtgacacaagtaagggccaattacacaatttaattatcaaacaataacacaacactaaccgtttcagctttcacaaatgtggactcaatctatggccgccaccaagatgggtttgttctccttttaacagtctacagggaatctgctaagcatacactaacaatggattatagctgatgccacctcccacacctctcactcctgccctgtcctcgcccagagctccaggctcaatttgaaggtttcttgacatttcttcccctacccctcaagccaggggcaactccattctgaactggtatccgtccccataagcctgttgtccttagggtctcagcagaggtgatacctctgactatctaggcatccagccaagaatctatctcatacctctctgtgccctatcctaagtattcccaaatcaatctcctcttctctacctcaattatcacaggcctagctcaggccctgacagtgtccatctaaacgactggaagaacctccacttcactgagctgtcacaatgacctctctgttgtgcttcaaagcttttagtggctccctatctcttccatgacaagggactccctcagtaacagggagcacaagctttccatgatccgactctggcatacctgaccagcctcactttgtgctgctccctgccttgtctataaagatccagccatggtgaaatgcctccaaatccccattcacaccaagactttctcacttatgctgtaccaccctgcctggaaaaccctttggtccattcctggaccaaacggactcagactcctaagtcaagtctaaattgcactcaacctggtatccttgacacctgagtgtacagtgcatgggcaaccttccccctcagtctaaattcataaaatgtgcttctttccatgccaagtttatttaaaacactgcaaacatactcaaggtcaagttgagaaacttttcaatgggcatctgtgagctgatttctggggaataaacaaagtgtgcttacggacttagtgatccgctgatgaaggtactgattctgttcagcaggacaaacagcagaacgtgggaagttctacattaaagatataaacatataccccatgagggcaagagtggggagactgaatgcagctggagacaggtagtggacccggtgactgcacagatcttaagggacaggcagggtgtgactgattgtgatggggtgggacagcccagacatagggctgctttaaggaccaaacagtcccacaggggacgtggcggtgctgctgatctgagccaggtgtcaggggcccacccaccccaacaggcagtcccactcaccgcctgaatgattccggaggatagagacacaccgccactgctccacattggcaagcttaccactggagccgaacacggtgctggggccgatgtacctgtgtgagaaaggggccaaaaaggcactcatggagtgctctgggcactgcatagaaatgctccctgcagccagcttatcagggcacacagaacaaagcaaaaacaaacaagaactggaaagcactgggttgttgaataaaaggggctggttaggtgaattatgatccatgcacttgatgaaatactacacagccattacaaatcttgcatgggaaaacgttcacaataagtgaaagaagcaggccacaggacatcacatacaatatgatatcacttatgtaaaggaaaaaaaaccacatgacatggatagcatctatgcatggaaaatggattagaaggacacacatcccaaaatgtcaaaatattaactgtagctttctttaggtggtgtgatgagggatattttttcttttgtatttttagttttctaaattgtatactaaatgttacttatgttggctatttaaagaagcaaaatcaacagtattttatttttaagcatctcacaatgaatcaaatggctttgacatctgaggcagagaaaccacgcgatctataggtactagcccccaccacaggagccagaggagcatcaatcacctggggcctggtggaggcagtgctgacacaccgatgatcagagcctctgataacaccttttgctcttgtagagctcatcacaaatccacagaaagagtgtgctgagatagccaagtaggctgaagagacagcctctgcctctgctcttgaagccacagccacagggccactcttggtgagcaatggtgcagggtctggtgccccagactgactggcccagagacctgggagcaatagttttccaggtgatggttagctccttttgagagtagagcagaggctgccccaggtggggaccaacagagaataaagtaatggcaaagaggctggactctggatcccctgccccagatcctgggcaagaaccagagcaccctgacttttaaccattttgtatattgggcttccatgtgaaatttcacttgaaaaaacaaaagcaacgaagccccacccacatcggcactagaagagatcagactttccttttcaggtgagagcctgcagtcctgtgagggggcagctgaccaggtctcctgaattcctggtcaggctccacctgctcctgacctacatgcactttccactacttatgaggtcagggctatgggaacttcagtgacagggtagggaaaggtgactttgataaagaccagcaaagcagcttctaaaaataaaatgtgaagaaaggaaaatgatgcttacgtagcccgcttccacaccataatcagtttgtcatctcccccagaagctaaatacatcccactgtttgaccaccgcacacagttcacacatgctgggaagaaaaaaaaataaggtgatgaaaatccagtagtcatgcccatttgctttatgtagagtttggcaagatgtaaagggtttataaaatctaatctatctaatctatttaaggcatctactgtgtgagagccccagaaaaacaattcagtttaagcactaacctacttgtgctataaaaacaaattaccagaacagtctggagggggaaaaatatacattatctgagaatcgttagtgctgaatgacatagtcaatagaaggcttctttctaagaaaatcaaaaaatgataaccaaatctcattatttcaaaagggtcatctattaatgagacacatttctgagtagagattattctcaaaaaaagagtacgtgctaaaaagggtcagatgctttttctagatttttcagatgaacagtctgttacagtataaaactctgacttcatctcatctgtcagagccagccctgtcacattcggattttccaaactcgccagcactgcagattgactgactctgcgcttataagctaagatcagcagaaattcccccaggcccctgatgggccagagcctccaagagcactcacaacttggcctttggaagacctgaaagatggctatcaaagttgtagcccccacatggcccgtgagtaacatgctccaggtctgaagacactgagaggcatgttgagaggacaagaacacacagaggaaaggaaggagctgatgtccaaaggccagtgactgttcattaagcatctcaggggtgggaaactaaggcactacagcaggaaaggaaaccatcacactgtctgatggccaaaagggtcctggcagagagcctcagagtgacacagtaacaacctgagatgttttggcaaattgtctcttgcgcacccttccccagaaccctactgtgtccaggtcgctggccccaaagccccatggaatcaggcagtaacgactcatgagcaggaaatcaccagaggtacctgcagactgtccaaagatggttctgtgggcgggccgagtcttctgctgaataactcacccaggtgtgcagccaacatctgtgccttcagacagcaggccgaggggagttaccgccgcacggggccttatctttctaattacaaacacatgtgctaaccttgggcactctgccaacacgcaaagcctgcaaagggccactctgtaatacctaagtgattgtccatctggcaaagcatcttgggaatattttcatccttctcgtcatcctcctggaggactggagacatattccagatcacaaccttcccagaatcctgccctggaacaaaggagcagaaatggctgaatgtgcaaggagtagaaatttgatattaatatttaatgtcaaattaaattaggagaagtcctcacttagcttccataaacaataattaactagatctaaggagactgaatttaaattactaatttaagttacagaaaagatgataagtactcatggggacgaaacggagcggacttagcagtcagcagaagtcaacctgactttacaaaaagaactttagactagcaatcaggagggaactgagctctgatctggcctctaacacggatccaccaggggtccctaaaaggtcttcatccctgcccagcacctagactccgactccttgactcctcatctgtgaaatgaggagaagggaaagtcaatgtcataagaccttttctgttctgtgtacaccctaaaaagcaaacagaaaagcacaccctagtggggtttccctccccttccaggtgctgcctggaatttaggctgttccagagccgactgttttgagacccaaatgtaccctgaacacaggaaaaatggctcattatcttgttatccaccctttgcagttacctacagacgagagaccaccaaaagaggggatttagggctcccgtggtcatgagttgatgtattgctcggctaaaaaatatacccatgccttttagtaatgatttcttttctttttttttttttgagatggagtctcactctgtctcccaggctggagtgcagtggcacgatctcggctcactgcaacctccgcctcgcaggttccagcgattctcctatctcagcctcccgactagctgggattacaggcgaacaccatgacacctagctaatttttgtatttttagtagagacggggtttcgccatgttggccaggctgattcgaactcctgacctcagatgattcgcctgccttggcctcccaaagtgctgaaatcacaggcgtgagccaccgtgcccagccttagtaatgatttctaagctttccatcactgatatctaacgaagtttagcccctcacttaattttcctattataatagggccaaatccaatgaacatgccaaaattaccataaagcatgtttgaaactgcctcttggccaatatgtaaaagtatttccaaaacatctctgctggaccaaggtggcaaaatgtgtgtcttctgggtacaggtgcgaaccctctgattccttcagctaagtccatgtgttctctctcatgtgctgcacctcctcctctcgggtgcagtccacagcatggaaggagagaaaggcttccctgcccacagcttccctacactcccttccagctccttgattctgggtggaagcatctgctggaaacccaccctgcagcacctggcctgaggacctagagctcacaaaggcactctctaagtgctgcctggggaggcctggttggagggaggccccgctctggggtaaagatgacagagggctgggctctgtggaatgctacattgtgtcactatatatacatcttggtattgtggcatgaagaacagctctgtctttccaaatagaaccatgcaacattgcaaaagatgctggctgaagcataagggcaatactaccaataacagtttcaaatggtgtgggctttcttacttgcccacagtgtgctttctctttaacctaactgaattcctttgacgagaaaatgggcctaataactacacgattgctttagaagcttaaattaccctcattcccttttttcagatgagaaaaatgctgacagagcccttgtctctggggctgggctttgcccactggaccacctaccgctctcgatgctctacaagtttggggatacaaactgattttaatattaactcaataaacagaaattagaatgatacatccgctgccaaaatacttacagagagcacactaaagccataaaaggattttgattttattcattcagataacacattataactgtacattttaaacagcgttgcatccatcctgaaaaatagcaagtattccctctacagctaaatggacagcaggagaagagcaaggtggcagggctgttaagctttccctttctttattccataaacataccttgtcctccagttgcgaacttggtcccgtcagggtgaatatcaactgaaaaaatcggcttgcctggaaacaaagaaaaaaaaatacagtatctaaattggcttttattcattgaagtgtatcaaactcaacagattcagttaaagtctaaactgctagaagattctccaaacatcagacaactgaaagtccaacagtgggagaaagcattccatcactgagaatggctgagcccataggatgcctgggcatttgtctgccatcttgtagggatgtgtgtttgtaatggctatgagctgttcatgattgaagttctgagtctcaggtacttagtgaaaagggcacacagctgtaactccagacatctccctattgcatggatctgcacttgactggcagcctagacagaaggactgctatttgtcttttctggctgacagctgagcaggaccagcgctggctgcaaccaaggagcattgcttcgcttgtcatacttctgcttccaaacagccctcttttgtttgtgctgtgaagttcccataccgtctgccatctcagcatctcctctggctgaacctccttcacagtttgtactctatgttaaattagctgttcaattcctccaggagaaaggactgtggctattagttcttagaagccccaaagagcccagtatgggcctaggcttgcactaggatcccatgaagctagctggctggctgggtgggtggatcagaccggcaaaagcactgtaggagcttgaaacccagcagaccatagaaggcactcacgcctggtgggcatttgtccagctccctgcttctaggacaaaggtttaagagctacaagtggcatgtcagttgctgttgagttcatcacatcttcagcctctagcacagtacccagtgtacagtagcgcagtaatatttgttcattgacaaaggagatacatgacaatgatctgagcatcaacaattgctgatatagatgggctgttgccaagagtctcttaattgaacatgttctgtctctgtcacccaagaggaggcaatgtggacacagtaccagagtcaccagccctagaatcactcagcaagtactgggatcaggagtgtgtgggcaggcagtggctgtctgagaactgtgaagtcctgccagggctcccatgcaagtgtgaaaattaaatgctggtgcccaaaaggcactgcccagcatgggacccaggcagcacccagctgtggagagccgcagccatgtagtcaaatcaagcatgaacttgagataaaatacactttccttcttactggtcactatgtagtataggttgagtatcccttatctgaaacacctgggacccgttttaaccaaagggaaatgacagaagtaatgttgctccagttccaggtgtaggccttaagagtctagcagttcaactttggctctctggagaaacctagttgtcatgtgagaagtccaagtaccctgagaccaccatgttttgaagaggcccaagctggccacatgtagagcatcaaagagcccggacaagtgagaatcaaggtcacagacacaggcctggtgaggtgttctatccccaagctattcgagccatcccagcagattccatagagccaagatgagctgaacctgctaagtcctgacaagctgcagaattatgagcaaataataaaactgttattggtttaagccagcaaatttaggggtttgtcatataagagataaaccaaaatgccaattcatttgcttttctgcttaagccagcttgagctgggcatttgtcattttaacaaaaaatgttctagctgacagctttggtcttgacgggcaatcagggcggaacattcccctccccttggagtgcttttcagttccataagtctgtgagacattgtattacatcagtcccctcaagaagcacaccagaaacccttacctgcaagtcacagttcccctgactacccaagagcacgtacaggctgagccaggctgtgctgagggctcagctgcacaagtaaccaattacagcccatgcgctttagatcatgcccactcacagcatcaactgcatgttttctcactcagtctctgtttgcagatttctactatgtgccaggcattaggctaagcaatgagaaagtaaagatacataatcatacaaactcccctagtaagatgtccactgatggacacttcacaagcagaaagccacctgactcagcctcgggcttcctgcagaaataataactgaattgggtcccaagggttgagtaagagttagccagaagatcgggtgaaggagagggttttcaggctgaggggacgcacggcatggaatcaagaaataggctgatgtaatgttgcagagcagactgcaggtagagagtgtgagaaagaagaggagacagagatggctcagcaagcatcagtaaggagctgagacatttctctaaaggtactttcaaggcagggtaatgccaaggtcagattcacattctggctccacaatagcagtgtggaaaatgggggtgggggcctcaaggctccaggggaaggcagggatggaggctggcaacaagtttgggttttggcattaaacatcatgggctgaatctttagccctgccacttacccagctacaaagccttgagattttattttattttatttttattattttgagaaggcgtgcctggttcattggcaccaggtttcctttcctagtgctatgcagattagatgaaatatggtaggggacctacacagataccagcgcagtgctggctccccgcctccttacagcactaggcctttccatcccaaggaaagcagtcactcacattccattagtgggaatgaaactatttatttatttatttatttatttatttatttatagacagagtttcgctctgtcgcccaggctagagtgcagtggcgtgatctccactcactgcaagctccgtctcccaggttcacgccattctcctgcctcagcctcctgaatagctgggactacaggtgcctgctaccacgcccagctaattttggtatttttagtagaaacagggtttcaccatgttagccaggatggtctcgatctcctgacctcatgatccgaccacctcagcctcccaaagtgctgggattacaggggtaatcccggccaccgtgcccggccaggaatgaacctcttctaaagggctctctgaggtggagctaaggaaagggaccttctggctgagctagttagacaactcttcctgtggcacagcatgatgatgacaaagatgagttcccaactacctccagtgtctggcctttctttgtaatagagacagaaagaaaagacaaattaacacaccctagactctagagacaccaagcaatcacctatccttagatcaaccccagatcagaatgttgtccctgcacacccaatacacagccaatatagtcagccactgtctactgtctggggatttgctgatttgacaagagcagcacaaatgctttccacctggcagggaataaagaatacattaaggaagctgggattatgacagggcatgctcaggtagaatcgtaccctccttcacactaggggaaagattcctagaagaggactaaacatgggaacttaaactctgagcacagagaggtggccagaggcaaagcagagagggcacaatggagagctgctggcccttccctctcagcagtcccacagacctttggtttggctccaaaaagtctctgggcttttatgttctgatagttcattgggtagagctgactggaacacatgtgcatatgtccttttggaatgaagcttgggaaagttgaggcttttgcccagtgaatgttgctcctgggaacacttcctgcactgcccaatagaacttggttttaaccaatgttgacaaatttagaattaaaaataagaaaatgtttgaaacatttattaaatgaaacagttacagaacaatactaaaatataaggtggggccggtcatggtggctcacgccggtaatcccagcactttgggaagccaaggcaggtagatcacttgaggtcaggagtttgagaccagcctgaccaacaggcgcaccattgcactccagcctgggtgacagagtgagactgtctcaagaaacaaaacaaaacaaaaaatatataaggtgggtgcaaacaacacaaacttatttatttatttatttatttattttgagacgaaatctcactctgtcacccaggctggagtgcagtaacgcaatctcagctcactgcaacctctacctcctaagttcaagcgattctcctgcctcagcctcccgagtagctgggactataggtgtgtgccaccatgcctggctaaaaagtgctggaattacaggcttgagccaccccgcccagctacaaacaacataatcttaaatgtagaaaaccctaaaaattccacagaaaaactattagtgctaataatgaattcagcaaagttgcaggatacaaaatcaacaaacaaaagtcatctgcatttctatacaccaacaatgaacaatctgaaagggaaattaagaaaacaattcaatttacaacagaatcaaaatgaataaaatttgtaggaataaacttagcccaggaggcgaaagacttgtacactgaaactataaaatataaaacactgctgaaggaaatcaaagacacaaataaatgaaaaaacattatatatgtactcatggactagaagatttaataactttaagatgttaggctgggcacagtggctcatgcctgtaatcccagcactttgggaggctgaggtgggtggatcacatgaggttgggagtccaagaccagcctgatcaacatggagaaaccctgtctctactaaaaatacaaaaattggccggacatggtagcacatgcctataatcccagctacttgggaggctgaggcaggagaattgcttgaacccgggaggtggaggttgcagtgagccaattttgtgccattgcactccagcctgggcaacaagagtgaaactccgtctcaaaaaaaaaagatgtcaaaactcttaaaagtgatttgtaggcttaatgcaatccctatgaaaatcccaatggtactttctgcagaaataaaaaaaaaaatcgatcccaaaattcacatggaatcttaagggactctgaacagtcaaaagaatcttcaaaaagtacaaagttgaggatctcgcatttccttatttcaaaacttactacaaagctacagtaatcagaacagtgaagtacaggcatagacagacacctagaacaacagaatacagagcccagaaataaactgttgtgtatatgatcaaatgattttgacaaggggccaagaccattcaatggggaaagaacagtctcttttacaaatggtgctgcgaaaactgcacatgcaaaagaatgaagttggatccctatctcataccatatacaattaactcaaaatggatcaaagacctgcatatatatcttagaaggaaacataggggaaaagcttcacaagattggatttggcagtaatttctttttcttttttctttctttcttttctttttttttgagacagcacctcattctgtcgcccaggctggagtgcagtggtatgatcttggcccactgcagcctcaaccttccaggctcaagcaaccctcccacctcagtctcctgagtagttggggactgagggcacaaccacgcctggtgcgcaccaccacgcctggctaatttttgtatttcttgtagagatggggtttcaccatgttgcccagactggtctcaaactcctgagttcaagcgatctgctacctttacgtcccaaagtgctaggattataggcgtgcaccactgcatctgaccatgaatttggcaataatttcttagatatgagactaaaggcacagacaataaaagaaaaataaactgaactttatcaaaattaaaaacttttgtgcatcaaaggaaaatatcaacagaataaaaaggcaacccatagaatgggagaaatatctgcaaattacatatctgataagggattaatgtccagaatatatagagaaatcctgaaactcaacaacgtgactcaaaattgggcaaataacttgaacaggcatttctccaaagaagatatacaaatgaggcacggtgcaatggctcacatctgtaatcccagcactttgggaggctgaggtgggtggatcacctgaggtaaagaattcaagaccagcctggccaacatggtgaaaccccatctcttctaaaactacaaaaattagccaagcgtggtggtgggtgcctgtagtcctatctactctggaggctgaagcaggagaatcacttgaacccagggggcagaggttgcagtgagctgagatcgtgccattgcactccagcctgggcgacagtgtgagactctgtctcaaaaaagaaaagaaaagaaaagaaaagatacacaaataaccaacaagcacatgaaaagatgtcaacatcagtaaccagtagagaaatgcaagtcaaaaccacaattacgtattacctcacatccattaagatggctactaacggctgggtgcggtggctcatgcctgtaatcccagcactttgagaggctaaggtgggtggatcaagaggtcaagagatcaagaccatcctggccaacatggtgaaaccccatctctactaaaaatacaaaaattagctgggcatggtagcgtgtgcctgtagtcccagctactcgggaggctgaggcaggagaatcacttgaacctgggaggcggaggttgcagtgggccaagatcccgccactgcactccagcctggagacacagtgagactccgtctcaaaaaaaataaataaataaaaagatggctacttacaaaaaacctcaggaaataagtgttgatgagggtgtacagaaattgtaactcttgttaaaaatataattaccatatgacctggcaattatacttctgggtatataaccaaaagaaagggtcttgaagagctatttgtacacccatgttcatagcagtactattcactacagccaagaggtggaagcaacccaagtgtcccttgaccgatgaatggatgaacaaaatgtggtatatatccatacaatggaatattatttagccttaaaaaggaaagtagttctgatgcacactacaatgtggatgaacctcaaagacattatggtaagtgaaaaaagacaaatgtcataggattccacttatatgagctatctatgaatagtcaaattcatagaaacacaaagtagaatggtggttgcctacgtctgagttgaggggaaaatagggagttgttgcttaattggtataaaggtttgcaagatgaaaatgttccggagactggctgcacaataatgtgaattgtgacagtactgaattacatacttaaaaatgattaagatagtaaattttatattgtgaatatctgaccacaatttttaaaatgctaataaaaaccaaacaaaaccaaaaataaaaataaataaaatggaggagtgtaggagggaggtgggtgtaattataaaaattgttggcggggtgcggtggctcacacctgtaatcccaacactttgggaggctgaggcgggtggatcatgaggtcaggagattgagaccatcctgactaacacggtgaaaccccgtctctattaaaaatacaaaaaaaaaaaattgccaggcatggtggtggcaggcgcctgtagtcccagctacttgggaggctgaggcaggagaatggcatgaacctgggaggcggagcttgcagtgagccgagatcgcgcctgttccagcctgggcaacagagcgagactctgtctcaaaaaaataaaaataaaaaatatataaaaattgttggaactgttcagcatctcgactgcagtggtagatacatgaacctgcacaggtgacaaaattgtatagaactaaacatacacacgcacaaataagtacaaacaaaactggggaaataaattttaaaaaataggtagcatatgtcaatgtcaactatagttttgcaaaatgttaacattgggagaaactggactaagtccagaagtaccttctcagtatttcatacaattcggtgtgaatctataatcatctcgataagaaataaacacacacacacacacacacacacacaaggcctgtttttaaaaaacgatatatatgtgtgtgtactaatatataaggcagtagaggtaaatatccaaacaccagaggttaggtcataataaaaatgattcttttcatgtgcaggtgacaatatgcacactctataacaagcaatccctctggagaaactcatcagccaaacacactaatgtgacctatatgcaagtaactcctatggctgactgccttctagacacctcaccctgatcttctctataacggtctgatctttccaagaaacctgctctacccactgtctgccccaacacagttaaggccagaccttgagaggagaggccaacaatccttgcacaatggccaccccgcccccacgacttttctgacctcatctcctactaacccccaccatcgctggtcttcctcttttcttggactgtaccaggtgcgctcctatcttgggccttgtactgactcttccttgcctccttcaggtctttgctcaatgtcaccctcacattgaggcctactctaacaactttaatttaaaggattatttccccaatgtggcacaacaaatccccttagtcctgatctatttatttcctcgggaatttcttacatattaatttcctttattgtatgtctgtctactctgcccactagaatgtaaactccagtaagtagatcagctcttttgtctgttttattcactaattcatcctcaggacccagagctgtggcttggcacataacaggcacaacaataaaaacttgttgctgttgaatggctggagaaagctcatgacagaagcactacattcaaacaccttcagtatcactggtgtaacaatctttggaaggcaggctcctgatctactgctgtggggactcagatttcgccaactgcctgcaggtgggaagcacacccttggctggttcacagccatctgctgctgttatctctaccactttcgaccacaaaaacttatccccatcttctttagtaagcatgacacaatgacatctcataggtgtcagatgcctaagagattgaaaacatagcacaggaaggaagctgttgcaccatacaaccattgtgtgtgtgtgtgtgtgtgtgtgtgtgtgcacgcgccacaaactaaagtggaaaagtgtcacaggtatatcatttaggagaccttaatcacttctcctgaagcatctgccaacatataatcaacaaagttttgagattgggcgcagtggctcactcctgtaatcccagcactttgggaggccaaggcaggcagatcacttgctctgaggaattcgagaccactttaggcaacatggtgaaccccatctctacaaattaaaaacaaaaaacaaaaattacccagtagtggtggtgcaagcctgtagtctcagctactcaggaggctgaggtgggaggatctattgagctcgggaggtcgaggctgcagtgagccgtgatcacgccactgcactgcagcctgggcaacaaaaaaaactgtctcaaaaaaaaaaaaaaaaaaaccaaaccaaaacaaaaaacaaacaaacaaacaaaaccccaaaaaacaaaaaagttttgacgaaaggcatttctgtttcttaatacttctttcccccctcattttgcaaaacagaggtattccctaaaaagtatctgcacaggaggattgcttgagcccaggagctcaaggctgcagtgaactatggtcatgccactgtactccattctgagcgacaaagtaagaccttgtctttaaaaaaaaaagttatctgcaagggtacaatgtatattattcaggtgatggttgcactaaaagcccagacttcatcactaagcaatatatccatgtaacaaaactgcacttacatcccttaaatttaacaacaaaaagttatctgcaaaatgtactcctataaatctagtcccttccacctacttccattagaaaattaaaagctacatttccatagtgggaaaaatctgctagctcaacaataaccacaattaagaagacaacaaacctacaatactatttaagtgaaaaatgcacagcaggctgggcgcagtggctcacgcctgtaatcccagcactttgggaggtcgaggcgggtggatcacctgaggtcaggagttcaaaaccagcctggccaacatggtgaaaccccatctctactaaaaatacaaaaaatttattgggtgtggtggcaagtgcctgtaatcccagctaatcggaaggctgaggcaggagaatcgcttgaaccctggaggcagagattgcagtgagccgaggttgcaccattgcactccagcctgggcaacaaaagcgaaactccgtctcaaaaaaaaaaaaaaaaatgcacagcaacattttagctatgccagttatctgtacaatgcaaggtctgtaagggaggctacacaccaaagacattggatttgctatggtgactgatggggatttggttaaagtcttaaaaaaattcagacacttgtataatgtgcatacactaaatgcgtcttctaaaatcacaaaatcacccagttgtttttttccaaatggtttgaaagaccacattaaaagttttaacaatgtgttttcctttgtgcattttctaatttttcctaacttctttcacagtcttactgagctcagtagatagcaactctgcccttagactggaactcatccttctgttctctcttaactcttttgtgtgtgtgtgtgtatgagatggagtcttgctctgtcacccaggctggaccgcagtgatgcgacctcagctcactgcaacctcccactctgggtttcaagcaattctcctgcctcagcctcccgagttgctgggactacaggtacatgccaccacacctggctaatttttgtatttttagtagagacgcatttttgccatgttggccagactggtcttgaactcctaacctcaagtgatctgcctgccttggcctcccaaagtgctgggattacaggtgtgagccaccatgcccggcctgttctatcttatctcataccccatatttgaccctaccttcccaacatacccataacccaaactttcaggagagatgcaaatgttccttaactttatcagggaacaggttacaaagtacattaacttgtcaaaagtcaacacattatacatttaaggtctggacattttatttatacctgaaaagaatgtgtttatatatacacacacacacacacacacacatacacatatatatatatacatatatatattacatatacatataaacacatatatacatgtaatgtattacataaacacacacacacacagagtctcccccaccagctccaaccatttcttgccatcacagccatcaccatcctgatccagaccatctcttgcttggattactaccagtagttggcattataactggtctcctggctcctccctccctctggtcccccacaaccaatctagtctccacgtagcagtcagaaagatctctaaaactcacgtcagatcacagtagtcctctgctccccttgcagtgagaatcaaggccttctagtagcctactaggctctcccaatcagtctgctattcactctctggcctcctctctcacagcccttgccttgctccaaccacaatgacatctgtgctactgctcaaaccctccaggcaagttccagctcttctttctgcctggaatgctcttccctcagatggcaccttcctcatctccatgaggcctgcagcgaatgctgtggtatcatgcccaggtccctaccctccagggactaaagcacactcccatagctatctgtggagtgttggcagccccaacagctccctgtagtcttcctccaggtcagacctgccctcagtggaagcactcttttggcagggtcaggtctcctttccaaaagagcctatatccaggctgtggacacgggagtaaagggccctggtctcccaccccaatccacgacaattctgaagggcctccccagctacagaactcccagcagggctggctgcggctttctctgtgcttacatcatagcttgccttctccctctgtctggtgctgcttccttcactccttcaatggtgtggatcccgagagccctccccaataatcctgcatgcaaaaatctgcagctcagaatctgactcctgcaacaaggcctttgctcaaatgttaccttttcactcaggctttgccaaagcgtcccacttaaacccgtctatcccccgcctctgcctcagcattcctcatctctaagtctgctgtttctccaattcacaggatcttgtttgtgattccgctatgtgtctcaccaggaagctcccctcccacatctcctcttttccacttacacaggaaacccccagcagatcccatcccagtctcactggccaggatgcataacaggctgctcctcaagagcctggcatgctgcttggttcactgctgttttaagagctgaaaacatacacacactgactcacacacatgcatacacacacacacacacacacacacacacacacacacacacacatattttcagctcttaaaacagcagtgaatttatcaactgttttttccatgtgagaccttctgttagaggatgcagcagacctggagtctgctccaacgtaggtctatccctggacctcaaataaggcctgctgtcccttctgtctggtcttcaccacagtggcttttgccagggtagcctcccagggaattggcctaccctaggtttgttaatgcatcgaggcagacaatgcttttaggagcaacaaatgttaatctaaatgggttttctttttgccaggagtgttttaaaaccatttgctatctgtttcatccacttcctttcctaaaatggaaggctctagaagacagaatcatgtaaatgaactccttgggtaaggcttgggcagaatgtttcccctcatcattggaattgccagcagattccactagaaagagccagccaggatgaacaagaagtttatttgcagtacatcaactctaccagccaaggacaacagacactgttagctgcccatccatcagccactttccatcaccaacttccagcactcagcactccttcaacatttactgagtgactactatggtgtgtaccaagtaccattcctggccctgggaaaagggcatgagcaaagacaaagtctgttttccaggagcatatgctcccccagggaggtgtctaatagaactccagttttattcagatatccactctgcccgttatgtaagccagtaggcaacgatgattgatgcaagagagggcacatgacctagttggaccaatcagccaatggggaagacccaaagtccaaggctggggcacagacctctcccttctgcttctcactgaaaacattctcgataccccacaaccagagaactcttgaaaatcaaatgccagaaaaggctcaccaagcacatttcaagagaaacctaccaggttagaagccccaaggcactcagaatggctacagaagcagtcagaggacaagctccagggaccagactcctggtcccatgctgtaccacgtggtttctgaaagctgtccttctgaggaggaaatgggcctgaagctctccaggacggagtggccagcctcagcacaaagaccagtgcttagcaaattagaaagagtaagtctgggcttgggctggagtctaagtgtgactctcaacacatctccatcacatctagtggaatcttggtgccagggggtcacctcatctcactcagcctaagtttccatctgtgaactgtaatgctgcaagtcatagagaatttcgagggtaatcttctatcgtatataacaagtcctgagataggtcagcttcagggtgcattaatttagcaacttaaagagacgtgtccctctgtcttcctctcctgtcatcagtgtcggccctgttccaagctggcttttacacgcagacctagtaaagtccagcagaagagactagcctgtcaagcatctcctcttatttaattccctaggaggtcccagcagacgtcccctcctagtctcaagggccaaaatggcatcacatggctgttcctcaacaaatccttggcatttacccacacatcagcttagggctatcagcaggttggcctgcagaaggcagaccaaaaaaattggggttctgctaacaaggaacaaggcaggcaaccctacaatatttgcaacactccctttgtgctatttgacaatatgcacaatgttcacaatcccactcacttctaggtgttgttgctgactctggcaggatgataaaatgtgctttgcataaatttttggtccccagggctcattccatacctctggttcatgtgctagacacttctgcagtccataggcaaacaccccggatgaacagaacatgctagcaacctctggggaaagggaggggtcaagccagacacagagcatcctcttcctggtcaccgacaggacccaagatcagcacagtggaagcaggtctcctacttggcttcagtggtcaaggccagacgctcctcagaagtccctcccagctgtgtaactatgattctgctcataaagtgaaaatagttttcaaccacttcttagagtaaaacaaatgtttaagaaaatcccatttcctggccttcatccatattctttctgcagcatattaaagaaataaattcagagagaggctgggagcggtggctcacacctgtaataccagcactttgggaggccgaggcgggtggatcacctgaggtcaggagttcgagagcagccaggccaacgtggcgaaaatgtgtattaaaaatacaaaaacactaaataccgaatactaaaaatacaaaaattagccaggcgtggtggcatgtgcctgtaatcccagctactcgggaggctgaggtaggagaatcacttgaacccgggaggtggaggttgcagtgagctgagaccatgccactgcactccagcctggcctgggtaacagagcgagactctgtctcaaaataaataaagaaaatatataagtaaataaatacattcagagtggcccaaatctacagtcacctgcctacatggccaagtcccattaattctacctctaccctgtctttagtgcctctctatttctcacctccatcacctgtgatctccctgtctccctgagcatctcaccaagactagaaattcctaactcctctagggcctgcctaagacacaggttgggtgtttcatccagcttcctcagaagcctcaatgttctcctctctcccctaaccccaagaaggaagttcaagctgctggcaaggctctgcctcccagccccattctccctcttgccctgtttagcctccctcctaacatgttctatgtctttccctaaatgctttcaccctctgggccttttctcctgatggtctcatgtgctgtagcgccttctctgccatcacaattctagtcacgtcaaggttcagtccaaggacacatccacaaacccgactctgctggtgaagtgcccttcctccttgggctatcacgcttattcctctagctcctgtttcccctgccctgcattctagaatacggtttgtatgtcaatctctctcatctatcttccacacagctttctgttcagagagagagccttatttacctctggtccccacagaactcttaccagaaaggttcaatgtttgttgcataaatcagtgaaaaatccacagcaaaatctcacccagttttcttctgactcttcagatgtactctggttattttcctaaatcaacctactgtcttcaggcataagtcaggagagaaattgctgagagaatttgcattttctgagctaccacatggagcaggtgaggcaagaattactgacttcatgaacagattaggaagagatggaaaaactttttatgtcacatatttagtaagcagcagggcacagagactccagagcaggatatctgattccaaaaacagaagacaaaattcttgtcctcaagaaacttacagtctagtcggaactgtaagacaaatacaccaaaaggcaaataacttattcagagcggggtttctcacccttagcactattgatatttggggctagataattctccatgagtgggctgtcctgcatgctatacgatgtttaacagatttgtcccctacccacttgataccagtagcacgtaccctgcccaaccctgttgtgacaaccacaaatgtctctagacattgccctgtagaaccactgatctaaagcaactgccatgtttatctctcaaccactgcaatcatataacctcaccattaggatcctttccctgccaattctcagacataggtctgcagtgccctccggcagcaggctggaccttacccacccactcctaactttatcattatatgattctgcctacattttcccttcaagctgaattatttaattttcatgctgatgtctcagtaggacagcttcaaatccttttcagaatgacacaaggtaggggtaaaaataatccaatcgcaggacaggagaaaatacacaccataaggccatgtgattaccagcaaattaccctgttcttgaaaatttcccaaatcccttttcataacactgccatcaaagtgtgaaccaaaggccaaaggtggacaagagctctttcagtcctggccctcttggttagaactggcttcaccaaagagctgagcataagcgctgtctgcccaggcatgagaattccagaaaaaactcaggagcaaaggcccagagttgggaagagccatgaatctcaacgagattttctaaacatacaaactccatatttctacaaactttaaaaccagaaacctagttgtttttactttctgaccttaacctaacttagaaataaagcttattttggtcaattctaaaataaaatatatagagaatactgtatccaagaacacgaagtaaaatgtgtatgtatgaacaataactgacacatcttctatataaatgatagctattatatttcaatttaacaatcttttatatttggtcccaggataaaatggaagaggtaagtcttattttaccaaggcccagaagtagagttataagtccaagaatttacagctagtaaatgatgcagttttgaacccagtctgattccacattcaaggctcatttcactacaacgtgacaacttcaagattaacttattgataaccttagacaagtgcttctcaattgggggtgattttggctaccaatggacattggcaatgactggagatatttttggttgatacaactagaagttgtatcaacttactctaagaaggtgtttgtgaagtgctactggcatctggtgggtagaggccaaggatactagaaacattctataacatagatgacaatcacacaattttatggcccaaaatgtcaacctgctgaagttgggaaaccctaccttagaggtgtctctattatcagccaagaaaatgaagaccaaagtacacccacatttcaataaatacttcttctcctgttctagctaccctctccactttgaatggattccctgccacaccagagaaaaatgctgagctgtctgctacttccccctttagactctcgaaaaacagaaaaagtatgttcatgctgggtgcagtggctcacgcctgtagtcccagctactcaggatgctgaggcaggaagatcccttgagcccaggtatttgagtctagcctgggcaacactgcaagatcccatttctattaaaaaaaaaagttatgtttgtgcttcacaaaattggagacatgaatatagaacaaggaagccagaaagtgcaatgatggctttacaaaagcaagcacaattttactggccactacccacccctcaggcttccggctgagcagcccctgctcccagcagccaccaatactcctacagtatttaaaggcctgctcggtagtgattcagaccagcatcatctcctccagggcagtggtaatttacctcttgacagtccttctgaacattccatgagattttaaaagaaaggaaatttaacaaagaacaagtttaaaagaagttaaatcccatcctgccagagttgccatatctttttttttttttttttttttttttgagatggagtctcactgtcatcaggctggagtgcagtggcgcgatctcggctcactgcaacctctacctcccgggctcaagcgattctcctgtctcagcctcccgagtagttgggactacaggtgcgtaccaccacgcccagctaatttttgtatttttagtagagacggggtttcaccatgttggccaggatggtctcgatctcttgacctcgtgatccacctgcctcagcctcccaaagtgctgggattacaggcatgtgccaccgtgcccagcctctttttattattacttattatctcagatttctaaagcacttaacagtttggggagcatttttatatctacgctcccaactgagtatcacaagcatactatgaagtggttagagtagatattatcatgctccattctagggctgtagagaggccctcagcaataagggccactgttgtgcttgctctgccaggctgatgcacttggctgctgatctgagtgtagtctcttattcatttgtacctagttcgtcacttaagcatcttgacttacttatgtttacatagcataaaacttttggcctacaaaggagcttatcaaaaaggaacaagttatatgacagtagaagagaggctggagaagggtaggctattcacaaaaactgatttaggtaaagcattttaaaataaaaattctatcagaccttcacacagtaaactagttcataataacatttttcctttcctaatcacaagcatcataattcataattacaatatttgtccagttctccagggaaagatctgcacagtacacatcaggaaatgctcttggagatcaacaggagaaatgaaactaaaactcaaggcttcggctttcatgcacagtaaacctaacttcatcttgataaattatgaaaacctcagctttcttacctgttttagccaatatttatcacatacccatcatgtggaagaggttgttcaatgcagtagggcatacagaagggactgaggcagtccctaccctgggggcatatggaaagtaccctcacaccttccatgccaggcaaaacacacagacagtgatacagcacatctaccggggtaactcaggatgaacagtttcaaaagaaacacgtgaacctagtccctgaaaaatgggaaagatgtcacacaagatggaaggagagagaggtggcaggaggagaacacacacatgatcagttcagtttagttgtggtagtagagagcatcctgggaccaaattcaaaacgaaaaagccacatgttaaaatatctattctcgctcctaaagaaaacggtagcaccctgtagtcgcactgcaaagtagaaatgaggaacaagacagcatcagggtgaccctttgcctgtcaacagtcagacaggccagaatcaggccctgggctggaggagtctccctgggttgatttctgtgctacagtgctgtcagcagagtggggtgggggagggggaggcgcgcttttttcatctacccggggagcaaacaccaactcctgcagcagttctgccaacaaggcagaactatgacgaaactgattaccactagcctctctgtatcagagtcaagatatggggtggatgagtccgttccccaagggtgtgctttggagccactgccacagagctaagaagcccctctgctagaacacacctgtgccctatctgcccaaccctagttcaccctgatgtcccagctcagcattaatcgtggatccttcgcgggggcccggggcccccaaaccctcctatttagggaccacaattccccaactgggggcactgtccccagatccagaggggcagtaacagtccctcttgcagatttcggatcttcatcctgccactgaaaggccacaagggggatttcatcccggtttcaccttcaggaccgtctgagcacttctcgggcgatgcagaccagtggaaggcactggctggcaccaaggcccgctcctgggagccaggccgcggcccctccaaggaccacaggtgggcagcggaagactcagagcaagagccaggggcgaagatggccctcgctgcggtcaacccggagcacgtgctggggctcaccagcctctccgcgctgaggacaaagtccgctcccgccggcttcttggcttgggcaccgggtaccgggcgtcaggggcgagacaggcaggacttgcgcgcgccccgactcgactccagaccccgacccgactccgggctcggcctcccgcgacccctgcgcgcactcaccattgtggttgacccaggtcggcttcaggagcttcattgttcggccgccgccgccgccgggctgaggcgagcgccgggtccctcagcgcgcccgggccatggagccaccgccgccgcttcctcccgcgccacccgccctccggccgccgcccgccccgcgccctcagggccgccgcgccatcgccggcccgcgcccccctccgccgccacagccgccacccgcgctcggccgccgccgccgccaccacagccgcatcccctgcgccgctcctcctcaggcggctcccgggcaacgccggaagtcacggcgcgcacctgccaaatcgccccggcgggaaaccgctccccacgcggactgggccgccccggctcctccgctggcaggggcttcgggtcgggcccgggcgcgggcgccccagaaagggcggttcgcctggacggcggacagcgagcggggcctgcagttgcaacccgggccgcccgcagaggcaggcggggcccaggtggcgtggaccgcccgtcaccagctctgcctcgccagtctgagtccgacttattaactagcttccgtcattcatcaacacgcgctattgggcatcttgcgagcgccgggctccgcgccggcgccggaatgcgatccgggcttcggactcgaacgaatgcgggggacgagccaaccctggtgggggaggctggggcggacgcgtttattagaagatcggggccgtttgcctagacatgaacatttggactcggaggagcagagggacgccccctcggccgctccggctgcactgcggagccgaggcccgcgcgagggcgcagaccgaccaaccggctagggcctgactggctagactgtgcccgctgcagaggcgcgctcccagcacagggcggggacggaagggaggaccccgagccgcgtgaaacgcaaggccctcgtgtgtgcgcagctgacaccctaggcggggctgcgtcgggggcggggacaggcgcgtcccagcccacgcagccggaacgcctgagcgctgggcgcctggtctgccggacctcagcagggggcaccgcgggccggactgtggaggggcgcacgcccggaagcggcgagggtagccatgacggcctccgtgctgcgaagtatctcgctagccctgcgcccgactagcgggtgagtgcggacgctggccggatagcggagtgcccagggcgcgtgcggggtcttcgcgactgtccgccaggactcgcctgtgctccctgctcgcctcccagtccacgaatatctcagggatgagccatctggtcgtgactcttatgcatgaaaatctgagcaccctggcgagcagcggtcctgcttaagtcctctgtggtctgaacgaaagattttgaaaaaccttccacgttgaccttgctgtcatatcaagtagttagaagtgccccgggtttgggagcattgcaattttttattttcctgtgaagtgggagagaatcagatatttatttatttatttgagacagagtctcgctctgtcgcccaggctggagtgcagtggcgcgatttcggctcactgcaacctctgcctcccgggttcaagcagttctgccccggcctcccgagtagctcggattacaggcgcccaacaccacgcccggctaatttttgtatttttagtagagacggggtttcaccatgttggccaggctggtcttgaactcctgacctcgcgatccacccgcctcggcctcccaaagtgctgggattacagacgtgagcaaccgcgcctagcctggagaagcagatatttatacatactcttgtatctttcaggcttctgggaacttggcagacgcagcttagagagactcaccagcgagcgtcattgttgtctttctgggaactcattcccatgaggtaaaactcaatcgagggcctgacctctgggggtaaaggtgtcagtctatgtgtagagaacaaagcaagaatgctggatgtgtggtttgcaaaattaacagcctacaaagtttctcagttaaatttaggccgatgcttttctgtttttccaacattttccaaaccatagattgttgtttgtaatttttaaaatttgagcagtttctcaagaagtaagtattctccttgaagggattcttgtgtgttttaaaggacacagcttaagtttctgtttctccatgacccttcctcttccctgcccattcggaggccctggagagtgtggggaagatgcaagtattaaaggtatttccatctggcactctcgactctttgtagatacttgattcagtcaatcttgatagtaaaggatttgatttttcttttttttttgagatggagtctcactgtgtcacccaggctggagtgcagtggtgtgacctcggatcactgcaaccttcgcctcctgggttaaactaattctcctgcctcagcctcccaagtagctgggattacaggcgcccactaccacgcccggctaatttttgtgtttttagtagagacggggtttcaccatgttggatgttggtcaggctggtctcgaactcctgatctcaggtgatccacccacctcagcacccaaagtgctgggattacaggcctgagccaccgcacccagtccacaaatcaattttaatagtaataagcttctaatctaacagtttggtattttcacttttgagtgtaatcccaaggcacacctgaatcccagcaataaagaggaacacttcccgattttataccctgatgcctcttgttgcttttgtacttttttttttttttttttttttttgagacagagtctcgctctgttacccaagctggagtgcagtggcgcgatcttgtcctactgcaacctccgcctcccaggctcaagtgattctcctgcctcagcttcccgagaagctgggattacaggtgcgcaccaccacacccagctaatttttgtatttttagtagagacagggtttcgccatgttgaccaggctggtctcgaactcctgaccttgggcaatctgcccgcctttgcctcccaaagtgctgggattacaggcctgagccactgcacccggctgcttttgtactatttcttgtaattgatggcacctacacagttctcacaagtactgtggggtggagtacctcctcaccacgctgagctcatgagttagtcatgcacagctccttcccccagtggagaggtcagtatggggtacttaccatcttgtctctcagtaggttcatgagaccaaagaggaaaatgtttaatatttgctttatctattagatcagaacctcttcgaaaaaagaagaaggtagatcctaaaaaagaccaagaagcaaaggagcgcttgaaaaggaagatccgaaaactggaaaaggctactcaagagctaattcctattgaagattttattacccctctaaagttcttggataaagcaaggtaaggatccttctctagggatgaagtcctcaggacaaaggagtaatatcaacttcaggtagttgtgtctgtagttcacacctgtgatagtcattggtcagtaggcttgagctgacttggccctaatgagtccttgctccttttggaagcaggagaaagcatccttgggtggtactcttgaatggctctgggtgggaaagaacctaagacatctaataatccagatgcttaagcactgctctggagttcatgttgttgctgtcatgcatgaggagtcttggctgtttctgatcccttgggcctggagtctgaagccctcgcctcatcctaacagtagaaaacccttggcctcctgttttatcatgcagatatctttggttggtatttgttgggattctactgtgtgcagggttaacagctcctgctgccgttttgtaagcagtgtgcaccatctataaaggggcaggtgttaaaagtcttctctcacccaagggagtatttgcttgggcagaggaagtgctaccagtctcctcagatcatctgttcttttgacagagagcaaatgaccttggttccaagcatcagttgcagctgcagccacattcaacattccatttcttaatttgtcccaaacttgttttatctcctaagtcctgtctgtgtctggcaatgggaatacttgtgtcagttgcagtcacagacttacatgccagtgagattggtaacccttagcttctttgcagagagcggcctcaggtggagctcacctttgaggagactgagaggagagctctgcttctgaagaagtggtccttgtacaagcagcaagagcgtaagatggagagggacaccatcagggctatgctagaagcccagcaggaagctctggaggaactgcaactggaatccccgaagctccatgctgaggccatcaagcgggatcctaacctgttcccctttgagaaggaagggccacattacacaccaccgatccctaactaccaaccccctgaaggcaggtacaatgacatcaccaaggtgtacacacaagtggagtttaagagatagacttgcaggctgctatccttaacatgctgcccctgagagtaggaatgaccagggttcaagtctgctttccacagaatcaggcatgctgttaataaatactggtttaatcaaaatgctcctttgtcttgtgttagaattttttttaaaaaatttttttttgagacagagtctcactctgttgcccaggctggagtgcagtgacgcaatctcggctcactgcaaactctgtctctctggttcaagcgattctcctgtgtcagcctcctgagtatctgggattacaagtgtgcaccaccacgcgtggctaatttttgtatttttaggagacagagttttgccatgttggccaggctggtctcgaactcctgacctcaagtgatccgcctaccttggcctcccaaagcactgggattataggcatcagccaccacgcccagccagaattaaaattaattcaccaggccaggctcagtggctcatgcctgtaatcccagcactttgggaggccaaggcaggtggatcacgaaatgaggtcaggagatcgagaccatcctagctaacagtgaaaccccatctctactaaaaatacaaaaaaaattagctgggcatggtggcgggcgcctgtagtcccagctactcaagaggctgaggcaggagaatggtgtgaacctgggaggtggagcttgcagtgagccgagatcacaccactgcactccggcctgggtgaaagagcgagactacatctcaaagaaaaataaaaagtttattcacctaagatggatggaggtgacagatgctgcccttcgccaggtaatgggaagaagataacaaagacatcaactgctgccctcaaatggggaaaaaaaaatgtgtaaaaagaagatcccaagggtatagtgaaaataccaacaggagtcagagtaacagaggagtggtgggaaaggaagttgccagctggaaaggcatgtggagaagcagggccttcctgatgggaaagaccaaggagccacctttgtgttttcagctggggttagggggaggcagaagagtgtggagcaggccaggaacatactagttaataaagatgctgtggcccccaagagggtgtgaggcctggctggggcagcggactctgtctcaagtgcttagtctagaatgtgaatgtattagtctgctcaggctgccattacaaattaccatagactgggtggcttaaacaaaataaatttattttctcacaattctgggggctagaactcctgagatcaaggtaccagcaggcttgttttctgagtctttctccttagcttgcagatggctgccttttccctcacatggtcgtcccaatctgtttcctaattttttatagacaccagttatactggaatagggcccacctaatgacctcattataactttaattatctctttaacgatgctacctccaaatacctccaaatacagtcacattctgaggtatggggttggggggagtgggagggtcgtatgggtaggacttcaccataggaactgtaggggacacaattcagcctgtcacagtacaagcccagtgtacgaatagagccattttccccagtggcttggatcacaacctcagaaaggattttttttttttttttttttttaccaccttagtgcaggtaaaccagggaaacatttcattggaataagaacttaggttgtcttcctagcgtgtggttcacttttttcccttttttaaaaattgtggtggccaggcaccgtggctcacgcctgtaatcccagcactttgggaggcctaggtgggcagatcatctgaggtcagaagttcgagaccagcctgaccaacatggtgaaaccccgtctctactaaaaatacaaaattagctaggtgtagtggcacatgcctgtaatcccagctactcgggaggctgaggaaggagaatcgcttgaatacgggaagtggaggtagtgagtcgagatcacgccactgcactccagcctgggcaagaaaagcgaaactccccatcaaaaaaaaaaaaattgtggtaaaatacacataaactttactatcttcatcatttctaactgtatggctcagtggtattgaggacattcataccatcagacaacatcaccaccatccatccatctccagaggtcttcattgcaaaactgaactctacccattaaaccataattccctgttcccctcttcccccaagccctggcaaccaccattctaccttttctgtgattttaactattcttaagtacctcacagaagcggaatcatagtgtttgtctttttgtaagtggcttatttcactgagcataatcctcaaggttcatccatgttatatagcacgtatcaaatttccttttcatggctgaattaatgttccattgtacgtacgccacattttccttatccatctgttgatggacacttgggttaccttccgcattttactattgtgaataatgctgctatgaacacaggagtacaaatatcccttcaagactgtgctttcttttagatatacgcccagaagtggaactgctggatcatatggtgagtctatttttaattttttgaggaagtgccatatggctttccatggctgctgtaacattatatattcccaccaatagtgcccaaggattccaatttttctttgctgtttttttggagtcggagtctcactctgtcgcctaggctggaatgcagtggcatgatcttggctcactgcaaccaccacctcccgggttcaagcaattctcctgcctcagcctgccaagctgggactacaggcgtgtgctaccacgcccagctaatatttttttttgtatttttagtaaagatggagtttcgccatgttggccaggctggtcttgaattcctcacctcaggtgatctgcccgccttggcctcccaaagtgctggcattacatatgtgagctaccacacccagccaaggttccaatttttctacacccttatcacacttttttttttttttaatagtagccatcctaatgggtgtgaggtggtatctcactgtggttttgacttgcatttccctaatggtcagtgatgttgagcatctttttatgtgctttttggccatttgtatgtctattcaagtccttgtcttttttttttttttttttttgaaacagtctcaccctgttacccaggctagagtacagtggcgtaatctcggctcactgcaacctctgcctcccgggttcaaacaaatctcctgcctcagtctcccaagtagctgggattacaagtgcatgccaccacacctggctaatttttatatttttagtagagacggggtttcaccatgttggccaggctggtctcgaactgctgacctcaggtgatccgcctgcctcagcctcccaaagtgctgggattacaggcctaagccacagtgcccggccccttgcccatttttgaactttttttctcattgagttttaggagttctctataattctattaatctcttattagagatatgatttgcaaatattttctcccattctgtggattgcctttttattctgtcgatgtgtctttttttttttttaagagatagggtcttgctctgtcacccaggctagagtgcagtagtgcaatcatagctcactgtaacctcaaactcctgggctcaagcaattctcctgcctcagcctcctgagtagctaggactacagacaccaccatgcccagctaccttttttttttttaaacttgtagagatggggtcttgctatattgtccaagctggtcttgaactcctggcctcaagcaatccccttatgtcagcctcctgaaatgctgggattacagacatgatccacggtgcctggcctgatagtgtgttttttaaaaaattttttctataaggaatggaggcagggttttactatgttgcccaggatggtcttgaactcctgggctcaagtgatccttccacctcggcctccaatagtgctgggactacaggagtgagccaccatgcccggccaatagtcttctgatgtgaaatttagtgcctttaattttcatgaagtccaatttatctatttttttctttttaatgttgatgactttggtgtcatatccaagaaactactaccaaatccaacgttgtgaagatattccctatatttaattttaagctcttacaatttcggtcaattttgagttaacttgtatatgacgtttggtaagggtccaacttcactcttggatatccagtttccaggcatcaaccatttgttgaaaagactgtcctttccatagcctgggcgatcctcttacctcagccttccaagtagctgggactactgcttttttcaaaaaaaaaaaaaaacttcgttttaaaactcttatcagtcctggataaaaatgttgcctaaggattctaagtcctttggccccacctgagacaaatgctgaatggaaccacttttcatgacctccactgctgcctctgaggtccacgtcatcgtcagtttttgcctgttctattgcagtggccaactgatctaaccaccccatcccttctccacacagcagccagaggtctctagaaccaggtcaggtcaggtctttggctacctgccacccagagaatcgcatacccagattcctgatcacagctcacagcacccgctctggtcaaaacatggtgtcaggtccctttgcctttgtgggtccctttctctgcctgacaggagttgagcctcttcacccaggtctgggctcagacactgaggccttccccacctccccgcccaaggtaagtgtccagcacaggtgcttgatagcagtgtttttttttaaacagtaggtttcatctgttaggttgtaaaatcagtttggtaggtcatggccgacagtttgttttcaactttttattttgaagtaattatagattcacaggaggttgcataggaggttgtctagggaggtcctgggtacccttgccccagcctcccccaatgttaacaccttatacactacagcacagcatcaggacgcagaaattgacattggtacagtctacagaacatactcagtttccccagttacatctgtactcctttgtgtacctaactctacacaattttaacttcatgtatagccctgtgtaaccaccagtcaggctgacagatggttttcaacaccacaggactccctcgtatgaaccaccccctcaccatccctaacctaaacccctggtaacctttaatctgttttccatctctataattacattatttcaccaatgttacataaatggaatcctgctacatgtatgttttcaagattggctgtttttgctctgaagaatttccttgagtttcatctgagttgctgtgtgtacagcagttactgaaaatggcactatatcacatacagtacggatacatattgttttgtatttcaacaataatatgctatatataacagtctatgccagataataatgtaaaatacttattattaatatggggttttatccaaaacatttatttttatttttaaaacatttatttagagatggggtcttgctctgttgcccaggctggagtgcagtggcacgatcatagctgactgcaacctcaaactcctatcctcaagtgattcttctgcctcagcctcccaagtagctgagattacaggtgtgagccaccacacttagcacctgtccaaaaagtttgaaagatattgctcttattacagtatttgttttcttcataccaccaccataaaataccaaactgcttcagaaattaccaccattttatttttatttattttgagacaggatattgctctgtcacccaggttgaagtgcagtggggcacaatcatggctcactgcagcctcaaactcctgggctcaaacaatcctcctatctcagcctccgaagtagctggaactacaaatgcacgccaccatgcatagctcatttattttttgtagagatggggtcttgttacgttgcccaggctggtctcgaactcctgggctcaagcaatcctcccacctcagcctcccaaagtgctgggataacagccgtgagccaccacatccagccaccgttttaaattcctatttattgatgtttaatgtctgtcttttacccaaactacaacagaaactctttgaagacaacttgtctgtttcaaaactgtggtcttataagcctcaaaccctgtccaacatgtggacactcagatgttgtgaagcaattgacatagaaacaaatgcaggaacatcctgtccagagagattatctgttgatgtggaacttgagtagtgaaggaggaggcaaaacatgatagtcacactacagaggcaggacttaatgcttcctaacagagcatgcagccgcacaatgcataccttgctaaacaagcaggtggcagggagcgtggctgcactgaggggaagcccctcatggactggggtgctggctggcatgccctggcttttgctgcactctccagctctgccccaggaacctgaaggcagctgctgcaatcccaggcatcacatgcaggctgcaaactcattttattattttatctttgagacaagagtctcactctgtcgcccaggctggagtacagtggcacgatctcagctcactgcaacctctgcctctggggttcaagcaattctcctgtctcagcttcccgagtagctgggatcacaggcacgtgccaccatgcccagttaatttttgtatttttaatagagatggggggtttcaaccatgttggccaggctggtctcaaactccagacctcaagtgatccacccaccttggcctcccaaagtgctgggattacagcagactgcaaattcagatgccccgtccctgtgtttaagagtaagaaaaaccttgtagatctctagcagtcttcctctcttccctcactgggtggaaatgctcattattaaaccagccacagccatgctggaggcaccctggttgccttagacacatcagtactcccctgatgatgggggaacgctggctcctctttagatgctcctgctcttgggatcccgtgagcacaacccccacccccacccccactgttcacagacacaggggctcttagggagcacaggagaaaacacactcaagcagggaaatactgttctttaatggacacccttctaacgtgatagattattctgccccaaagaacaaattaaaagatattcaacttgctgcctgtgtccaggaagagagcagggagggtgctgggcacagacccagcctagccctcagcatcacacaacagggccaccataggatgagaaaccattctattagtaataaacagacctcttcaagaaatagtgtttttggtggttcatacattttaaaacacttaacaagagaataagcatacaaatttctaatactgtccaggtacaacactgttacacacaaaatctaacaagtgtgaacttaattttcagcttctatttgaaatcagatgaaatagcttttgatacattaaccaccaggggaaattttgagggaaggagtgcttaattccatatgtcttggacttggatttcttcagctgagtccacaaaccctctttatgcaaggttgtgtgttctgtagctgtgtgcatttcttaaaaaccagagtctccaggggccgacctgggagcctaagaagtgaagcctgctggtgcagaggggccagcaagccctacctgctcggcacacctgcctgcatgtgcagtggaactgagcgagtggagcagagtgtgagcactcacaatgctcaccaaacctgggacgtggcaggcagtttcccaaggactaggaaagacattcacagtggcacaactgtttagctacctcattatgacccacctgtgtgtccacacaggtcagggctacccttcagtttacctgagaagcctagacctcaggaccgccatctcctatgctaccatgcccagcctgacctggctgctcacaagtacctgccataatgcttggcctcctggaagctctaaagcggtgcaattgtcctgcagaacatcgcagtgtcagggtatcctgcatgcaggtgaggggtgggcaagtagggctagcaatgtcctgctccatgttcctgtgagcaagagctcacagggacccaccagactgtgtaggctggtcacagtccccagggctgtgcaacagcaacttgaaacagactgaggaagctgcacaggccaatggcagggatgcttgtcactcgtccttctcctgtggcagagggagatgccagtctggaggggggctctgcctcggggcccacaccaggatgtgcttccgtgcagcccggactcgtgcccgctcgctctcacagagggattgctgtgcaaatgagactctagtcactccccaggctctgagcaccctcaagacccctgtacctcccccctctcatcaccctctgaaacacagatggacaggcagggcctatggtacacaccactctgcagcacagctgcttccacctactataccttggcgattcttccatattagcgcacagagatggagatcattttttttctcacaagctactgtgaaaaactactgaataggtcataataatttgaggaatttttaaatatcttctcctggacctcagggctcaatggctctggttgacctcgtgagtctggggcatattcacctgctgagagtgagcctgggggtgctgggtggagaggagagaagagtctgagagagcagctgtggggagctgcagggaggagtgtgttagggagaagggaggaagacggggaagaaatacatgtcctgggtatcctggaagggtgggaagagtccagaggacagaccacccgcctgagtggtgccacaagtgccacttaacccatcagcttctcttggctactgtctcccaatacagacacaagtcagtgtatcacaacatgggtgacctttgctgtcagcccttggtaggtatcaggtgctatgtgagcctctttacacagataacttaatctgtctacatgtctgtctttgttcaagctctattgcctcaaataaaatattttgatcgtgtttaaaaagctatcagaaatgtagtacagaatattaaagattcccaaatgtccattcccaatgcggcagttaacagcttccctgatatctttttttggtccacattttagagctaacatgtttccctaaagataggataatcttttgctggctagtctacttcctgctttcttttcactaaacaatacactgtaggcacttttccatacccagggagatgaccgaccattcttttcaaaggctatctggtatttcactttgtggaaaaagctatttggtcaaatgtctattagtgaaatttaggttgttttcagcttttgcagtatcaaaaacataattagcattctaacttttaactgtacactgttatccaattacttccctgggataaagttccagaagtaaaacttaaggtcaaaaggtatgtatctgacatttacataatcagaacacctgacacccccaccaacactgcacaactacccagaattcttcaaacctctatcaacaccactttctgctgttactgtcatttagacttatatacctgacacctggccatttgattttttctttttttttcttgagagggagtcttactctgttgcccaggctggagtgcagtgacacgatctcggctcattgcaacctccgcctcccaggttcaaacaattctcctatctcagcctcccgagtagctgagattacaggtgtttgccaccatgcgtggctaattttcgtatttttagtagagatggggtttcgccatgttgccaggctggtctcaaactcctgacctcaggtgatctgcccacctcggcctcccaaagtgctaggattacaggcatgagccaccatgcccaggcttttctccttttttattatttttataaagatggagtctcaccatgttgcccatggctggtctcaagctcctgggctcaagcgatccccttgcctcggcctcccaaagtgccgagattacaggtgcccaccaccatgcccagctggctttcttttttaatgaattgcttctttgtgtcctttggccatttttccattctgaaataatccctatatttcttattgatatatatataacagctctttatacacacacacgcacatatatatacattaaagttatcaatctcttgctatataagctgtcagctttcttactttttttgactttcacatattatggaatagtcatcattttcttttatacagcagtctggtttccacatcagttcatctctttcagatcactgtatacacttaataatgttgaagtgttgatcagtcccattgattctcattccttggcactccccatgagcctcgcacctttcggctggcttctctccatctcctctcccacaaggggtccaccgtagcactgtattctacactacagtgtgggtgccaggagggcagagactcttcttatcactcgtgcatccccaagagcacccaatgtggtacatatttgctggacgaaaaaacaactagaaccacctccttaccggtctctctgctcctgtaatatattctctacaccctagcaaacagattgaacttcttttaccctctctcttttttttcccccctgagacaggtctccctctgttatccaggctggtgtgcagtggtgtgaccatagctcactgcagctttgaactcctgggcttaggcgatcctcccgcctcaccctcccaagtagctgggaccacaggtgcacgccaccacactttgctaacagactgatcttttaaagatataaatcgaattatgcctcccagcacactttagactaaactctaaactccgtatcaaaaggcccgccaggtccctggtataccgctctccaaccatccacctaccctctgcttcaggaacccaggccttatctgtttctcagcggtgtctaccggggctggatgaaggctggctcctggtcactcaggactcagcaacatcacctcctgcgtaggccagctgatgaccctaacaccggacggctgccctcttccctctctaaaccactctacaccccctcctcgctggtctcctcctttgtctttcacgccctctgaaagtcctgttgatatgctaatttacacaatctctcaaaagaaaggaagcgtgaggaggatagggaccccgtcagtccccggctaggtcgcggggcatggggcgtggaggggtggggaaagctgggccccgcaaggcgctccgaagcgccgccccgctccctcccggcgcacctgggcctcggcgttccggcgctcctcccagtcgcggcagctggccaggtcgcgctgccactgttcgcaggccggccgctcgccgtggacgtagtagtggtgtaggaagtgcctggcgctgcggcagagcttccactcggcgcggtaggcctcgcaggggcgcggcggctgcggcgagaggcggcgcctgagcggggcccggcggccgcgccctacgccccgagccagtcccgttccctccctccggaagaccccggtggttcccggctccgacccagcacactcacctgccagccgctgccgtccgccatgtctgggcgaccggcgcgccaagcccgcccctcagtccgccagccaatgaaaaatgaagaaaacggcacctcgtgatcgactgacagaagaactaatgagcaccgacacattcaatcacgtcttcgcccccttcttcgagaagcgccgacaaacaggacgagcaaccaatagcaaccgagggcggctgcggcgcgcgcggagggccggggtcgcagggtaaatccggggcgagacctggcgcgaagcctacgcgaccaccgcgacgacagcgccattcaccccgggccaggcgggcatcctgggccgcgcagctaccttacgtcagccgcctctcaaatcacacggctctggccagttcttttcagcagctttatgagattttctcaaatctcaacaatccggtatattttcaaaagtacatactgagcatcaaggtggtgcagcgaacctcccagatctgcagctccagcagtcttgcttgagcgtccactcaggatggaggtgaactcgcaaagtaactgagattggttgggcatgacatatggtggatctagggttgaatgacctccccagggaacgcaggcttgaagtggaggctgagaatgcaatccgagtacagccataggccggtcaaaggtatggaggcggtgtgtagcaggggtgagcggggtaggagtggcttggatgtctgtagttctattctaagggtgcgggagacatgtaacatttaccttattcatttttcgagacagggtcttgctgtgtcacccaggcttagtgcagtggcgtggcgtgttcatggcttactgcaacctcaaactcctggactccgaacagctgggaccaaaagcatgcacagcctcaccaggctaatttttaattttttttttttttttttgtaaagatggggtcttgctaagttacccaggctagtttggcctcaagcgaccctctcactttggcctcccaaagtgctaggattataggcggagcgccagtgcctggctgggacgtttataaaaaggagcaatgcacaagaggcaacaaaggcaagtaaagaggaggctggtgggcttgcagaaacgccctgcagtacctatgctgcggttctcccacttcactgataacaaatcctcagtatccactgatacaaatcctgggactgctgggccagtcccaggaatgacactgggacagactccctggaggtggatcagaaagctgcagttttaccaggggtcctgctgttgaggcagccggctcaaggaccaagcccaaataagacactgagaggaaggctgcaggccagggtgcaggagtaatgaccaggatcagtgctccaactggccccactgtgtcattaaaaggctctgcaatggaatccatcctggtccaggcaggggagtgtgcctccagcaaaggaccaggcgtttcactgcatacacagcaggtgttgcttagtgaagacaaaaacccagagccagaggtactgtaacattcttcattatgcataaagtgacagtctgttagctgatgtgatcctgcaaatgaaggctgtctacccaccaagggtttctccctctgctagtaaaactgagactttgtcagtggaggctcaggtaagtccccacagtgctcatgccttccaaaaccacgcccatttccagtgatgatggtttgtgccacaggccaagtactgaacatcatgacactcatagacactcttcactgaagacgtggatagaccctggggccaccattctctcctctctggagtgttggaggggccctgaccagggcaggacccccatgtctggaagcagggttagccctggctcatgggggaccctgctgggcttagccattgccacctagggatcaggcagccttgtttcttcctactttctccaggagaagccccagagggacacttttctaatggtgagatggaacacggagcacctgccaacaggccttcagttatggtcagaggcccaaccaccagtctgtgttagtacctaatcaaacatttagatttaggctttagttattgcctgtttttacttgaaattcttggcttagaattattcccaatggggccaggcacagtggctcatgggaacaaatttaaaataatcagattagcatgtcaaaagatctcacgttatagaaagtgaagatctaagaccaaataaatactgataaaaaatacaggccagcagaagcttggatgatttaataaattaaaattgggagttggggagtagggaagaaggagaggaacatctctttagcatttgttcattctaacattcacatgtttgcttctccatggagttgtttcactatgaacaggttcactaaggagccagttatgtccatatgaaatgagaataaaagtgcaaactcattcagatcaggttcttctgagtggtgtttttgaaaaaaatatgtaaaataaaaatagaaacattctttgtcaaatacttaaattgcagccacagtagtgggacagccactacttatagaacacatgtctatttaaagcctttttttaggccaaagactgacacctatgcaattgatgtaggaaaagaaaggataaatgaagaaaaagaaagaacacttcatgttagacaatttagtcaccttcataggttttgacagaattagggatgcagaattgctcctgctgaggcagtgggagctcccctcaagctgaaagcgtgaagaggtgaggaggcagctatctacaggccctcagggacagctctttgtctttccccaaatcaagcatacaactacaaagtcctgctgctccacttccaagtcaaacttaataattcttaggtaactctaaataaatcttaagtaacagagtattctctgatgaggctcgtccctgtcagtgccagtaactaaaagccaagatgttgcaaatgattcttttattattttccaatcagccaacagtcctcacttagggctttcttccctttttacgcaatgactgtccttctccagagaaagcgacgaatctgcctccagcttcatcctaggtttgaagagaagatactattttcagaaactccctggaggtttacaataaatgccttactctatggactcacgtaccatccacattactcataagaaatatctcaggctggacacgatagctgacacctgtaatcccagcactttaggaggcctaggtgggaggatcacttgagcccaggagttcaagaccagcctgggcaacatagtgagatcccatctctaccaaaaatagctcagtgtggtatgtgcctatgatcccagctacttgggaggctgagacgggaggatggtttgagccagggccatagtgagctatgattgtgccactgctccagcctggatggcagagcaacagagcaagaccctgcctcaaaaaaaaaaaaaaaaaaaaaagtctgtaagttcatcacccaaaaacatttcaggtcacttttctgtacatgcttaaagaattgttttcccacttaattctgaaatctcatgccaataaacttcctgtctagtatactcccaaggctacagaactgaattctgtaaaaaagaattccatgatgtaggagggccagttttctaccagtggacattgttgtggtaagcagcttaatgtatttgcacacaactctgattttttttagagctcaaattcctgggtcaaagtgtgtacacacttttaatgcttttaacatatagagaccaaccagccctcagaaacattccactaagctatccttccatcagcagaaagagggattgttttttcccaaacctttgaaaactgcacatattttttttcacatgcttttattgctagtcagtctgaggcattatctcaacttttccctaggaagaagaggattctggaatgttcaacacacatccctgcacctggctccccactaactgtagcatgttatacctgcaatagagcactgtttagtatttatgtggtcacattcatgtaaatttgagtcacagctgcatttagtcttcctttgccgcacagccttccattcatcctggtgtcaatagctgtgtttggcttcttcctctattcaatcacagcctgcattgcatggagttcatctgttttgacaaacctgtgtctcctgggccttcgccctgccgtacctggactggcctttctctaggtgccgtacatgttagtgggggctccttatttcctggattctatgactttcttatttctaccttattccttcattttagtgaggaacacctcctaggagcttcctgagaaaagatgcatgaggattatcttcttgtgagttccttttttctaatctcatatttcattgataggctggttggtatgttagtctgctagggctgccatataaaatgccaaagatagggtggctcaaacaacagaaatttattcttcatagttttggaggctagaagtgcaggatcaaggtgtcagcaggtttggtttcctctgacacccttttccttggcttgcagatggctgccttcttgctgtgtcctcacatggcccttcctatgtccaaatttcctcttcttaaaaggacaccagattgaattatggccaactctaatggtcttattttaacttaattgcttctttaaatggccctatctgagttactgggggttagggcttcaacacagaaacactggagggacacaatccagctcataagagttggtacagaattttaggttggaaaaaatttcccctcagaattttgagtatattgctccactatcttctagtttcctctgtgtcctgctaagatgatgtccctttttttgggagacagggacttactgttacccaggctggagtgcagtggtgtgatctcagctcacagcagcctccacctcccaggctcaagtgatgctcccaactcagcattaaagtagctgggactataggtgcgtgccaccatgcttggctaatttttaaaattttctgtagagacagggtctccctatattgcccaggctggtctcaaactcctgggctcagatgatcttcccgcatcagcctcccaaagtgttgggattacaggtgtgagccatggcgcttggctgatgatgtccttaatgcatggtgatacctctgttctctctctagaagctttaggatctttctttgcctcaaagtggggctattttcattcattttgctggaactcagtgagcccttcaaatctgcaaaattgtgcccatctttggggaaactatttccctgatgatttctgctcctttggtttctgtggctgttcttcccacaaatcctctattatttagatgctggaatggaaagctttctgactgtggccttcacttcagagatagtagtctagagacctactggagtcgagcctccagccttctgggatgggggagggagggtaatgcagctctaactgcttagtaacagaattctgtctttagtccctcatttctagaggtgccttttgagaattccacaatctacacagaactgcttctaggctttctatggtctactaaggtacctggggcttccaaagccttgtagttgcctcctcttccactgtctttcttacctcatgacctttagccacagccttagtggggctgcaggatggaatagagctaaatatgtcttcaatcccatctttaaacatatacttcttaaatacatatttatggtcaaacaggcctgctgtgcccactggcctcccctgccttctgtaaatttgcaacagtcaggtcacagtcagcctgggggacgtcccatgctaaggtcttaggtcggagtcaggcactggcttttagtgagaaaggcagcctgtagctggtgaagcctggatggtgcctgaaggaggagctggagggtgaggtctgactggccactatgtttgctcctctgagcctgaaaggtcccaatgcccaatgctgtttcaacttgaacattgagcccagaagtggttgtgagtaggaccaggtgtgcaaacttcacagtggtctctgtccccaaccaccccaagtgctagagaaaagagttcagtaattgggatggctcccatgtagcagctggtcctgaatgggtggctcagtacatctgccctctgccctgatcctggatcctcaagggtccaatcctttgagaaaaggaaccaggagagcgatgggtctgaagcgctggtgttgtagaaatcctcatcacaaagaggtgactgcgttccagttgctgccaggcctggccatattcccacaaagtgcccatgtctacaggatgctcagcccttgccttcctctgtcccgccaccaccctgctcagctagaaggtgctgcctatatttgaagttcaaggtctctgttggaagacgaagcccacccagggcacacagttctgtgataacagagcctggagtcggctctagagcaagacagagctcctgacccccatgctgcaagtcttctgtttcatacaccctacaccagctctacagaaaaaaacaggacaccagggagcagagggaccctaggaaagggaaaacatgacagacaccctcatgtggtttggctgcgtccccacccaaatctcatcttgaattaccacgtgttgtgggagggaccaggtgggaggtaactgagtcggtgggaggtaactgagtcatgagggcgggtcttttccgtgctgttatcatgatagtgaataagtctcatgagatctgatggttttataagtaggtgtttccctgcaccagctttttctctgcctgctaccatccatgtaagatgtgacttgccccctgccatgattgtgaggcctccccagccatgtgaactgtaagtccattaaacctctttcttttgtaaattgcccagtctcgggtacatctttaccagcagcttggaaacagactaatgcacacccctactcagaatgccaagaacttcagtcatcactagcaaataaatctcctcattaccaaccaaggaaatacaaggaaatacactcacctcttcaacctttttgacaaggggacgtgaatttctgatgaaagttatcttaccaagtttaaattcataattgggaattcctctgtaagaagagacagagacagagaaatgttatttccaggaaaaaaggactaaaattcatttttgacagtcaagaggaacgcagaaaagatgctgctgcaccccacctgggccctttggtgcttcctggcatcctcccaggagggaagcagaaagtaactgacttcttggtttggtatcaatattgggtatagggccaggggctttaggctctgtacctgtctatggagaggggtcatctgaaggattgggaagccctcactgtcactgtcctgagcttcacagaaccccctgaggtggctagactctcactccagtattctgatttcacacacacaacagacaactgacacacctcagccctgcccctgccatcatggccaccagaggaagggtctgctgtgggtccccggacccagcaacagaagcacatctgaggtagctcctcagggaactttcaggggaactgagataatgtgacctgattaataattccaagtcacaaaacaggaaaataggcagatcaccaaatagggaccagaaaggttttgagtaagagacagatctaatcagactcgcatcttaggaaagccagtgggggcaagaagaggctgaattgggggtatggagaggtatggagagaggctggaccacagtggtactgggggtggcactgtggaaggaggggcatgttgtgctccaccccaccaaggagagcagctaagggttttagtcccttgggagactactgacccaggctttgtctccagaactggggtgaggctgcccgaccccagcgggctggcacagatcctcctcctgtcctggaggagagccaggacagacctaccttttaatatctccaggcttgattggggaggggctgggctctacccctttcttctttccatccagtctattgccagatccagagaaagcctagacaggaagtaggtgagtcatataataagcccaagtgtgaggacgatatgtcctttgcttggagatcactgcagggatgtgagctgggggtgctgtgcagaccccttcaggactgaagccctgactcctcaactgctggggtgctggcagctaagaactctgcccagttcctcagggggtggccatgagctgaagacagccacttggccaagggcagccagcagtcagtgttgggttaaaagacctgatccctgcctctgcagggccacccagttcaagctctatgggtgggctaaggctactgttgtgactgccccatagctcagcttcccatcattctgccctctctgctgcttcctggcacctcctgccacctcagtgcccacacatgaaccacctccacctgtttcccatggagccttgccagtagttatgctaagggtcatgtttgcaacctacatggtacaggcaaagaaaaaaggaaacatgatttacaagagagagaaagcaaatgtggtaacttttggtgaacctaagggaacagtatatgtctactgtactatttaaactcttcggtaggttagaaattcttaaaaatctgggctgccttatggggctgttgggaagattccaggagagagtggatacaaaagggtttggtaactgagcgagtggcagatttgcatatgcacaggtacccagaggcctaacccctgctgatgtccatcgagcatcatggagaacaccttgagtgagtgctctaatttcaaggagcagagggcacagcaatataagtcaagtggtctggtactcacgcggaagcccagctctccagcatagccactgtggtcggcttcaccttcctgacagggaaaaagaaaaacaggtgagctcctcagcggggacacccagcttccctctcacccccacccccggctaggatgtcccccggaagcatggctggaagggacgcagaggatatgactacaccaacactagcagaggccacccacgagccactgccaggaactcaaaagcagcatgcagcaggacagcaaaggacactgaggataacacttactgtcgactcctcatgctggacttgtctttcgggttctttgtagcccaggggagcatcaaagtccacctgtgtttccaggattttaaaagtaaaatattgagacatgaccacccttggcttccttttttgtttttaattgagacaactgtagattcacatgcagttttaagaaataatacaaaagatgccttgtacacttgcccagttttcccaacggtagcatcttacaaaattacagtaaagtattgctgccaggatatcaacactggcacaacccactgctcttattcagatttccccagttttacatgtttttgttcatgggtatctttagttctacacaatgtaatcactgtgtggggcatgtatccaccacagttgagatgtagaacagtttcaccaccactaggactgcccatgttgtctttttataaccatacccagctgtctcccagccccctccaccagtcctaagccctggcaaccactggtctgtcttccatttcgaaagttctgtcactttgaggatgttatataacgaagtaactttttgggattggctttttttgctcagcagtattccctagtaatacaaccaggatgctgtgtgcatcagcacttcattcctactcagaaggttcagtacgcttccttagctcttaagcatattcactcctcggccaggcgcggtggcccacacctgtaatctcagcactttgggaggccgaggcgggtggattacctgaggtcaggagtttgagaccagcttggccaacatggtaaaaccctgtctctaccaaaatacaaaactagccgggcctggtggcacatgcctgtaatcccagctactcgggaggctgaggcaggagaatcgcttgaacctgggaggtggaggttgtagtgagccaagatcgcaccactgcactccagcctgggcaacaggagtgaaactaagtctcaaaaaaaaaaagaatattcactcctcaacgggtcagagctaaccatggcagcactggcagcaaactctgttgccccaactggccctgagatagatcacaaggtcacagtctcctcatgatgttctgacagcatcttcctcctctttacccagagtcccaggggctgtttgatgccctcctgacaccctggcctgcagtggtcaccaactgcccatcctcccagggcccaggctcactgtaactggacagagccactcacgttcatgtcacactcaatgatggacactgccttgtcgggtttggtctccatcacacgcagttcgtagatctgtggggcaaacacagaaatcagttggatggtttcctggcagcactggagctgtcgctgtccatgttactgtggctctactggctcctgcgaatgacacagcattcatgcccatgacacaacctacagctgcacttcttgctgtgacaacactgccataagggacaggctgccctgtgcccatcgctgaagagatgctgttccccagatatggttcaaattagacaaggtagttatacagctaactgcaaaagacactaacaacctttaacctggaaagttcacttctggaactttactatttattttatttatttatttttagacagaatctcgctctatcgcccaggctggagtgcagtggtgcgatcttggctcactgcaacctccgcctccagggttcaagcacttctcctgcctcagcctccctagtagctgggactataggcatgtgccactacacctggctaatttttgtattgttgtagagatggggtttcaccatgttggccaggctggtctcgaactcctgacctcaggtgatccgcccacctcggccacacaaagaactgggattacagacataagccaccgcactcggccttcgaaatttattctaagtaaataactagctatacccaatgagaaaattctaagaatgctcataccaacgtcactaataccactgtacagatgctccttgacttatgatggaaccaagtcccataaacttataagttaaaaatgtattaatattcctaacctaccaaacatcatagtgcagcctgccttaaccattctcagaacacatacattagcctacagttgggcaaaatcatctactataaagcttattttataataaaatgttgaataactcatgtaatttattgaatactgtactgaagatcaaaaacagaatggttgtataggtattcaaagtatggtttttactgaatgtgtatcatgtttgcatcataataaagttgaaaaattctaggtagaaccatggtcagggactgtctgtatactcaaaatgcagctgaattatatttcttcatatgtaaatttacagttatacaatggtatgctacgcagccaacaggaaaataattgtaaaaccagtcatgttgcttgtgtctaagatgacctcacctatgtaaaaaaggcacataaaaaatgtccagaagcagggccgtgcgtggtggctcacgcctgtaatcccagcactttgggaggccgaggagggcagatcacgaggtcaggcaaatgagaccatccttgctaacatggtgaagacccgtctctactaaaaaatacaaaaaattagctgggagtggtggcaggtgcctgtagtcccagctattcgggaggctgaggcaggagaatggtgtgaacccaggaggtggagcttgcagtaagctgagatcgggccactgcactccagcctgggcaacagagcgagactctgtgtcaaaaacaaacaaacaaacaagcaaacaaacaaactccagaagcatagaaattaaaagtggccctatctactttttcctgcatcatttcaggttctttgcttttatctaaagtctgtcttgcttttttttttttttttttttcgagatggaggctcgctctggcacccaagctggagtgcaatggtatggtcttggctcactgcaacctccgcctcccgggttccagcgattctcttgcctcagcctcccaagtaactgggactacaggtgcgtgccaccacacccagctaatttttgtgtttttagtagagatggtgtttcactatgttggccaggctggtcttgaactcctgacgttgtgatccacccgcctcagcctcccaaagtgctgggattacaggcatgggccaccatgcccggccagtatgtcttgcttttacaaccattttaaaaagtctggatagtcccaccatttaaaaaaaaaacctaagcagggccaaatctacttttaaaagtgtcataattattgaatagataaggaataaaaaaaggatctgtcattgtgtggatatactaccacttatccactgagcatccggcctgtttccaatcattttgctgtgttaatgacactactataaacattcaaacatgtctcctagggcttggctcatgcttctctaccgttttcatgttttcaaaaggccacaaataatcagtgggtcataaaaccaacagggctgcaagcagaactgaaaaggaaagaattggaagacagtaccctagaagtactattgcatttagtaaggataaatattcctgtgacattttccatttacttttatgtattggcataatattaaatactttttttttaaactatgggaccaattttctaggttggtgctcctcaaactacctgggaagacctagtttttaaaaatgtgcagtctgctggactgccatgtggtcctcctgcacagaagcaagacacaacacacaccagacgcccagagctcaccaagacaagtactggttctgtggccatgtgtgtggaggttatgacaatgccaaattactatacgtttctaaacattcacttttgattcctgcttcctcgaggccctggcaaccaccattctttttttttttttttttcccttgaggcagggtcttgctcagtcccccaggctggagtgcagtgccttgaccctggctcactgcagactcaactgatcctcccgcctcagcctcctgaatagctgtaactaggcacatgccactacgcccagctaattttaaaattttttcattaattttttgtagtgacaggatcacactatgttacccaggctactctcaaactcctgggctcaaacaatcctccaaccttggcctcccaaagtgctgggatgccaggtgtgaaccacggtgtccaggtgattctactttctgtctcccatgagtttgactactctaagtactcatgtaagcggaatgtagtatttgtctgtctgcatctggtttatttcactgagcagaatgttcatccatgtggtagcatgtgtcagaattcccttcctttttaatgttgaataatattacattgtatgtgtgtaccacatattatttacccattcatctgcaatttatttttgactatggtatgagttaggaactcaatttgttttttcatcttaggaatagtcaatatcccagattccgcaaccccagtatctcctttgcctggtgacatcaatgctgcctcagtggtggaccaagattctttgtatataaagctttcttccactggcctacttgtctactccagaaccaatgccatatggtgtcttaactactggagctttattacactcagctgccgtatagaatcttccttatatatgaccagattcttttgtcaatattttatctacaatctatgtatctgtatcaagtgacaatgatctgtagtttacctttctcctatccttgtgtggttttggtgatcaaggttatgccgacctcagagaatgagttgggggatatgttctttctctatttttagaatatctaagagcaatttattgcttgagtgtgaggaagaacttgcatatataaccatctgggcctgtgtttcctggattaagatttttctgattgaattacttgactggctatacaattatttaggctgtttgtttttttttttctttagtcaaacttcaattacacttttctctaggaaataatttatcaatgtcaaataagttggctcatttcttagtataaaatttttcacagttttatctttcaagatatttgctttatctaattcattttatttgtttttaaacattcaatatgcatgtagacttttcagggtttgctttttttttgtttgaggcaaggtcttgctttatcacctaggctagagtgcagtggcacggtcactgttcactgcaacttctgcctcccggactcaagtgatcctcccacttcagcctcccaggtagctgggactacaggtgcatgccaccatgcccagctaatttttgtattttttgtcgagatggggttttgccatgttgcccagtctggtctcaaactcctggacttaagtgatccacccacctcagcctcccaaattgctgggattacaggtgtgagctaccacacccagcttcagctatcttttttattaactttattgaattgtaaacagagaacactttaattctaaacaactctctcaagagagtaagtctaggccaggcgcggtggctcacatctataatcccagcactttgggaggctgaggctgatggctcacctgaggtcaggagttcgagaccagcctggccaacatggtgaaacctcgtctctactaaaaatacaaaagtagccgcaagtggtggcacatgcctgtagtcccagctactcaggtggctgagatgagacaggagaattgctcgaacccaggaggtggtagctgcagtgagccaagatcgcgccactgcactccagccagggtgagacaaagagagactctctcaaaaaaaaagagagtaagtctaaagacttactcttttccaacattttagatgtcattttttaagcttcatacattaaacattattactgctttatatggcaacatttaccctggattcatatttgccaatttatttattccctattccttcttgctttccttctaggataatgcttattcctaaagtacatgcttttaaaattccattggtaaataacctctctcagatttggttcatctgaaaatattttcactttgcccttattctttaaggaaggttttgatgatagttacttgatactggctgtaactgttgctattcaaagacctgctacttgctgttcttctgaaggtactgtgttttctccctgcttacctctctgtatttggtattttctacctgtagcttattctgtttgttatacattataaatttcctgtcatgatgggctgaccaccaattctaaatcaatttcagttaccatctcttcagattattgcaattcctccattctttcctactgggattgcaatgggcatgtttgactttctcagtgtcttcaacatctcaagctctcatatgttccatccccttgctcctctgtgtgaaattctgttatttcttcagattcatctttcattaactcttttatagctgttgtttaacattgtttttcaaatctttctggttatttttgatagccttttgttgctcgctattataattccattttaaaaaatatctttgaacattttatatctaattattttacatttgtatctagaaattctaatgctgatttccttagggatctaatttttattgtctctgctttggtgtagtttaattatgtgttctttgcttgttcaattgacagcaatcccaaagacgtaactaaactggagtgctttttccagagaggatctgtttatttctcctgagacaatgacaacacccacctctgtgtatattttactgcttttaagggttcccgttcaatcctgatctctgactcagatctcccactagagcactgatatggccatctgccctcagggcaacccagcttagagtgtttaaaattctctataagcacaacagtacattaatcagaagggcccattagaggatctagttttccctacttctaaaagtggaagttcaaacctgtgtttcaattttacatacactcttatataatgtaccctcccttagagtgcaaagtatcagtactatcctttatcatcagtttaggagttatatgtagtattactaccttaacattaaaaacaataacattaaactgcctgtaattaattataaaagcttagagtattcagttaaggtaaacgatacctaaaatgttctccacaaagctaaagggaacaagattatttcttagtttattaaaaggaaaaaagaaagtgtgattcgaaacccaaggaactgaaaaataaggtcagatgcctcaaatatgaggaaactgccagagaataagctggatccctgcactgacaccaagggagtaactggctaaaccacaggcagctgtgacacagctgtgacggcccagtccccgaagggaccagagagtgctgtgaaggagctaagtgctagcttcagggaaagcccagccaagccaggctgtggtcactcccgaacactaaggctagccctggcaacagctctgtgggagggtcaattgtcaacagtcacagtgaacaggggcacccatattactgtgctccatgcctgtggtgggacagcctgatggcaggattgccaactattacatcctcctgcaggcatattcccataggtaataggaaagtgaatgctttcttgaattttggactaagtcctgtcatttcactttacagttaaattgtctagatccagacacctaaacagcataaaatcagggatgaaaacagaggcattcagacctgagagacttgtgtcagaaaggtcaagcctagagaagctgctaagtgaaaacggaagctgaagaaaacaggaggtggaggaggatgtgggctcccaggaggagaggtgagcctaggaggtgttgccctaaggcagagccaggctttgcttctcagatgccacacagcacttggccccactgaagggcctgtcagcttctgtggggcaggtatcccaaggacaaggacccagcagggttgttattgtgtctccacagccctgcaaagggcttagctcagattagaggtgcagtggggacctttcaaaccaagacagaaccagcagccttgccaccaaggtacacagaggtatgactaataagtctatcaatgttcccctgtaaatgcaatctatcctcaaaacagagttaccaaatgaattagggctctaaatatgaacccgggaaaacttaataaccaaacagtaggcagtaattaggtgataagatccaggcatacgctgcttaaaaagaagccccattcaaacattagaatggacactgcaggtggctcttgtcaggaatgacctgcatgaactgggctcaccttttcattatagttgatggcaatcacatccccggtggtcagacaggcaaagttcctaagtgcgttttctaatctgcagacacattctgtcaaggcaacatggcaagatggataccttaatctgaaacaagtttccatgttagatgattactggtaggtagagactgtaccatgatggtacttgaaacacgaagcttttaatacaataaagtactacttggcaataaagaaggatggaactcctaatatgcaataatatggatgaaatgccaagctggggtaacaaatgccaagctgggggaaggggaaataaccaaccacaaaagggcagtgagattccatccacatggaaccctgagaaagacagatctatgaggatgggaggtagctgagaggtttctgggccaggggatcaggtggggactgacaggaaaggaccttttggggacatggaaatgttctgattacatgggtgtatacattttcaaactggctgaactgtgtgcattttattgtatacaaattataccatgggattttaaaaaatcctgtgggagtactaaagaacaaaaaagatttaatgagtcagataggtcctctcaaaagttcctcaaaatcaaagatgctttcatttatacttctgttgtttctatcttttgagctgataactttagttaatagaaattaaaataaagaaaccagcaaatactttttataacagtaaaactgtagaacccaaatgcccacacaaggaaatgtctattcatgtggaatattttgccatgtcttcctcatcaatttgctgaaggactttacataaaaaggtcacatgaaatgtggctccagagcctgccactgtgagtccaacttgagggtgaaagggtgaggctatctaggttcacctcgcttggtcaaacagctttccagaaccagagcaactttgtgaaaagcgccttatgtggtggatgctttctttgctcccaaatatgaagtgccacggtacgaagtgcccttccctccactcctctagtgaccctgccagggcatcttctctgacttccactgcagcagctggaggagcagagccagagccctcaggctgagaacacgaggcctctgcaggcagggcgggctccccatatggcctctgcgtactctggcacctgctgcagcaccagcttcccactttctctgctcggtgccaagactgctttcatccagacctcagccagaccagaaaacaccaggctctcaactgatggaagtgacgccctttctccacacactaacaagttaattgtgctgacaaaacagcatctgagatcaacctgataagtctgcattggggcagggcgcggtggctcatgcacgtaatcccagcactttgggaggctgaggcaggtggagcacctgaggtcaggagttcgagaccagcttaggcaacatggtgaaactccgtctctactaaaaatacaaaaattagccgggtgtggtggtgcacacctgtaatcccagctactcaggaggctgaggcaggagaatcacttgaatctgggaggcagagtttgcagtgagctgagaccgtgccactgcactccaacctgagcagcagagtgagactccgtctcaaaaaaaagtctgcattgcaacacatgtaaaaaccctgagaaaatgggcatggcccattcctggtcactgacagccaaacaagcatgtctaggtcagagctctgaaggacaagttaactagctcttcccataggacatccccctgcctgtgggacaggaggctcaacaaggccatcgtgtccagaacataggcagcaaagaatatacatggcccatatgcatccagagcacacccagcagtgccttgctcctaagaaaacatgcggagagagcgctactgggaaaggaggcagcttttcttaacttcctatctgtctgtgttgtttgactgtttgttttttttttcaagtatgcattaaaaaaaaataaaaaaaaagaagtagaatggagtggccactcttatgccatgatcgtaacaggaaaaatcagggccatggagctagagatcttgattggtgcacacagcaccgtcccgtacctgcactgcctacttcctgatgctgtcaacacatacacctggcttaagttcagaggtgaacaaaaagaatccactagaacctgatacctttgctttctgcttggtgacatagaaactgcagtcattgctacctattggcctggagtgaatcagctctcaggctggcatgcagtgaggttgacgggccagtgcacagctgggcggaggtactagggagccacagaaggggctggagctgaaggcagataagctgctccctccttccactggacatactgtgcatcctggctttgtgccaggtgacacagaccaactgaaagaagggcttcattgtggtctccatgaagtgtctggaaagtgacagaggtggcccagacagcacccagtgcacttggccagggccacgcagatgtgctagctgaaccccattattctcaaatcacaacttgaatcacaaatgtgtgatccccaaagcaggcacagattcaatacagtacatgatgtttaacaaccgccagcacactctcctttgtctagaagaactccgcttatttgaaaaagatacacggctttggggttggtgatgtccaggaagtcagggctctgaggttggaatttggagtaggtggccacttgaaggttgacgctctccacctggaccaggccgccttcttccaagagtaagttctgcatcatctgaaaggaagaagaggctacatgagactcctagagatgaagcagcctccacaaccactgctccctatacactgggcaggcccgtcttacttgggtccttggaagaggaacctgagccaagataagtaattcgtgatactatgtcaggaaggagggaaaaatcaagtgatgtggaaggaagaaggccaataaaggggtgctactgaagctgtatagctcacagtgtgaacgcatctctgcagggctgcccggattactcactagctccaggcttcccaggggcagagcattttcctggaatagtcactcactgtacttccaagctgtcccacaagcaaattataaggccctgcgtcaagtagggctgcacctgaggtaggacaaaagcagcacaaggcaaggctgacctggcaatggaatggcccaccacagctgaggctgcaagatggtgacagaccccagaggtctctgctaaggaggttataaaaatctgacaaagcctccacatgtctctattaaacaacccagccaggtagacgacggctgagaagtgagacggaaagagataaacaatgcccatgagtactgggtgtgcagggagtccagactcaggtcagaagctctatgtctcttgcaatgaaattttgcttgtcttatttgaaaccgtcttaaaaggggtgtcagacatatacatcagtagaaagagccgtagaagagagctcccacgcaccgagccctgacagttggacagtgctcacgtcgtggctcagtccatcgatcagcactacctcacacccagtcccaagccacattagatgccctgaagcaaatcccaggtatcacatcccttcaagaatgtttcatcgggagtggcagtgagaaggtgactttaacagccaagggaaaagggggctgagggctgtgtcacaaatgagagggagctcatgaggagggagaggcatgctgaggccgaggctgtgcctgggaagccgtgcctaggccatgagtgaagcctgagtggtgggccctatggataggcttgcagaggaccccatgcactcacgctgacagctgcttgtcaggctagtaagggcagaaatagagggtggtcactctaccaaatgccacaggcaggcacagaaggatgcagaggtgactggctttggtaacgggggtctggcatccccaggagtgatgttctaacaggaagtattctaaggctcagagttagccagtcgcaggccaggcgcactgtccctgggtagatttttgtgggaaatttgtcagcgaggggaaggatactgggctgcaattgcaagcctgagggaaggctggccagggatggggggtggcttcctcagccagaggcaggacactgccataggtgatgtgaggaggacaggcagagaggtcagactagggcttgaggtgagaaatgggctgctggaagaggcctgagagcactaagcaggcaggaggagctgatgcctggccctccccatgcagcattttagagcatacagcacaacgggcagccgagtacccacatgtcacaaacggctagtccagggctcggatctaggtcagcagacgaagccttggctacaaggaaaaaggccagtacctattccaggctggctcgccctgaagaagcttgggagcatgggtgggatggagtccaccagccagcccagaaaaagcactggctcacatgccctccaagacagcagatggggtatacctgtcacccgcctgcccatgccaggagctggaaggccagctcaggggaagaggtggcctgatggcttcacaccccaaaccagctccaggctacctaaagaggctttccaggggagaaagggttcaattagtttcctggtctaaagcagtccaacagcttggacaagaggccacccaaacttcaagtctatgggttaaaggagaaccttcgagatacagtgtatccccagcatcaccacctcctcttataggtgagccacagaagggactggggaagtagtcactgcctgacacttcagctacctagagtggcttcagtgaccaggtgttctaccggatgagcacaatgtggcctcaggcccttgggggcacctgcagacaaacacaagaatagcaaggggctgagcagcaaatactggggagggcaggtgagccaatctgggctttgaggcataaaagccccccaacaggccaggttgggcaggcctagtcagctgaggtgaggaggcagcatgggaaggccaggcactaggaggtgcaatgggagtgcagggctcttgtcggggagacactggccaggcccagaccttgggaaggaccctgggacccaggctgaagaggatgccactaccatggcagcatgggcaaggtcacctgctacagcaggaaagagaccttcagaattttgattcatattattgttgttttttttttttgagatggagtctcgctctgtcgcccaggctggaatgcaatggcatgatctcggctcactgcaacctaagcctcctgggtttaagccattctcttgcctcggtctcccaagtagctaggactacaggcacgtgccaccacacccggctagtctttgtatttttagtagagacggggtttcaccatgttggccaggctagtctcgaactcctgacctcaagtgatctgcccactttggccttccgaagtgctgggattagaggcgtgagccaccgtacctggccagaatttcaattcatatttaatctcagaaaatattagttaaggccatcccttctgaacgtctggcggccaccatgatagggcatcagcaggagaggtgggctgtgcttcagaccacctccctggtggcagccaagcaagcactcctgagagtttccagcccacagctcactgcggggtctctcagtatgcctgatgtaatccaagcacaaagagaaggacaagcaggtccctttgtgaacttccctaatgtgccagagctggggagaggagtgaggagaagaaggagccaagtgggccacagctacctgtgtggaactctcactgctgcaggctcctccctacagcactggcacagttctgctcacttctctgaggggtacagccttgagggcaggctctggtggctcacacgccctggatatcccagcccagatctgcaatgacatccttcaagtcaactttccaaagagagcctgcttgtaaggaaaaagacgtcactcccatggcagctcagttgagagatttgggagactacgtcagaggtaactgaaaacatgtatgctgtgacagactactaaaagtaggggaaaagcataaaaacctcaaacaccctacttactagaccacctaaaaaatactgttgctccattatttttaaaaacgcctcacccaggaaatcacagatgaacagttcagctgcgcaactatcaaagaaaaggccactcccacagcacagtggcccacaggtgcgtccagagcccaccagcccgcataaggcacagtgcactgctctggatcccttctctctcgctgggtcggctcaggctaagacgctgagcaggaggagtaggcggggccacctgctccagggccaggactctcgagtgcaggagatgtctctgcctaagtggctgctctctagagaccctggcagccccactcacccagtgtgggaggtagcagatgccctcatcagccacaaactccagcacgccacaatgcgtcatgcggtccgaattcttattggtcagtttgaacagcatgggataggtaatgttaagtcggcctgaaaataagagagagactatgaggcacagctcctatgaagggacacctgttcggcccacgccttcccatagaaggagcctccccacaatcctgccctcaaccccacactcctctggcagatgaatccccctctgtgagagcacagtgcacggctcaaggaggaacctggcaacttggtaacacagcactggcatagacttgtgattttctgaagtcaacattttaaaaagtgatgtgttcattcatttattcataaataatttcagtgcccaccatgccctggacaaaatcccgaccttcaaaggtttctagtttgaaggtagaaaccttccaacaaagaaaaccacaaccagatgctgcaggtgctgtgggaagagctggcaggagggggcagagctactgggctaggctcctagaggccgagttctttaggctgggcactgggcgggcagacctgggaggaaatccaggcagaggtggcagcctgagcaaaggcgtggaagggaagaggagcccaggcagttcagaaatggtggataattaggcaagacaggctggggacaggtgtgcgagtggttgggaaggggaggggcaccacacggggtagaacctagggcctgggcccagcgggcagtgtgagctctcagcagggtcatgacataggacgccccctctctctgatggaccttgaggtgtgggctgaaagcaaggccagaggcaagtaagctggactggtgacgtgctgacccaagaggtgcacaggcacataaaggaagggctggcaaaaagaggcaggaaaacccaggagacactgggcccccgggagaagaccgagaaggaactgatggtagtgatggtgtttgccatgtgtaaggcccttgttcagtcttcccagaacagtcaggtaggtactatcattatccccttttatctatggggaaactaaggcccacaggttaagtaacagcacacaagtggtgagcacacaagacctcacagcacacaagtggtgatgccaggattcaaaccaaggctgctggcttaagtccagggattcaaccatcaaagcagaatttagcttgttagttcagacaaatattccaataaaaatcacacttagtgttaggaagtaacgcagattccatttgagatctccctaaaaattctaataaagcaaatcaagttaaaagcttgggcaggaagctacagagaacctctgagagtagcatggaggtacagtaagggtgggcactccctcctatcaccaagggtgactctcacactggcagtaaaggggccaggacctctgtcccggtccacctctcagctgcacagccatggagctgacatacagctggtccacagtaaactggactgggctcagccaagggtctgagattgttgcaagtgaaagagactccaatgtccctcagtccactgactctcaaactgcattttgtgacttagaggctcccagtgccctggggctcccagtccctctgtaccccctcactttctccaaaaaaagcagagaacctcattttatgaattagaggacttcctataagatttagacagaaagagtttctcccatcacttaaaagatttgaacaacactgatctgagctacacctcaatgacccagcccctgagtctcttctggacacctgtgccaagggtcacccctggtgtctggctcctgggtcagcatgacttgaaaggaagacctttttagggagcctgttctctcctctgtaatgacagggtcttcgtgagaactgtgaactccatagctctgttgacctactggttgagctgaggcctccactgggtatagccacagccagtgctggctcaggggctacctccaccttgtggttggaatcggatagcttaggttgtcacagacactacagtacttctgatgcacagacactgtagatatccccaattaaagaagaggacattgaggttcagagaggtcaagttgctactctggagtcaggctgggcaaagagcccgaggtgagtcacaccacagccagcacctgttctctgcttgctgccaccagaggcccccaaaaccaagcatgaacctgtcctcctggccaaccccagtctcctgcctcacacaggaagaattcacaccagaaacactctttaagtctggaaggcaatgactgcatccttgattgggttgtccatgatagggattttctgtgcctgtgtagtatggggctagggcatgggtttccaggttgctctcatgggataaggggtcagagaaaagggaggaagaatgtggccactcttagaacccctgtgggcctatctcactcctggtaagaggcaggagcccagcaagaggagtggcttctggatggaagacaatagctcagtttttgacatgctgaggatgcattggtgcactggagattagaaacgggggtctgggccgggcatggtggttcacgcctataatcccataactttgggaggccgaggcaggcaggtcacctgaggtcaggagttcaagaccagcctgcccaacatggcggaaccccatctctactaaaaatacaaaaaattagccgggcgtggtggcgggtgcctgtaatcccagctactcgggaggctgaggcaggaggatcacttgaacctgggaggcagaggttgcagtgagccaagattgcgccactgcactccagcctgggcgctaagagcaaaactctgtctcaaaaaataaataaataaataaataaaagaaaagaaatgggggtctggagctcaggaaagatgtttggtgaggggatgaggaacctgctcacagcgccctcttgtgagctgaccaattcttcctttaggaaaaaaatctagtgagcccagccaatggcatcagctgccctggcacggtacaaagcacttgatacttgtaccttcacttaatcctgacagaatactgagaacagttggggggtgggtggaggtggtgatcaggaagggaaagggaacccccttcacagaggaggaacctgaagcacccagggcagtgatgaagctgaggttcagggggccctggcctcgccctaggtacctgtgacccaggttctcccagcccagcgcatgccctccacggacaattcacaaccagatgctgacaaagggcactggtgtctggatgtactgaggagcccatgctgactcttggtgtccatatgtacattatctaagtccttaagtcactcagaagatacttactgagttggtccagggccgagggtggcataattactgtggaaagaacatttaagaaatattaaaaaataaaaataaaaaggacagaccaaaggcaagatgcagtttctttatatctaacaaaaagccttaaactgtttttagggtagccagaatgtcccagtgatctttcatgaagaatcttacttgatgtaatttattttgggaactgaatggttatcagccataaacctaaccataattagcaccccaccccaacagagcaagtcagggataaatcccagcaccattttcacagtaacactagcttctgactcccacatgcaaagtaagtactgttgaaggctacagcattgcagacttagggcaggaaaagttactattcaaataaaaacaagcacatactcttccctcctttctccacatctgacctgtcattaggccctgctagcatggacacagagaagcagcggtactgtgtggagaagcggttttggaagaccctgggaatagggtggtcgaacatgttgaaagagaactagaaggaggaaagagaaacaagtattaaaacaaaggtacatttcttcatgtcaaaagccaaaacatgtcagagtaattaatgctactaaacattgtcagagaacacaatgtactgaaatcttcaatgtaatcttactaaatacaaaacaggccatgccaagcctgtcctgaacctttttcagggctatgctcccatcttcatcctcaggatcaaggcccaacctcttgcatacctcagagacttgtactgacagccccacagactcctgcctgggctagttcctctgccttgaacacttttcctattatcattaatctaaacaatatttgttaattgaaacatctctttattgagtgcctactgtctgccaggctctgatatgagcacaagggaagcaccactccagtgatgtctgtccactaacaaaatagataccacccctgtcctggtgaaaatgacactcaaagcaagagagatatacactccaagcaacggacacacacacatgtgtgtctggcagttctgaagacaagcagcagggtaagtagacacagggctcctgggaatgctattttaaataggtggttaggaagggactctgcacaaagacctgaatgctatgagagggagccaggcaaaaaagagggaaagacattccaggcagcaggaagaacaggtacccagtggttgcaccccttcccctgggttccaattaccatcctttcctttccccaggaagcctctcttgctctgctgagggtcaggtctagtgcctctccagcgtgctctcacagcacaaagtaggtacacgttacactatgttatgatgctttcttacagcaacaagcaaagctaaaacatgatgccattaaaaagataagatcctagatcttaaactgtagactaagatgaggcttagcaaacatgtatcaatttgaaggttttctcaaagtacagtattcctcccaccccccacccccatatccacaggggatacattccaacatccccagtggacgcctgaaaccacagataatactgaaatctatacatactatgttttttcttatacatatctacaattttcttatacatatctacaataaagtttaatttataggctgggtgcggtggctcacgcctataatcccagcactttgggaggcagaggcaggtggattacctgaggtcaggagtttgagaccagcctggccaacatagtgaaaccctctctctactaaaaatacaaaaattagccgggcgtggtggtacacgcctgtaatcccagctactcaggaggctgaggcagaagaatcgcttgaacccaggaggtggaagttgcagtgagccgagatcgtgccactgcactccagcctgggcaacagagcaagactccatctcaaaaaaaaaaaaaaaaaaaagtttaatttataaattaggcacagtaagagattaacaattaataataaaacaattacaacaatatactgtaataaaagttatgtgaatgtggtttctattttaatatttttggaccatggttgacctcgggtaactgaaaccacctaaaatctcacaggaggatatatattcaaaagaactggaggcagaatcaagaagagatttttgtacaccccgtattcatagcacaattattcataatagctaaaaggtggaagcaactcaagtgtccaatgacagatgaatgaataaacaaattgtggtatggtatatacatacaatgaaatattattcagcttttaaaaggaaagaaatcctgtcacatggatgaaccttgaggatatcatgccaagtgaagtaagtcagtcataaaaggacttatattttatgagtccgcttctaggaagtacctagagtaggcaaattcatggagacaaagtggaacagagattgacaggggctgtgaggagcagaaaatggagagctattgtttaatgtgagtagagtttcacttttgcaagatgaaaaagttctgaaaatctgttgctcgtgaatgtactcaacactattgaactatagactgaaaaacggttaagatgataaaaatttggtttttttaaccacaactaaaaaaaaatctgtattagagaaaatttcttgacttgattccaaatatatatttagtagaaggaatgccacctactgacaaagcagtttactagcaactccaaaattagcaagctgaattagccatctcccaaaatgcaaacatagcatgttcccgcctaaaatctgggatggttctttactccctggcactctaacacagtaatttccaatcttttgtctttcttcttttaagcagcataactgttcagctaaatcttggccagaaccataacacaggaaatagcgtttctgggtgaacaaggccagaacagggtaggggcttgcttcccttgagtgcttctcactagccaacctatgtaagccatttcttctctttgaatataaaaggtaaatccgcacaaaggggcaacatacttaacaacctgcctgcagtttacccatgaacccgaccttctgccccttctttgctgctcccgatcccatctctcactttccttttcaatcccgagacctagcacactgcctggaacatatcaggtattcttgagtggatgaactcaagaatagaaataagccagggtttgacagtgacacacttgggataaaatctaacaatcattccttgtctttactaaaataaacaggtgacaggaagacaataccgtagagtgctttgcagccagacagacttggcttcaactctccagtccctacttctgtgactcgaataaagtacctctgtaaacgttagttttctcatgtttaaaatcatcatcatccttgcttccaaagggattgtagggattaaaagaaataagccgcgatgagggagtacaggtgttaaaagctgtgtaacaggaaatgtaccagcaggtattagcttccatcgttatcattaccgaacacaacaccgctgtacagattcgaaggcacgaacccgtaggcacggagctcacggagctggggcaagagctgggtgtcccccaagagcgggggatgcccactacggattctccctggggagcgccctgattctgttcccatccccagcaaccttgcaactaactttgggtttatggaaacctgttgcgcgtccagcacttgggaaacccgtgaatggacacaaaccttcctttctttcgtcaaggagggcaagtccggctgagacagaatgcgagccacgttcaggaccggcggacgcgaccacaggcggttagtggtcaagggtcctgcttgtgcccggtgcggccgatgagcctgcaggccggactcaggcccgggtgactcggcacctccgccgccgtcccgccccgccctgccccgccgggccctacctcaggccccgggccaaggcccagcccccgcccgctgcccgtcagcgcttaccatgatggacaccacctggcagactccgctcctctcaggcaatgcaacgaagaaaccccgccgaccgctctcccagccgccgctgccgctgccgccgcgccaagccggtacgccccagaggctcaccggaagtgccggacccgagacccggagggggggtgcccgggacaaagcgtcggctgcaaaagagaaaaggccaggcgaagacgctaggctctaaaacaccctcagtagaagcattaaaatgccctttcgtgatttatttccccttttataggtatttttaaacgttattttaaattacgtgttgacagtattcccctccagacgaatttagtagggcccattgtccttacgactacactacccacaatgcactacccagactgcctctgcttcagccatcgaggactcgggcggaactaagctacaaatccttcttcaaaccacaccaaaaacctattgcaaacgtaaatgctgccccattgggtatgtgactgagtttaatgtatggttagaagtatactttccctgagggttcccagtgggaggcagtaggcttctcttcccaaagtaaagatgtccgcccagcgtcgcttttctgggtaaaagcgagtcagagttgaagggggcaacagtgtttgcgttcggcctcagaggtgacgcttctttgggggcgggctggagttttctggccgtgaatggcagagcgctaatggccgcctccaatgtggcccaatcagaaagaaaggaaggctgggaactaagaagctattggttggtgatccctggaccaatcggaggagccgtgatttggcgggagtcttgaccgccgccgggctcttggtacctcagcgcgagcgccaggcgtccggccgccgtggctatgttcgtgtccgatttccgcaaagagttctacgaggtggtccagagccaggtgacgcccagtccgggacccccgccgaggccttgccggtggggaagggatgagggggagcgaccgtgggtgaccgggaggcaggggagggccggggttcgggtcgccgtgttcagccggtctgctcttccccgatagagggtccttctcttcgtggcctcggacgtggatgctctgtgtgcgtgcaagatccttcaggtgagttctgcggaccctaggagggcggggccggcgcgcgaggtgagggtgctgcgtgggggcgcagggcgggcagagtgtcaggatgggtgctgagggcttagggtgggagagggagcagggcaggaggtgaacagcaagtgagaggagagagactcggaggagaggttgcctccctgtcccaacggtgtggggtgggataaaggattaagtaaaaggtaaagagactagtttgtatttttgcaataagctattaatattaataggtgaacacagcagttgcatttgggggaaactttggatctgtcgtggcctctcaaatgggggatttgagagagaggaatctgtgacaactgtgggtatagtcgtgtcacaggtgttgctgggaatatgggagcccctagtctattagggaagatcgttagtttggttttgaatagggcatagtatttacgttgttttggtcaggcccttggatcaggaacttttcagaaggcctggaagttaaatcggcatttctccccgatgttttactttggtaatttgcaaaattcacagaatggtatggtaaacgctcatatccctagcacctagcttttcccgtaagcatttcactagctttaatgttatcccgtgtcttttgtctctcaacccgtctaatcttcctcagtttcttttcaaggtaaattgctaatgtcctaaataagataggctttgaaaacactctctctccaggccttgttccagtgtgaccacgtgcaatatacgctggttccagtttctgggtggcaagaacttgaaactgcatttcttgagcataaagaacaggtattgaagatgcgttttagaataacgtggctttttactcaattgtaatttcttgacacagcattctatttccacgatagattaagcgtgtatttaagtatcagctacattaggcaatatggaagagaaaaacatgctgtatttactggtgacttaccacgcccaagttgtagaagcaaaattgacagcaaaaaaagataatgaatgtggatagccccaactttgaacttgttttaacttgttttgcagaaatttgattgtaaggtgcttggaatctagcagtttttaatatggtctagttaaaattattttattttattttggtttatttttttattttttattttttttgaaacggagtctcgctgtgtcgcccaggctggagtgcagtggcacgatctcggctcactgcaagctgtgtctcctgggttcatgccattcttctgcctcagcctcctgagtagctgggactacaggcacccgccaccacacctggctaatgtttttgtatttttagtagagacggagtttcaccatgttagtcaggatggtcttgatctcctgactttgtgatctgcccacctccgaaagtgctgggattacaggtatgagccaccacgcccagcctttatttatttatttttgagacggaacctcgctttgtcactcaggctggagtgtcatggtgcaatcttggctcactgcaacctccgccttctgggttcaagcgattctcctgcctcagcctcctaactagctgggattacaagtgcccaccaccacgcctggctaatttttgtatttctagtagagacggggtttcgccacattggccaggctggtctcgaactcctgacctcaagtgatccgcctgcctcagcctcccaaagtgctggaattagttaaaattattttagaatacactactattttatgttatttctctgagaaaatgcatcctggtttccaacttaaaatccaggaataaatttaaacaatagatgccaggattcctcccacctctgcatggggccaaatgagagatgggacattgtacaccccacagagaggggatgggacatggaagagggtccctggagtccctagccatatctaggattgttttggcagagacaaatcctctcctgatgttcctgttattatgtcaaggacccgcaccagcttggtatttataaggaaagaaagtgctatagtgatagagtgtgataaaggacttaatatttaagtacccataaagtatttgctaaaaacttaaacctgtacgatgccattagcctggagaggcacgcagcatagtactgtgaggtctggagagacccaatcacgtgctcgaagtcttggtctgctcctcattagtttcttgagcctgtccacgagacttgggcttgctgagtctcagcgtgctcctggggaaaactgggagccccagggcccaccctgctgtgtcaccatgctaaagcacttagcatgccagcctggccattttttggagtcccttgccacgtgggcctcgccacatgtcagggactgagtgagtttaagcagaacaactcagaggcttagtgatgaaggaaaaggggcctcctcgatatagctactttacaatatcttcctttttttcagtttcattattttattctcataaactgtggagctaatgtagacctattggatattcttcaacctgatgaagacactatattctttgtgtgtgacacccataggccagtcaatgtcgtcaatgtatacaacgatacccaggtactttttgtgctatgccctcaaactgtctgtactttttatgccatgtacaatgtctcacctggtgttcttggtaaggtgtgtgtctgactaccctgtgggactgggaacagcctgaacacaagaacttggtctttgtcatcttttttttttttttttaaggagagtctggagtacactggcacaatcatggctcactgcagcctcaaactcctgggttcaactgacccttcctgcctcagcctccttagtaggtgggactacaggcacatgccaccacgcccagcaaatatttgtttttatttttgttgaaatggagtcttggctgggcgcggtggctcacgcctgtaatcccagcactttgggaggccgaggcaggcggattacgaggtcagaagattgagaccatcctggctaacatggtgaaaccccgtctctactaaaaatacaaaaaattagccaggcatagtgttggacgcttgtagtcccagctactcaggaggctgaggcaggagaatggcatgaacccaggaggcagagcttgcagtgagccgagatcgtgccactgcactccagcttgggcgacagagcgagactccgtctccaaaaaaaaaagaaaagaaaaatcagcctggagttgctttcagacaggagttttagtcaccacttaggggttacacatcttcatgtcctatatcagacagaggccaagttgtggggcgttcattttattggtgtatgacgtaagaggatgctgtgtttccagacttaagtagactagatggttctcaaagaactgttttcagattttcataatttctgcataccacgtatggtgtaactctggtgcctcactggtaatgaaaacaagaaaattccttagaagcctggaactcttgttaaataggtagctatttgtatgaacaggaaactgagtcagcttattaggaaatgataagattctgcagaagaacatattgtatagttttccgtagaaagaggagaggcttaattcctttttgttttgaacttagatcaaattactcattaaacaagatgatgaccttgaagttcccgcctatgaagacatcttcagggatgaagaggaggatgaagagcattcaggaaatgacagtgatgggtcagagccttctgagaagcgcacacggttagaagaggtgagtttgggtctctcacagctatcccagaggaacttgcactcccagaggtcggaggtcatcctgaagcctgccaggccaaggtgtactgagggcagtgggaagtggaaaagttagcaggcatggatgctgaccctgggctctgctgtcccctggttatgtggcctcaggcaggttactggacttccctaaatagtggcttatctgtccaataggatcctgtcagaagaaatgaaatttaggacagctcagctctgcggctagatagcaaaaaaataatgtagagaagcaataaatagtgtaacccccaccccttccttttctactgtcttctagcatcacttactatgcagtcactgcagaggagcaatgtgggtctgcatcccttggccaggcccagtcccagacaattactgcaggggaggtatcttgtatgtgaagataccagtggttttcaccatgtggaccttgggtctgagctgcttagtgatctggggctgggcccagtggcctacccaacactacggcttctgcaagatgtaaaatgacaggcagaaggtggttgttcccatagcacggagggccacgtgatgcttttgaagatggcctctggctcctgatcttggtgtgtgacctagaatttgcccccgtaatgttctagggtcttcccttcatcctcagcctgacatttcccggtaatgtgcttttgggaagcctttttgagccatatttgagatgttcaagacattcttcatttggggaaggggcaatgcccttcaaactgaggcatgcttctctcttctttctcacctttgtcacccctttcactaggtttgggtgtctcatagggaacctcttggacccactgttatattttcttacctcttgcccagctctttgttctattttttggaagactttttgttttttgttttttttttgttttttccccagacggggtctctctctgtttcccaggctggcctcaaacttcgggctcactcgatcttcccacttcagcctcccaagtagctgagactaagcacatgccactacactcagcttggtctttatcttctaatctttggtttgtgaggggtcctttttgttctctgaatttttttttatatagcattcttttaactatcgatgagctgcatttcattggttcccaaatgtcagtatccaatgggatttcccgggaaacattcatgttctacagataagtcttggaattttccactctgactaataaacaaatattttttaagcacttactatgtgccaggtaccagttaggccctggggtgcgggtatgagagcaaagtcctgcctttgcaaagctttccattgggggagacagatactgatcatgtaaatgagcacaattagggaaagctttcaggtatcaaacatgagttagcaggggatggagccaagaggattcctgggcagagcatccatagacactgcagctctgaggtgggaaggaaagtttcaaggaaggcttggccagcagtgccaaaggaacaggcaaatgagaacagaccagtgggtttggcaataaagagaaggtaggttgtcttgatgagatacaggaaaataatcagcgtttccttttacatacttaacacatcaatttggaatttgtgtttgtaaatgtttaacataatattcatggattataataggcataatttcccaccaactttttattttgaaattttttgaaatgtatacagtggttgaaaggatagtacagtgaatatccatgtaccttcaatctagagtcaacagtggatcatgactgtaggtggtctcagctacttgggaggccaaggcaggaggattgatgaagcccaggaatttgagaacagcctgggcaacatgaagagaacctgtctcaaaaaaaacaaaaacagtttttcacatttgccacatttgctttctttctgtgtattcttttttctgtattatttgagaatagattgcagaaactgatattcttttttattttttattttgttttttcttgagatggagtctcactctgtcactgaggctggggtgcagtggcacgatctcggctcccttcaacctctgtcttctgggttcaagcgattcgcctgcctcagcctcccaagtagctaggattacaggcatgcactgccacagccagccagaaaccatgatattctacacattctttcataagcagctcctaagaataaggacattcttccccataaacacaatgccattgtcatacataagaaattaataatatcctaatatcatgtaatattcagcccatattcaggtctctttaattgtcctcaaaatatattttgcagctatttttatttctgaactattctccaatcaagattaagacatttagctattcctctttactgtcttaacctagaaccataccttacctcttttttttcttttgtttttaatgacattgaaggccagttctcttttctaatatttactactacttgtttcttcatggagtactttaacttgcttctctatccctgcattttctatgatctgtaaattaggtctagagcgttgattttaataacattaagcattcttgagaagaatactttttatataattaaaacctgtgcatgatttataactaagtatgtgtatattagaggtatatatatatttttttgagacggagtctcgctctgtcgcccaggctggagtgcagtggtacgatctcggctcactgcaagctcctgggttcatgccattctcctgcctcagactcccaagtagctgggactacaggtgcctgccaccacgcccagctaattttttatatttttagtagagacggggtttcaccgtgttagccaggatggtctcgatctcctgacctcatgatcctcccaccttggcctcccaaagtgctgggattacaggcgtgagccaccgtgcccggctgctttttagaggtatattcttagaaatatttttaccagcctggtgtggtggctcaagcctgtaatcccaacactttgggaggccaaggcgggtgaatcacctgaggtcaggagtttgagaccagcctgaccaacatggagaaaccctgtctctactaaatacaaaaattagccaggagcaatggcagatgccggtaatcccagctactcgagaggctgaggcaggagaattgcttgaacctgggaggcggaggttgtagtgggccaagatcacgccactgcactccagcctgggcgacagagcaatactcttgtctcaaaaaaaaaaaaaaaaaaagaaatatttataccagactggacaacatagcaagacactgtctctacagaaaaataaaataaaaattagccaggcatggtagcatggtcacataggcccggctacttgggaggctagagtgggaggatgccttgagaccaggaggttggttgaggctgcagtgatccatgatcacatcactgcactccagcctgggcaacagagcaggacctcatctcttaaaaagaaaagaatgaaatatttttattaataagggtgcacattcaaagaggtttagagacaataggttataaataattgttttaaggagttctgctataggccgggcgtggtggctcacgcctgtaatcccagcactttgggaggccgaggtgggtggatcacgaggtcaggagattgagaccatcctgctaacacggtgaaaccccatctctactaaaaatacaaaaaatttcccgggcatggtggcaggagcctgtagtcccagctactcagaaggctgaggcaggaggatggtgtgaatccaggaagcagagcctgcagtgagctgagatccaccactgcactccagcctgggcaacagagcaagactccgtctcaaaaaaaaaaaaaaaaaaaaaagagttctgctgtaaagaaaagaggagacatggggtcgagaatcatttttacttgtcttttaaaggttggatgttagagctggaccccagcaaagatgagagtccgctataaaaataaccataattatacttaatctacaggtgctataatatcgtggctcaggtcacgggtttcaaattttgtatctgctataacagctttgtgactgtaggcaagtgacttaacctctgtgtgccattgtaaaataaggagaataactagacttaattgttttggttcctactgatgtttaacaaattactccagaacctagcagcttaaaacaaccttttccttatgctcatggattctgtaggttaggaatttgggcagagcccagtgaggatgacatctttttgatctgtgatatctgggccctcaggtggggactcaatggctaagaactggaagcatggctcagacatctgctgggagggctccaaaccaggactactgagccaagcacctgcagggtctctccattgaatgtgacttccttacaacatgactgctcaggcttccagcatgaatattccagtcacccgggcagccactgcatggctctcccgaccagccttggagtacctcagcatccagtagccacaagggaggggacaggaccccaccatgcattgtggcagggtcaaagaaatctcaggctgtgggaattttgttactttattgaggcataatgtctacacaattcactaggtggtacaattcaatgagatttaacaaatgtataaagatgcaaccaccatcccaccatgatagagaacaattccattacccgcaaaaagtttcctcaccaggaccatggcttttttttaattaaagtttttcttttgagataattacagattcacatgtagttgtaagaagtaatatagagagatcacttatatactttgcccagcttcccccaatggtaaaatcctgtagtataatatcacggtcaggatgggaggctaaggcaggcggatcacttgagcccaggagttggagaccagcctgggcaacatggcaaaaccctgtctctacaaaaactacaaaaattagccaggtgtggtggtgcacacctatggtcccagctacttgggaggctgaggtgggagaatcacctgagcccagtaagtcgaggctgcagtgagctgtgagcacacaactgcattccagcctgggcaactgagactatctctaaagaaaagaaagtctcctttctaaatttataaatcatgtgatttttcagttggcactctaaaggttagaaatcactgtgaaagttctgccagaaactgaatatgtctattccatttatgcattcagaaactgccaaaataacccatgggtattgctttaaaaaaaaaaaaaaagatacagaacatttccagcactgtaaggatccctctgttgcccttttatagccacacccacttgtctgctgcctggtaaccactagagagctccatttctgtaatttcatttcaacaatattatggaaatggaaatggaattatacagtatgtagccttttgggattggctttttttcgctctgcataattcttggagattcatccatgtttgcttgtatcaatggctcattcctttctcgtccatcagcattgtgcagttttcagtgtataaattttctgtttttgttagatttatacctgcataaaaacaaacaatatttattatttctgcgtgctagccataaatacgtggacaccaaaatttaaaatacagtatcatttgcagtcagtcaaaaaaatgcatagtctgctgttgttgggtagagttttttagaaatgtcacttacatactgagagttggtggtggtgttgagttctgtttgcttgctgcttttctggctagtaatactttcaactcttcagaaagggacattgaagaccccaactctgattatagatttgtttgtttctccttccagttctatcactttttacttcacgtatttatagctctcttgtgcgcacacatttaggattgtggtgtccttttggtggattgacccttttattcacttagtgtcccactctgtctctggtaatttgctttgctctgaagtgtgatttatctgatattaatattgccactcctgctctcctttgattaatgtttgcacgatatatcttttcacattctttagtttcattctgcctatattgttacatttgtagtgaattttttaaaacagcatacagttggctcatatttttaaatcatgttttttaaagccattctctatctcttaattgataaacttagcttacttacatttattttagttactgacatgttagggcttaagtctgacattttattttctgtttcctggtctctgttttttttattctatttttttcttgttctttgttatttgtatttttatttttttgagatggagtttcgctctgttgcccaggctggaatgcagtggcgcgatcttggctcactgcaacctctgcctcccaggttcaagcaattctcctgcctcagcctcctgagtagctgggactacaggcacgtgccaccacgcccagctaattttttgtatttttagtagagatggggtttcaccttgttgggcaggctggcctcaaactcctgacctcaggtgatccgcccacctcagcctcccaaagtgctgggattacagccactgcgtccagcctgttttctttctttttctttcctctagtgtttgtgagtctatctccttgtatagattttttagtggttgtttcaggttattacattacatatccataacttatcacagtctactggtatcatcattttaccagttgagtcacatgtagaaaccttatcttcttttttttttttttttgaggtggagtctcactctgtcacctaggctggtgtgcagtggcacaatctcagcttactacaacctctacctctcgggttcaagcagtactcctgcctcagcctcccgagtagctgggaccccaggtgtgtgccaccatgcccggctaatttttgtatttttagtagagatggttttcactctgttggccaggttcgtctcaaactcctgacctcaagtgatccacctgcctcagcctcccaaagtgctggaattacaagcatgagccactgtgcctggccttgtcttctcttaatgtcttttactctgccccatttataatataattttcttaaatatttcctccacatatacagtgttataatttttgcttcagtaattaagcataattacaaactcaagaggataagtaaggaaagcctattgtatttacctcatttttgcttactgtatttttttcttcctttccagtattctaaggtttcttttccatttcctttctatttaagagtctcctttaaccgttcctttgggggagagctactggagataaattcccttagttttccatctttgagaatttcttgatttttttttttttattcctaaaaggtacttttactggatgtagaattctgggttaatacttattttctttcagcatttggaaaatactgtgccacttactctggctgccgtgatttctcatgagaaatcctctgtcattcaggctttatccctatcatgaaagtcttatttttctttggctgtttttgagatattttggttttgtttgagtgttcagaagtttaattaggatgttaggatgtgtcttggtgtggatttgtgtctatcctatttgtttctcttatttttttgagacagagtcttgccctgtcacccaggctggaatgcagtggcacgatctcagctcactgtaacctccacctcccgttacccagcttcttgaatctgcaggtttatgtcttttttttttttgaggcagagtctcactctgtctcccaggctggaggacctgcaacctctgcctcctgggttcaagcaattctgcctcagcctcctgagtagttgggattatagacatgtgccaccatgcctggctactttttttgtatttttagtagagatgaggtttttccatgttggccaggctggtctcaaactcctggcctcaagcaatctgcccgcctcggcctcccaaagtgttgggattataggtgtgaaccaccacacccagccagcaggtttatgtcttttgccaaattttcagccattatgtcttcaagtgtgttttcagtgcaccctctttctcctcctccagggcactgatgacgtgaatgttagctcttttgttgtagccccacaagtcccagaggttctagtttttttggtctattttttctcggttgttcagactgggtaatttctgtctttctgccagttcactaattcttccctctgtccccttcattctgctctcgagcctatttgctgagttaatattccagttgtatttttcagttctaaactttcttctatatatatatattttctttctttctttcttaaactttgtttagaacacttgtctcttctttagatctcttatttctttgctgaggcttcccggctttcatttgtttcaatcgtttgtcattgctcgttgaagcatttttatgatggctgctttaaaatcttgggcagataattctaacaactctgtcatcttgctgttggcatcggtgggttttcttttttcattcattttgagatcatcctagttcttggtatgatgagtaatcttcaaatgaaaccaggagatttttgtattatgtgatgagatttcgtgtcttctttaagtcttctgttttagttggctttctctgacacggctcaagcaaggagagtgagtgatgccaggtagaggtaaaagatcaggttccccacctgatgtctatcacctggggcagtgaaggtccaggcttcccactttgctgcctcttaccctcctagcagggaggggaggaatttctcattactagaaggtgggggtggaagtctgggttctcccaccattggttctcccacccagaggtggggtgtggacttgtcaccaaccagcaggggttgcagtctcagttccctccttggcctctctgataccaccagacagagggcttggggtgccttgctacagcttcgcaaggatgggagcctaggctcccactgggcctttgctggggtggatatggatgttcttggtggtgttggctagagtagatgggctactgcctaaaagctttctgtcttgggaggttgctccttcccagtcctttgactagacagagcagcttttgtgggtttttttttttgttgttttgttttgttttgttttgttttgttgtctgcacctgttggtatttctaggttgctggcttttcagctccaactctggcatatatgaaccagaaggaaaactcaaggaacactgtgttgttcctcatgtcccagagtccctaactgctctgccttcacctctacctttcagagtcttactttgtttttttttttttgttgttgttgtttgtatgtttctgaggcagagtcttgctctgttacccaggctggaatgcagtggcacaatctcggctcactgctacctccacctcctgggttcaggcagttttcctcctcagcctcccaagtagctgggattacaggcatgtgccaccacgcccggctaatttttgtattttaagtagagacggggttttaccatgttggccaggctggtctttaactcctgacctcatgtgatccgcccgcctgtctccaaagtgctgggattacaggcgtgagccactgcgcccagccttactttgtttgatctatgatgtcgaagggttttcggtatatttaatgaatgtatggggaaaaacatatctactccattttcccagaagcaggagtctcgggaccatggatttctaaacctaccacattattccaggcctttgttgtgaagattaaacgaggttgtgcctgtaacattagaatagttcctaacgcatggtagaatataagaaatgttagctctcatccatcctgatgtggaagctggtacaaagtgggtgtgagcttaccttggatcccatagtgctgtgggtgacagcagctagggtggatgaacacagttttgcctggagcaggtgcttgggaagcccctactctttctgcccatggtgtctggagagctgggagccagaaggggtcacagccatcccttgcctccatgcctctcttccgtaggaacaggctgtgctcggggcactggtgtgaccgtgttctctctcaggggtctgggcctactgacttctgccaaattggaaccttcttgggctgtggggataaattcctggtgcatttgctccaccttttgttctctttgtccctgtatcaggagatagtggagcaaaccatgcggaggaggcagcggcgagagtgggaggcccggaggtgagtctgtgcttccagctgctcccagcaccagaagcccacttgcctgggggtctgtggtgccacccatacctctgacttcctgtctcaggataatttattgagtttagaacctttgggccagtggctctgggagtgaacctgtggccgctgcattggagaagagctccaggttgttcgccggtcccatgagtgacaggacagccccaaggtctcccaggtacatgccatccattagagaccatggccctggctctttatttttatcaagtttttccaatgtagatactttgatttacaaattatttataagaagtgctctaaaatgaaaatattggaaaggttattctagcttgaagtgagcatgcagcagcgcccttgaggtgggtcccgggggaagcccttgctggatctctcatggaaggtctcccaggccatccagctgatgttccccctgtttcagctgagggcatgcactcctgccgctgccacaggaggaaggctgccccctcggataaggacaacgtaagacaggtgtggtggctcatgcctgtattcccaacactttgggaggcccaggcaggagaatccaggagagttcaaggctgcagtgaactatgattgtgccattgcactccagcctgggtgacagagcgagaccttgtctctaaaaacaaaccaaaaaaggataatataaaaccatttcaggaagcataaggaaagaaaagtgaaaataatccataatcacactgcctaattaaaagagattctgggtttgggtttctattcctgggttatacatacttgtgcatattttacatgatacatctgattttgcatctttctacttaatataaccatttaaaatagttctgaacaggctttctaaacagcctagtacttaattggcagtttcccttctttttgaaatgtaggttacttccaatattttgccattataaataaggcttcagtgaattactttgtgcacacagcaagttttgtcttgctttttcctttgaattgtaattatgggacaatttctctgaaatggaattctgaactataccactttacatcatacattgccactggcagtttgtgttaatttcccaacgttacacatatacattctgctaaagagtcaataagtggccaggtgttgtggctcatgcctataatcccaatactttgggaagccaaggtggaaggactgcttgagcccaggagtttgagaccaacctggacaacatagtgagactttgtctctattaaaaaatttttttaaaattagctgggtgtagtggcacatgcctgtagccccatctacttaggaggctgagttaggaggatcacttgagcccaggatgtcaaggctgcagtgagctgtgatcacaccactgcacttcagcctgggagacatagcaagaacctgtctcaacaaaaaagaaaaaaccaagagtcaatatgtgaaaacaaatagtaccatgatttaatttgcatttcattgaatactgtcaagtttagcatttttccaaaatatttggcttcctgtactgctacttcctgttgaagacctgcattttatgtcattacagaagagacatcctctttgactacgagcagtatgaatatcatgggacatcggtaagtatgaataggtggaactcactataaagttctgactccaggggtcagtgtcctcaaatgtgaagaagaaacgtagattttagagccacaaaagcctggtttgaatctgagctccatgtcttccccctgtgtgaccttgggcaggtgttgcaagctctctgagccttaaacatctcctcctctgtaaagagaataatcctcatttcagaggtaattattaaaatggtcgtttgcacccaataggtgatcaaagaagagcagcgtttatttttgttcatcaaaaacacagaatgagtttgtaccagtctctgtgcgagaagataaaacgctatagacttataatggcccatcagtgtgtgtcttttacaaaacagaatttagtgtagaaaacctactatgtcaatagtgttgagcagagctcaaggccttaaggagccctagaaaataagtttcaataaaacatcctgtatttagtcttagaatttaatactgggaccttgaactctaagcaccgtatttccagtgtcccttttattgtcaaggttccattgtcctttgaaggatcatccttttgctgtctctgctcagtccttgctaatggaaaattctaaacagttggtggggagggtgctgatgctcacttagagaagataactccctccagatatatggggccagttcccttggaaattctctccctggaggaagcccgcatctcacggcaaaggggatcttagggtcttctggtcagacaccagtcttcctcaaggtcttttaccaaatagagaccctctgcttatgggagttaaatgctccgatgtggacagccctgttggaaagagaggtgctgaggcccctccctctttaatattcaaataattggacccagggctctgcctcacctggccttcctgggaatgtgtttgaggacgccagccaagcaggaggagtgtgcggatgcagagccaggcaaatgatggggtctcctggcctttgggattcagtgcctgccttgggcatcactgaggaacacagggagatacaaagaggccccagccagtgctgcacccgggctgcccctaccaagtgaattcttcccttgctacaggataaaatatacagacagtaatgattttaggtagcaaaggagttactttcagtcttcctcttctcagtttagcgtgtactcatcccacatgtcgggctggaatccacccacatgccctggccaggtagaccctccatccgcaggggtttgccagggcccttctggctcaagtccagtctggctgcatggcccagccccagcacatgcccctcccatgagccttagacttctctgcttccttacagtcagccatggtgatgtttgagctggcttggatgctgtccaaggacctgaatgacatgctgtggtacgtagcccctgcggcagctgtgtgggagtatttgttgccttggtcagtgccacataagcagctctgtcctcccacagggagggtgtttcccttgtccccaccaggagtgtcagatgcagcccctttctgggtatgtgtgtgattttggtctttttcctaactgtgaagccctgggagcttcacacaaacatgggacttggagtgtcggagaatgcagaggaagagaatacagtacagcttcaccttccccactcctgctgctcagcctgtactcagtaaagtcaagtgacaggaggagtgtgagatttgaaggaggcagcctttgcagtggctcacatccttaattctacatccgtaatcccagtactttgggaggccgagacaggagcatcacttgagtgcaggagtttgagactagcctgggcaatgaagtgaaaccctgtctcaaaaaaaaaaattgtctgggcatggtggctcacccctgtaatcccagcactttggaaggtcaggaattcgagaccagcctggccaacatggtaaaaccctgtctctaccaaaaatagaaaaaaaaaaattagccaggcgtggtggtgggtgcctgtaatcttagctactcaggaggctgaggtaggagaatcgcttgaatccggaaggcagaggttgtagtgagccgagactgcgccattacactccagcctgggcgacaagaatgaaactctgtctcaaaaattagccaggtgtcatagtgtgtacctgtagtccaagctactcaggaggctgaggtaggaagatttcctgagcccagaagttcagggctgcaatgagctacaattgtgccatcgtactccagcctgggtgactgagtgagatgctgtctgcagaaaaggaggcagctcttgctaggcatccttgcagtcctggcacacggtggcaaaatttgatgtaggaagaaccatccctcctctgagtccgctgtgcgggctgcacctggcatgaccgagcacagtggggcccagtcactcttgctgtgggctggccgtcatgctggggaagccaggccttgcctgggtctcaggtaaaagatgagcctgaagatgggagccttgaaggctcaccagaggcctaaacactgctactctacatcctgctactttaagctgcaggatgagtagatgtgaacacaactagggccccctgtgctgggggcatgtgccatgaggggctcagagagatgaagtgataccagggtcaccaacagctcagcacaggcctctgccatgatactgtatcaactccactccgagtgttggggtcaggagtgcaggacaagagcagagcatggcctaggagtgggtgggagtgctggctcctattatagctgccatggctctcctgggaggttttcctcctctgagtacctaaagctcccacagtggcagacactgcactgcaaggccccaattacccttctaacctcttcacctcaaggagagaggccacctgactgaggcaagccagggtctggccccactggcaggacattccccagagtgctgagcttgggcccgttccatcatctcactccatcccccaggcctcattgagcccaggtgggctataggccggctccactgccttctcttcttccaggtgggccatcgttggactaacagaccagtgggtgcaagacaagatcactcagtaaggacacactcccttgccttgcagggtcagccctgtgctgtggccaggtgcacagcctgaccatagccactaagtttttagcagggtccctgtagggtcctattgagaagtgaggactggccctcctccttgggcccaagcatttgtcactgaggaagggctaactgagtaccagccgagtgaccgtggccttgtgtggcgtcttcatctggcaggtagagccagcctccccagttctctcccagtgccctgcttgtgctgggtgctaccagcagggccaggcttagaggcaggtgctgaggtgtggcccttgcagtaggtggggggatgggggaagacaacacaggagcaggttgggggcgggatgagagcccctagtgaggaccctgagtatcttgccaagcagtaggggtttgaccccaaaggtaaggggaaggctccaaaggtaaggggtctggtgtgaagcagaaccccttttgccctcagtggtgggctccccatctgatagactgacggtgagctgcaaggctgcctcagaatgcagatgctgcagggcgaagtgggggttggcttcttctttcatccctgctaatgcacgaagtggcccaaccttctctagtggccatcaggcagaatctcttagggattggcatggacctagaccccaacatgctggtcctctcctaggggacccatgtagatgtccccaggctgtcacctggcacagccctaggcgcagcctccaattgggtgctggtctcctcatgcagtttgaataggccccatgccactatttcctgcctccccagccctgcccctgtctggatcctgcaataaggcccacaaggcaggagaagcccaagtttcaggcctggagctacggcctggacaggtcaccttggcacagcccactgccctgttgggccctgagtcccttcgtgtgttaagagtagcatggaatttgtgcacagataatgtaggggctagaaacaccatggtgtatgcactgataggcactgttcctggtctgtagcagtctctcaggtgaggcccccacggtcactgtcctggttggtggccctttggaacctagagtggggtcttcctgctctcattgtgctcagtggcacttcctgtacaggatctgtacctgaaactgtccctataaactttacaaaattaatgagggcagggggaggggagaaatgaaaatgaacccagctcgcagcacatcagcatcagtcactaggtcggcgtgctctctgcctgcttcctcgtagctgcttggtgtctcattgcctccgaaacatgtagaccctgtcacaagattgtagttcccctaactgctccatagatcacaacttgaaccttaggaaatgccgttttccctttgagatatttctttgggtcccacatactgatggagctactgactgagctgctccgaaggaccccacgaggagctgactaaaccaagagtgcagtttgtacaccctgatgattacatcccccttgccccaccaatcaactatcccaattttccagccctccacagtctccctaaaagccccagcccaaaactcctcaaggagatggattgaagatctcctcccatctccttacttggtgccctgcaatcatgaaactcttcctctgctgcaaactctgctgtctcagtgtaacaggtctgttactgcacagtggacatatggaccgcctggtcctataacacattttggaggccgggcgcgatggctcacccctgtaatcccagcactttgggaggcagaggtgagtggatcacctgaggtcaggagttcgagaccagcctggccaatatggtgaaacaccgtctctactaagaatagaaaaattagctgaacatgatggcacacctgtactgtagtcccagctactcgggagggtgagacagaggaatcgcttgaacccaggaggcggaggctgcggtgagctgagatcgtgccactgcactccagtttgggcaacagaacaagactccgtctcaaaaaaaaacaaaccaaaacaaacaaaaaattatggagagcctacctgaagccccttatgggtatttgcctgcggctaggtgccccttcactgttcggtgggcaggacctagagacaagcccaagtggccactgggctccattgaaatatgggctgttgctggtgccctgcctgttgacggagcagtgtcaaccttcggtgcataaactgctcgcagcaaagacagtttctggttttcaaaggcattagaaaagttttctccatgcaactggcacccctttctcttctgatttgctggcctccttggaggtcttgtggcctcctcagaatcttgtgacatattataaccctttcttaactggaaatgacccagacacccaacaagcatctaaaataattttaggattttaagctgcatggaacgtttgcctagaagcattcatacaatttacatttcatgcatttttaagtttgcctagattacttatgaaaactgagagacaaaactagtcatcatttcaaattattttattgttaacctttttctttttttgaaatggggtcttgctctgtctcacaggctggagtgtgttggcatgaacgtaactcactgcagctttgacctcctgggatcaagcaatcctaccaccttagcctcccatgtagccgggactacaggcatgtgtcgccatgcctggctaatttttttgatttttttgtagagatggggtcttactttgttgcccaggctgctctcaaactcctaggctcaagcaatcctccctcctcagcttcccaaagtgctgggattacagatgtgagttgccacacctggccttcttaatcatttttatagcctgtgaccatcagatgttcacctaagaaccttaaagttaaatgcatgtgtatttttgctgacaactcagaagattcagctgttatcattaaaccaacaatattcatcttatttgtcaaaaagtcatacaaagatcattctggttttggttagttttacagtcttaaaaccttttatgcaaagtcctgacaccctaaatatccagtagagacaaatataaaatcgttcagtcaataaactcagaaaaaagatgtacgctgatagttttgaagacgtttctatttttattttaccaataattttaaagccagcttatttactaaagatcatttaagtcacatgaagttgaaaaatatttgaacttatttactttgtttatgagcactcatttatttataagccaatttggtagcatgtaggcacaacacataacacaacatgtacatacatctaaatttattttaacccacatacacacacatacaaaggtacagcttttactgcagaactctagccatgagacagcagtacaaactcaccagtttataaaagagggctggatccaaattatttctgacaaaattggaaccattcacataaataaactttgtttatcccagtaggtaattcagtgaaggctgtgaactaaaattttgaataaagcagtttctatagcagtttgattttaaaaacttaccctttctttttttctccagtttcaagttttcaatgattacattttagctacaactggctgagctgtataagcaaaacaaaatctccaagtagctctgaataataccatagacagtgagtcttttctcaataccagtagcttaataataccagattcaaagcagacagaaaagagacaggggtgatggctcatgcctgtaatcccagcactttgtcgggggtgggaggattgcaggaatccaacctaggtaacatagaacccctctctataaaaataaaaaaaaaatcagctgggcatggtggtgcatgcctgtggtcccagctacttgggaggctgaagtgggaagattacttgaacccgggaggtcaaagcttcagtgagctatgattgtaccactgtcctccagcctgggcaacagagtgagaccctgttttaaaaaaagaaagcaggcagaaactttctcatagtttttccacaggaatttcttcttttagtgggtaggttacccactgcactatcctgatgaagatgtacgtctcttgtcttcccagtttcacaagatgcagcccagtgcccagcttggagtaaccaaatcaatatttctcattccagctgagacgatatacacacaacaaaaatgcagacactgatcattccactctgcgcccagatttgacgtggcgaggctcatacttgcccctgtcagcccccagcacctttgatctactcaaagttgggaggaattacctccaaccaggagttcagcgggtggtctctgggcaagatgaaaaagtatatggtcaacctgagttaggcctgctgagctgctgctagcaattccttcagggatccctttcacaaacataaacctacataacaagacaaagacaaacaaaaggccttccgaaatcaagttccaaatttcagaagtcaagaggatttctcccaagcagtgctctttggtctccttccaatgcagaggaagtcccctcaaacgaggcccttcctattattagggagggtcgacaagacctcagaagaggcctcgagacttcagagggagccacaaaacctttgaagaggccacaggacctccaaagaggccagcaaatcagaggagaaaagggtgctggttgcacggagaaaacttacctaagatgcctttcaaaaccagaaacttgctttgctgcgagcagtctatgcaccaaaggttgacattgccctgtcaacaggcagggcacgggtggcagcccatatagttcaatggaacccagtggccgcttgggctttgggcttgtctctgggtccttcccactgaacagcgaaggcgcaccaagccgcaggcaagcaaatgcccacaaggggctcgaggctagactcaccataatgtgttataggaccagcaggtttgtatgcctgctgtgcagtaacagacttgttacactgagacagcagagtttgcagcagaggaagagtttcatgattgcagggcaccgagtgagaagatgggaggagatcctcaaatccatctccttgaggagttctgggctgggcttttttggttttgtttgtttgtttgtttttgagatggagttttgctcttgttgcccaggctgcagtgcaatggcgctgtctcggctcatcgcaacctccgcctcccagattcaagtgattctcctgcctcaccctcccaagtagctgggattaccagtatgcagcaacacgcccggctaattttgtatttgtaatagagacggggtttcttcatgttggtcaggctggtctcaaattcctgccctcaggtgatctgcccaccttggcctcccaaagtgctgggattacaggcatgagccactgtgcccggcctgggctggggcttttaaggggactggagggtgaggggctggaaaattgggagagttgattggtggggcaagggggatgtaatcatcagggtgtacaaactgcactcttggtttagtcagctcctcgtggggtccttcggagcagctcagtcagtagctccatcagtatacaggacccaaaggaatatctcaaagggaaaacagcatttcctaaggttcaagttgtgatctacggagcagttaggggaactacaatcttgtgacagggtctacatgcttctgaggcaatgagacaccaagcagctacgaggaagcagtcagagagcacgccgacctagtgactgatgctgatgtgctgcgagctgggttcattttcatttctcccctccccctgccctcattaattttgtaaagtttatagggaacatttcacccactctgctgtggatccctgtcacttacggagtctgtcatcttggctgtatgggctgtggcctctgcggtgcccattctcaggaggtgtgagacccatgaggaccggaggtggacaaggctagagaccacacccccccgctccatccaatcatgttttcctgggtgcttggtttctatgcaggctgcatgtccttagtccctgcatgggaacagctcctgtggtgagcaggcccctgaggaaggccttgagcgggaatggagcctaggcttaggctgcctggtaagagctggagggaaccagccgaggcttgtgctacttttttttccagaatgaaatacgtgactgatgttggtgtcctgcagcgccacgtttcccgccacaaccaccggaacgaggatgaggagaacacactctccgtggactgcacacggatctcctttgagtatgagtatccttgtggcccagcctgaggggcacaggcagcacccctgctcagcaggccttgtttgctttgtcaccctctgtgggttctggccacatccccaggagggaaagcaggtggggcaggaagttttgggggaaggggctgtggtgtgctaccccagctcatctgtgtggctttggcttctaaatgccagagctgagtttggaagtatcacccttctccagcacatccctgtaaagtgcttattgtgggcctggctctggacatggtagcagtgcgggcagtggttcacgcagtcaggaaagaaggcagctgccatgtaatcacacagcgtgacgtgtcttttgagaagcacatgggacattggtggagtgctcagaaaagaccatggggagaccacatctcacacagtctcagccacactcagtgtggcagctgctgtactgagcacaggaggggctgggggactggctggggtcaggtgtcaggaggccagagcaagccttgtgagccaagggcagcgggaggctgtggagtgaccagagtttgagtcagggtttttaaaaggtcccttggctgcccagtagaggtaggttgggggcaaggagatggtcactgctttccaaggccacacaatagtggcttggcccaaactgcagcagtggctgtaagcagtcagatagcatgatgtcagggacggagctgccctgtctctgcactgtgatggctgggaaggaggaagagtgagggtggacacgtcagtagtcaggtggccatcggagcctggggagcggggtggagctggctgaactcctggggaggggagccgctgtgcactggagctggtcccatcatgtgcgtggcagggtgggctcacttacccagggaccatgggagtgtgtgactgagacaggagggagggagtcagggagctgaggatgctggggcttgaggaagctgctggagtgtgggcagggagcatggtggtctgaaggcctgggagttcccaggagttgggaggggcagtggtgggaactgagcatgccgaggaagcaggcaggaccaggctctcgtcctgtagaggggaaatccaccgtgggggacagtccacactcacaactgcgctcacggtgccaggggcagtgatggatatgtttaagaaaagggctgaggaggtcgggcgctgtggctcacgcctgtaatcccagcactctgggaggccaaggcaagtggatcatgaggtcaggagatcgagaccatcctggctaacacggtgaaacctcgtttctacgaaaaatacaaaaaatcagccaggcatggtggcgggtgcctatagtcccagctattcgggaggctgaggcaggagaatggcgtgaatccagaaggtggagcttgcagcgagccgagatcgtgccactgcactccagcctgggcgacagagcgagactccgtctcaaaaaaaaaaaacgaaaaaagggctgaggatgggggcgcttcgtggatggggtcccagtggagggctctccggaggaatgggttgtagggagggctgggctaggtggagcaggaggtgcaggacgacaagctggtgacgcccagcctcctacgtcatgtgtggccatgactgctccatgtgaccacagcacctggactttgcagacccctgtgctccagattctctgcctgtcagacggatggtggtctatgcctgtcacttcacaggctctctgtatgggtcagcttaagctaagaaggtcaaagggctccaggtcactcttgggatacctggttttgcaggcaggcctggtgagaaagggccccgccatcagagtggcccacctgctggagttacgagagtgctcagggcggccagtgggtgcttgcatgctccttgactgcaggcccagcctccgcctggtgctctaccagcactggtccctccatgacagcctgtgcaacaccagctataccgcagccaggttcaagctgtggtctgtgcatggacagaagcggctccaggagttccttgcagacatggggtgagtgactgcctgggcctctgcagtgccagccctggccacccccaagggaaaagcccctctgctttgttgtgaccaacttagttataaaatgcagcctgttctgccataagctccttgccctagatcccagaatatcttctgaatgctggtgcggggacatcctcgcttgcccttggtttgggtttctttccaccctgtcggtgtgtggtgacctcactcatgtggcttgggcttgctctttccagtcttcccctgaagcaggtgaagcagaagttccaggccatggacatctccttgaaggagaatttgcgggaaatgattgaagagtctgcaaataaatttgggtaaacacacatttttctggatttatcttcattacatccaggttcattaaagtgaagggttctactttaactgtgctcctaaaataatgcaaaaaaaaccaacgtgctcctaaaataatgcaaaaaaaacaacaacccgagaatgtacaaatgagtgttatctgagtctggccattcctgaagtcttgagttctttttgggttaaaaataagacttcttcaagcttgtgaggtttaggatcctaggatccttggatcctagggctgctgtgggacctgtgaggtcgaccccagtctgtttcactggagacagcaaatgggccacagggccaggttcaggtgaactctgcccgaccaagtccatgggcactcctggaggcccctggcttctcccaccccagccagctggcatgctaaggtgtgagagaggaccccacacaccccctaagccagccataaagctgttgacaagaaggcacccggccactctgggctgcagggctggtatgtctggacgttctgacctgcctcatcctctgagcagcatggctgtgctggaagcattgacttgggcctgtgagggacattagcacatctgttggcctgcctggcagtgagagcttgcccacaatttgagggtgacagctgtgtttgctcccatgacaggatgaaggacatgcgcgtgcagactttcagcattcattttgggttcaagcacaagtttctggccagcgacgtggtctttgccaccatgtctttgatggagagccccgagaaggatggctcagggacagatcacttcatccaggctctggacagcctctccaggtagcaggagggctgtgggtttgcctcatggggccaccactggttctcacactgcccagggaggtcagttacggggaccccagggctgtgggagtgactgtgtcctgcagaaactgcttgggtgaactggaatcacagtgccagtgtggtgtgcacctgacacattacctgcccctcttcagtatttgtcactttctcttgaatcttttttggcttttttttctttttgatttttaaaattttctctttttttaccttttgtatctcttaacaaaaggcattatttgttatgtatattcgttcttgtgtttaatcttatagttgtcatttctcaattttttaattttccaattctttcttatctcacttcctgagatgtcctatatttttccatgtcttttcgcttgttttgaaatggaatgtgacaatttggatcttttttttagcatgtctgtctagtgtcagactaaagacatcagagaaaaatatctccaaatacactgaatttatttgggaattagaaaagaggattatagtgtctgcgatgcacagctatggcaagccaaatatgcatccaaagagaggaggctaaggggacacttttattggcaaaaggagaagttcacgaaagctagcttggaaacaattcattggtttcagagactcagagccagagttggcgtcagttcagtggtgaagatgcattactgggcaagtgttatattttaagagcatcttatctgaattgttgcagtcctaaagaagggatttcttgtggggttatttagaaagtctttgagtctttattccagacatgcaagcaggagctctccttggtgctttcccagctttaatttgtttgggcctgtcaaaaagtgatttcatcctgggatctgcaactttcacattagtgtactttcattatccagagaggtgttattctgtcccttattctctttttttctaatagtgactttgaggggatttgactttgctacttctctcatgctttttatgtataaatttcatttccctgactttttaggaggaggaggcatgattcagacagcttttctggcttcacagagctgccacttctgttgcttttgtgcagtggtaaagatgcatatgtatatatgggggcctgctttctgggatttcctggttctgctcccaagcacacttttttttccactgctttattgagatacaatttgcatgccatacaattcacccatttaaaatgtacaatgtgatggcttttatttattttattgttatttttttagagacagggtctcgctctgttgcccagggtggaatgcaatggcatgatcatagctcacagcagccttgacctcccagtctcaagcaatcttcctacctcagcctcttgagtagctgggacaacaggtgcatgccaccacgccttgctaattttaaaaatttttgtaaagatgtatcactatgtggcccagactggtctcaaattcctaggctcaagcaatcctttcacctcagcctcccaaagtgctgggaggaacaggcatgagccactgtgcccagcctgcaatgacttttagtaggttgcagttaggttttgcaaggttgtgcagcaatcaccactatctaattttagagcatttttgttgccccagagagatcctcccagcctctggcaaccaccagtctcccttttgtctttatgaattggctgttctgagcatttcatacaaatgggatcatataagatatggttctttgtgaccgggttcttcacttagcatcatatttgcaaggctcatctatattgtaggatgtatcgggattatatgtcttttccctcgtccgccacctgagacagagtctcactctcgctcaggctgtagtccagtggcacgctctcggctcactgcaaccttcgcctcctgggttcaagcaattctcctgcctcagcctaccgagtagctgggattacaaacgcatgccaccaagcctggctaatttttgtagttttaatagagacggggtttcaccgtgttgttcaggctggtcttgaactcctgacctcttgatccacctgcctcggcctcccaaagtgctgggattacaggcatcagccaccatgcccggccagtgtctttttattataaataatattccattggatggatatattctatttcatttatccattcataagttgatgggcatgtggtttgtttccacctattgacaattatgactaatgctgctgtgaacttgcatgtacaagtttttgtgtagtcatgtctttgtttcttttggttatatacctacatgtggaaatgctgggtgacatggtaacactaggtttcaaggaactgccagatttttgaggaactgccagacttttccacagcagctgcaccattttacattcccaccaggagggagggtttcaatttcttcacatcctcaccgacacttgttattgtccatcttttggattacattcatcctagtgagtatgaagtggtatctcgttatggttttgatttgcattttactgatgactaatagtgttgagcatcttctcatgtgcttattggtcatttgtgtatcttgttaggagaattgtctattcaagtcctttgtctttttttttttttttttttgagacagggtgtcactctgttgctcaagctggagtgcagtggtgcagtcatggctcactgcagcctcaaactccttggctcaagccatcctcccacctcagcctcctgaataggtgggattacaggcatgagctaccacacctgctaatttttaaatttttagtagagatgagatcttaccatgttgctcaggctggtctcaaactcctgggctcaagcagtcttccagccttggcctcccaaagcactgggattataggtatgaaccaccgtgcccagcctaaaacttttatatattctacatacaaatcccttatcagataagtaatttgcaagtattttctcccattctgtaggctgacttttcactttggcagtgtcctgtgaagtataagatttgttaattttgatgacatttaagttacctactttttcttttgtttcttgtgcttttggtgtcatatctaagaaaccattgcctaacccaaggtcatgaagatttcacattattttttctactaacactttaatagttttagcccttacattaggagtatgattcactggaggttttttttttttttttttttgagacagggtcttactctgtcacttaagctggcatgcagtggcatgatttccactcactgcaacctctgcctcccaggtagctgggactacaggcatgtgccactgcacctggctaatttttgtattttttgtagagacatgttggtcaggctgggccccttactctttactatagtctccttacacttcagcaaggccccttgctctttaccatgcccccttatactttaccaggctcccttgctgtttaacaggaccccttgctcattaccaggactccttgcactccagggaggctccttaaactttcccttggcccactgcactcacctgctcttgcatagggcaaaactctcagtttgggccgctgctctccagttgcctggagttttaagtcttcttaggtctcactacctcttggctttctctcgcactgatgtagatagtatacctgtctggctgttcatggtctctttttacctgcttacactttggggtttgaagtgttcccttgttctcttaatttgttgcaaatgtgggtcctaggtttttggttttgcaatctagttgctctacttttatctagaaatttgggaaaatccaaaaactattttaccactgttgctgccatcatcccagcattgatgggtaggctttagacattgtctaccaacttcctgctatgacaaaggagcatttatcccactcttgtccaccttccctcctgttggtacagttttgccactatttttaacttctttgtaactttaacatatttatgtcttctttcatcactagtatctcgtctccctactttgtaagaaaaggatatttaaaacactcttagtccattttgtgttgctataaaggaatacctgaggctgagtaatttataaagagaaaaggtttatttgcctcataattctgatggctggaatgctcaagattgggcatctgcatctggtgagggcctcaggctgcttccactcatggcagaaggggagctggtgggtgcagagaccatgtggcaatggaggaaggaagagagaggaggaaggtactaggctctttttaacaaccgtcacgggaactaatagagtaagaactcacttacaccccctagccccagggagagcattcatctattcatgaggggtctgcacccatgacccaacacttcccactagaccccacctcgaagatcttggatcagatttcaacatgaggttttgaggggacaaatgtccaaggtgtagaaacagccttactttgctcttcagtgctgctcagtactttctgaaatttgtgcttttacgttttcaagactgataacaatcttgggttagagaaaaagatataaattgtcttatctttggttacaggttgattttaaaagttgaaagtaaacaaatagttttactttattgtgctaataaactattccagagacaatcatgtgtagtaatagattactatctggcacggctctttgtttttcctgctgtttttaattgcctcctttatcacatccatttttttctcctccaaactccttccagctgtttttctgtgagcccctttttgctggagagtctggggttctgtcttcccaccacagcctggacctacagctctctagacctgctttccactgtccccatggatgtccaaatcttggctgtgcctcttagtttagtccaatgtttcttgggatcttcatctttgtttcatttactccctcattaaattagagcacagttcttaagtaacattcaaagaaagggcgcatgtgagataaactttctgagttcttatatatctgacaatatctttattttactatttctttactattccccccacagaaaacatccgtgttttttattcttgcttttcaggcttcctggaatgacgatgctctgtcttatttttttgccttacattttccatagctttgtcttgttatctatgttgaggaagtttttcttgactccagacttggagtggatgttttatcttttgcaactgttttaatttccatcaacatttcctagtttttaactcttcctttttcatagcatcctgttcttggtttaggaatgtaagagttgcacacatctctctgaagatactaattagagttcagtttaactttctttagttctccaaattatctgtttcttcagggttatttttttaggccataggcatttctcaaatggtctgatgtctttcatattcaagaacgggattgtggacccttggctgggccatgggtatctgggcacagctcactggtcataagacatcgtttcaccttagcaggcaggagccaactgtgacactttgggactccccactgtagggcccagaggctttgcttgaggattctacttattcacagatggtacatttcatatactcagaggggagcctccctttttgtggggaagagtaaaaatctatctgttgggtttgaggggatcccttgtccaacctccagcccttgcccaagcctcccctgtgtcagagtcctcctgggccttcaggatcttccctttgttggcttttagtttcctgtcttctgatacttgcacccgctccacctctcatttgcattactgtgggtttatacattttaaaaaattctttcctttcatgtgaaagacaactcaggagggaaagaagataaattcttacccccaaacctcttcctgaaccaggaaccaagcaaactatttgtgactttggtattttaccaagagttcctgacaagcaccaccaaagccatgtgtctgccctgttacaggagtaacctggacaagctgtaccatggcctggaactcgccaagaagcagctgcgagccacccagcagaccattgccagctgcctttgcaccaacctcgtcatctcccaggggcctttcctgtactgctctctcatggaggtcaggcttcccacagagcacaggcgcctggtcacagcaccagtggcttcgtctgaccatctgtctcgcctccgcagggcactccagatgtcatgctgttctctaggccggcatccctaagcctgctcagcaaacacctgctcaagtcctttgtgtgttcggtgaggggccaggcgggtgctgtgggtacaggagggcaggtgcttggagagctccctggatggggagttagatgctggccttggggtgcctgtggctgttgaccagctgcaaggtctaggcacatccattactttttctgagctgtctttttctcagctgacccctaggaaccttccagttctctcaagctctgattcatcactggctgtctaagtcactcagacaagtagggaggggcccttgcagagtgaacagggctggggcttgtgtcctattgttgcaggtcagggaaagcgggatggttgtagcaccgactggcttcccagcaacagcttgtccactaagctgatttcctgtgcctggctttgtcttctgtgtggcctaaccccctctttgcgttggcgtggaacacactcctaacttggctggctttagggcaggggtcctcacctagccgacatggggctcctcccagatgtgacatgtcaataattgaagtcctcctctgcttcgaggatgagagtttatgccgggggctatttcaaacaaaatgtgctaacaggaagttgaacttttcttttgccgctgaactaaccagtaaaatgatgacagatgacatgtgttctatcaaccaggtaatgtcaaagataaactagggacagagcatgggccttgacgtcctctaggctgtgttcaaagatgagcctcctcatttgccagttgtgtgacgtgaggtagatgatctgacctgatcctcagtttcctcatccgtgaaatgggtgaacacatacccactttacaggatccattcatttaccagacatgtattgaacatccaccacctgcccggccctgttgtggagtgactgcccatcctggtgcacatcctgggacacccctcagtcctagacacaccaggaatactggtcacctgggctgtagggtgtgggtgcagcaggcacagcagagaaggaaaccctaaacctttatcctgaaggagcgtgccggcgggggggacgaggagtggcagctgcggttaagatgaggggatgtgctgccaggggatggagcaggatgaggcggggtgggctggggcctcctggagaaggtggcagctgctgcaggacctgaaggaggtgagggagaggatagcagggcaggctccttgcaacaaacagccaaggggcagtggggctaggctggtagacaaggaggctcggggacacagcatcacagccacagtaccatgctgtgggtacgggagggcaggtgtttggagagctccctggactgggagttagacactggccttgggcatctaacttggggtggctgggtggggaccaaggcgtctcctggtgacagcgtccctggaggctttggggagtggagtgactgggcgctgttgggctctgggctctgagtgttgagctggggcccaccataccctgacggagggtgctctccgactccatagacaaagaaccggcgctgcaaactgctgcccctggtgatggctgcccccctgagcatggagcatggcacagtgaccgtggtgggcatccccccagagaccgacagctcggacaggaagaagtgagcagcttccactcgtcctgggactggagggtcgggggtgttggggttatcagcttattagccctgctgagtagagtggtatttgcctctagtgtctgtcctggggcggggggtgggaagggtccattgcaggccgcctggcccccgacatgtcttgtgtgtcagcagcttttttgggagggcgtttgagaaggcagcggaaagcaccagctcccggatgctgcacaaccattttgacctctcaggtgagagtctcctgccactctgccacactttcccacctgaccctttgaggctattgcaggccctggaaccaagcaagttggcatggctggaggagcctggccagcagccctcttgaccttccagatctggccctgggacaggctactcctggtggctcagggagctctggtgaacctcaggcccctgagagggaaaaagtgttttccagggaatgactggcctggctgtggccttacagcggccttacagccagtgctaaggatcactttcccagcaagcctaggggactggccaccagggcccgtgtgccccgatctcacctgtcagggttgggttgtttctgtttcatggggtgagggaacagcagggcccgtgatgacccaggacaccaacccttgctgcgccagccacctctccacaggccggggtgtgtgtcgtgataggtgctacctgtgagatggctgggacaccggccccacctgtgtgtcagatgagcccagaatggataggcctgcctgcccactgcttccccagcaccagcacggaacatggttcacattcggctgtgttggcgttcttattattgttgacaggttttaaagtaaaacagacgtattgatatttcaccccgggttagtttgctaaagctgccataacaaagtgccacagacagggtggcttcaaccacgtgtctcctcccagtcctagaggcgagaaggcccaggtcaaggtggggcagggctggcttctcctcaggcctctctccttggctcacacagatgaccaccttctcactgtgtcctcacgtggtctttcctctgcatacctccttggtgtctgtgtccaaaccgtttcatcttccaaggacaccagacagattggattagagcccaccctaacaaccacatttgaacttaattaccatagtcacattctaaggtcctgggggtaagggcttcaacatagagatgtgggggagaccgttcagctcataacaccctcagtacttcctgcacctctgagaaaggatattttcttgcctcatcaccacggattcctcaacaatgatagacactgtcatgggagatccagcctttgttgaagtggcgtcagccatctcagagctgccttccttgagccagacccagccatggctgtggcactgtgtggcattggttcaccccgcacagcagcccctgctaactcttttgtgcctgtgatgtgggagaggtggatggacacccactggcctgcagaatatctggccttcagtatacagggaggactcgggctgggaactgcttggtttccctgagggtggagagccaggggtgagggtgcagagtgggccatgtctagtgcccacctgcgtgggctgggtctggggctctcggggctgtggctggcagcatagatggctcccagggccaggccagccccatcctggggcctggttttgctttgtggtgagggtctgggtgctcagctgagcctgagggccctgtgagatatgggcagtttgcaccatgtccccttgtgcggaagagaacactgaagccgaggaattggccagagtgcggccaaaagtgacctgccccacccaaggacttccacaacccactctggggacgggggttcatgccagctggggtgggcaggcccgtgtttgtccaggtctgtagggcccttccctgtgtcacctctattgtcttcccgggggggagttctccctgcaggccccaaccctgacctctctagcagtgcagacagcagttgtgaagatgaagtacagtgagacagacacaaccactgagtgcagaataccacaggccgggaggagccgcgcactttggaatgcagtggagggcaggcagcggaggggagttctgtgccctgtcttgtgttcccactcctcccttctcacggctgtttttctttcattacttcagtaattgagctgaaagctgaggatcggagcaagtttctggacgcacttatttccctcctgtcctagggtgagttacaggggttctgcaggggtggctgcagcagccccctcagagcccgaccctgatgccctgctctgtcctccctcaacggaggcttctacttgggtttcagaccgaagcagggttcttgagattggagccaacacatttttcccaagcacatctgtccttaggctgccagcagggccacaatggggcattttgaggcagctaatttcattaagcccctgcgatcccttcagaaagagctggtattcaccctctgctgaccacacttgggctgggcatcgcgtgtgacacatgtcacacacagactccctggtgctgccctcgaaggccacctggagcctcctgtcccacagccttcgtgtcaggcgctgggcaagagcccgcagagcagccatccgggcttttgtgtgcttggctcatgagaaagcaaagctgttggcagccgcttagctgggaattccaaagcgctggttctgctggggccttcaccagcacacagctgtcctgagggccccattgggattcactggcaggtcactgtcccgggacacctcccactgccccatgtgctacctctttcttaagggttcccaggaaataggcctgccttgtgtctttgtaaccatctctcagcccaggttccccacagggaatgccacatccagccctgcatctcccagagccctagcctggaggctgcggctgtggcagatgggccctgccaagactctgttgcaggaggtccctcaggccaggcctggggtcctccccactctcccatccgtccgtccatccatccatctgtccatccctccaggggcaagcacctgttctcctgttggggctggagtgggggtttctgctgacaacagcatagggggcctcagggaccccacagttcctctcagggtggcctgggctacatggggcccattttgggcgcggggctctgagtcagaccctcggggtttttggcaagttctgtagggtcatcagcagtgaccttgggccagccacctaatcaggcttagcctgtttcctcatccaaaaatggggcccactctctccttagacgatgagtgtgagcatcacaggactgcatagggtggggcggaggcagaggtggggctctctggcagtggagtgggtgctagaggcaaacccctcccctgcagcctgcttggtggtgatgttatgctgctgtgtgtccttccactgaggcaggggcacaggtggcctgggctaggagggctgagcagcagagtgccgagggatggagggagagcccccatgggagggtgccagggggctggctgagcagctgggcggggtccgtgaggtaagaaggtgcccgggccagggggcaggagctctgatgtaggacagctcagcccagtcaaggggtgctatgaggacagcaggggcctccgagtctggggtggcctcacccccacaagcagtcctggctactcagcagcactacccagaggggacgcctgggcagtttcttcaattcggtggcacatcaacatcgtttgaaacttgttttttcttgttttgttttctagaatttgattcttccagaatgaccttcttatttatgtaactggctttcatttagattgtaagttatggacatgatttgagatgtagaagccattttttattaaataaaatgcttattttaggctccgtccccattgtggctctggtctcgaggccagtgcttgagtgtgctctgagccttctgtgggtcttgggccccaggagccctcagtgcctggcaggaaatcagcatggggattggccccaaggacaagatctccttactctgtcctccaggccctccgggtggcagtggacagaggtcaggacccctcggcatccccgcctcctcatagcacctgcaccggccactgcctggtggtgccagccagcacctggctctgtccacctaccacttcctctggtccacctggcctcagccacatagcaagtccaccctctcagccatccctccacctgtgggtctcaccatccagcactcttttccaggtctttgaaggcaggagtgatttgggtaggttttaagtcagtggggaaaagctcagaaagagtggcctggaaaagagcacacaggtaggtggggctggtcttggtgcagcccttggcaaagggcagtgggcacaaaagggtgagagctggactggaggctgggcccctcccctcacctctggtggtttgcacagcttcccgggacccttgagctgcctaccctggccatttgggaaaattcaaaggctgtgcagcttcctttccatgccctttctttcctttttttgagacagagtctcgctctgtcaccagactagagtgcagttggtgcgatctcggcacactgcaacctctgcctcccgagttcaagtggttctcctgtctcagcctcccgagtagctgggattacaggcacacaccaccacgcccagctaatttttgtatttttagtacagacgggtgtcaccacgttggccagaatggtcttgatgtcctgaccctgtgatccgcccacgtcggccttccaaagtgctgggattacaggcgtgagccaccgtgcccagccccgtgcctgtcctttcttaggaaaaggctttcttaggaatgccctcccaggcagccttgggcctcagcttctgaccaaacacaccagacctggtactacccagtcccggtggccaggtgcaagagtgtaaggaccattgtttttggctctgcccagggccacagctctgggatcacacactcccaagcttggggactattcttggtccctgttgtacaggcccaggtggggtacaggtcaggcctgctgaggacctctgcaccgtggggcccctctccctgtaactcatcccaccggctggttccacagcagctcccaggaagctgccacacattccagcagctgccctaagccactctgagcctgcattcttggggttctcccactgctccatgatggtagcctggccagacctaggagactccctgccactggatgtggcccagacatttctgggcagggcccccaagtccagtttggggcagataccaagtctcccttccggctgggcttagagctcttccctgcagcatgcccccttcatcagctgctctcttctgcttctagctttatgtcaaatgtcaaaaatgtgttaattcaaagtgcctagaacaaggctaaaaacagtgagctctcagtggctatgttagatggctctagacacccccattccgaggtgcctggcaggggccagcactgactcccaggccacacagcccctggaggaggaaggttacccagagtgcccccagcaggggctggcacaggtgctggttgtgagcaccattctgggcaggctgccaggccagcagggtgggtacaggctctgtagggagctgcgctgggactggcagaggagccaggacgaggggctagagccaagctgtggtactccaggcaaccagctgccagcacctcctcccatggcaaccctactgttgaccggcgtgtcctgcattcacccctgttcctgccccacccaccattggaaagggcctggtcggggattctacagacctctgtggccacttgatggggcttgggactaggcaagccctgagagggcagtggaaaacctcaccctgtgctgtgtggggcttggccctttctgggagaagccagcggcctggctgctcacccccagcacttcccacaccgcaggacccccactcaccagcctgtgttgagggcgcttcaccccgcatcttctgctggggtctgccgctgcccccgcccctgtcccatcccgggccccagggccccatgacgcagcagctcttctgaccgcagatcccgcctttctgggctgtagtaagtggtggctgtgtctcccacctggtgggaaggtggcagggaggatggggaaaagagccccagcctccagccctgggaggaggtctccacaggagtccttgggagggcggggctggtgggtgatgaatggggctgctggacacggaagatggctggacagagaacaggacacaggtgggagagagttcaaaccatttactaagcagattcttagccttcccactcccgccctctctcaagctccggtgcccacaagccttgcctggggagatgctggagtgagaccgggaggtccaggccaagtcactggtccctgggctcgggccctgccgatggagtaaagaccagctgtacacatcttccggtgggggccctgggctctgcatccgcccctccgaagtcagcaggagcctctgggaagtaaggcagcagccaagacccccagcgtcttggaggggaagcgaaatcctcagtctgacacccgctctgcctatggaaacagcgccgcgcacagaaaaggaaacttcattccgtctgttaagggcagggccgggctagtggcaggagaaggtcagctgcgggcgcaggcaggagcggatccaggagccgcgtcggggcgcagagccggacgttccgaggagcctgcgcgccgcgctacccggcggaagccgcggtccatgcggggctccccaggcttatccaacgcctcgcaggcgtggctggcaggaggggcccggccgtgcccagcgccctcagacgtagttcttcttgtcgtagtcgccggtggccgtgggccgccgcggcgctgagtacttcacggggaagctgaggtcgggacggccggtgcagacccaggcgccgcagcacaagaggcagccgcctaccatgagcagcgcggtggccgcccagccgatgtacagcgctgcgcccagctcgtacttctgcgacacgggcacagacgggtcgtaaaactcgcggacgacaatgttggcgaaccagcagagtggcacgagcgccagcagcccgcaaaacaggtagagcacgcctcccgtgagggccacacgcgccttggccgggcccggggccacgcaggtggtgcactgcgcgcccgccagggtcacgaagagcgcaacgaacgccagcagcacggcgctcacggtgagcgcccgcgccgcctgcacctcggtgctcagagccagcaccgagtcgtacactttgcactgcatgtgcccggtgctctgcaccacgcacgacatccacagccccttccaggtggtctgcgccgtcacgatgttgtggtccaggaaggcggtcacctgccacatgggcagcccgcacgccaggatcagacccccccagcccaccaggcacagcaccaggcccaggatctccaacgctgcggaccccatggctagaggcgagacgcgcacccgaaggcccgcagaacccccaaggccgtgctgcgcggcgccctgggcgggccctggtgcctttgcgcccgcgctcccggctcttggccccagtccgtttgccccgcgggtctgtcgcacctcctgggtctgccagctcctgccggggggtaccctctttgaaggttcgggggcggattctgtcccccgggcccggccccccggcccgaagcagccaatccgtgcgcgggtcatcgtgccgcagccaatcacagagcctctggcagctgaagttagggaaacaacggctcttgaggggtagctgagggcgcgggaccgctccccgcccggcagccgcccccagccccacccgccgttgtcctagtcgcggccgagcgcattctgggctggcctagggcgcgcttcttgggccgcctccctgcgcgtcccggccccgtcacttcagaaggcgctcgacccccagtctgcaccacccagtccactcccacatccccgactgagccgggtggtctcttccactcgagccagctccacttccctgaccaaggtttgcagaagccccccaccccgtcaccgccgtagaggccctcgtaggggggctctccagaaagcccgccccggggtccaagccccacccaggccctttctcgcactctcactctccagccccgctctgagtcccagcactgtctctctcatcccatggcaaacagagaggccaggcaggcgtgtggaggtcaggcccagggccccagcctcaccccccatgccactcactgcctctctggagcctgagtctctggcaaaaagcggtggcacaggggctttccccctgcctggcgacccccactctcccaagccgcaggggcttcccagacctctcaatcttcacaggggctgctcctcttcctgcggtactgcccgcaccccatccttgggggcccagttcaggtgacaccacttcaggaagttcccagtgacccagcacactgggtgtagcacccaggggcagtggtggccccaggcctagcagcctgctctggccttcagacaggagagacaaagggacacggaggggctgtgccctgccctcccaccagtggcgatggtgtccctggcaccccagcccccaggccaccctccggaagccaacttggagtttcctggccaggaggaagagcccccatccttgctggaggagggaggcgcgggatttccgggcattcttctgcacaatggcccagccatttctcgaaaggtccactggtgtggacactccgggccccctgaggctcaggtgggggcacgcggctccaaaacccacagccccatgggggcaccagcccctttctagtagttctttccccagtctctctcggcccctttgtttccagtaaagtttgaactccaggccctggactgaggccactgggtgcccagttcttttatctggtctgtgctcagttccattggacagggccctccatagaaaaagtatggcactgaggctggtcacagatgtgggaggtttgatgactttctccctcctggggcccggttcccttctcccccttcagatggctctgagatggtaaatgagataaggccagcgtctggctcacctagtgtggggaggttctgaaggcaagtgtgcccagccctgaggctggaaggaaatcataccctctttgctcagccccacgtggcctctccccaccaggtatggctctgaggaccactgccttctcccagctatcactttagtcactgccttcctcctgctgcagacccatgggccatgccccttcctctacagaccctcctggacatctcctcctctgtgtactccaggggtacagctgacccacccaccctctcactcttactaccccctaacccaagcccagggaacttccccagatccccctactcccagcccttccatgccaccatcttcctgggatgactgctgcggcctcctcaggtcatcagggacctgcccttgcccagctaggccacccaccccaccaggcccctctcctgggcctcaccctacctaagaccctccatggctcacattgcccatggacgaagagccgactcccagagcagctggattgatgtgtacctgcatgcgctaggactggccagtccagccaccagtcttggtgcggccctgagcacacactctgccccaggagacttacctgcctatgggcctcacatgggccgtctcttaccttggcctcttctgcccgcagcgtgtatctgtcaggttgggtcctgctcatcttctaagatgtgttgccgaggtcatttccaggaacaccttgctgcaccgtcccccagcattgcttttagaagcttgagctggacctgtccttttgcttgccgactttcccacctagtatccaggaataacctccacagggtggctgtcttcatgcgtctgtcctgcacaggaggctgcctgttgccctctagccagcttggagctgcagccagcccaaggctctcccttctcacctggctgcctgtttttcttctctcctagctgtcaccctagggtggccccagcaagctcatgtttctttggcggcagcctcacagcatctcagggacgtggcagaggagtctcaggcttcacctttcacaatctggtttctaccctgaccccactatgttggtcgaggccccaggctgcagtggaacaatgccaatgcagagaggcccagagagggccgcaggggctgacgccaccccagacaaacccacctcagatggaggctggcctctgagtagcccaggccagactccggaggggcatgagggtgcacccacctttcctgccactcatggagggtctgctcacctacttcgtggcaagcactgtctctaggcagagcacacagcacaagaagctcctgcccagaaggagctgacaggaacctatcaaccaagaactgggcaggaaagacagtggtgaaggcctctctgaagaggtgacatttcacagggatccggggaagaagttccaggcagagcagaagcaatagccagtgcaagatcccagaggtgggaaggggctcggcgtccaaggggcagaagcggccttgtgtccacagtgccacagtggtccagggcctgcaggtggagatcggaggtgtcctggttaggcagggacacaaacccctgatctctggtaaagggcccttggggcagagcactggccaaggccacctgctcacccccagccattgttctgctttcccaggggaagaatggcaggatctcattaattgtgtgtgagaagagcctgagtctgcagaaaagccaagtttatcttgagcagctgctggctgaccctgccccagggtaatcccgtgaccttccaaggataagctaaatttaggctcaagattcctggggatttgggtttgggaaactcctagttaacagatttgatttcaggggaagtgaagaacagcgtttcttctatctttcagttttgaaacagttaaggatgtgtccttctatttccgcaaatgtttgcagagcctccaagcacagtgtggcctggtgctctttcttgacacaagccagtactcctgcaggccgagagcagcagctggggtcctcctgcatccctgaccactgcaccaggtgcccgaggcaccctgtgtggggcccctgggcggctgtgacgatgtgagcagcatccagagtggacagtgccagactcggcggttttgcgggcattgttgttactctttgtggttaaacacaggcatggagtcagattcgctcccgcaagcaagaaactttctggactagtgaggtggcctctctgccttagttcctcactggtaacgaagccccccaatggtggaggctgcgaggctgcaggggaggccgatgccagtcccggttctcttctgcctttcctgagtgccatccacccaggctcccagggccttcacagctcatccaacctcagccgcacccctcagggtagtcatcgctggctgttagtcagaattggaggtcactgtggctttaacttccccagcgggtgagggagtggggggcagggagctctggtgtgatccacgaagggtcaagggttctatagaatggcaagccaggccaagcgcagtggctcacgcctgtaattccattcaggaggccgaggtgggcggatcacttgaggtcaggagtttgagaccagcctgtccaacacggtgaaaccccgtctctactaaaaatactaaaattagctgggcgtggtggcacgcacctgtaatccgttactcgggtagctgaggtgggagaatcccttgaacctgggaggcagaggttgcagtgagccgagatcatgccattgcactccatcctgggcaacacagcaagactccatctcaaaaaaaaaaaaaagtccaccaaagtacatcataaaccaaatttcgtaaaactggtgctaaagagaaagtcttaaaagcatggagaggaaaggccgggcgcagtggctcaggcctgtaatcccagcactttgggaggccgaggcgggcggatcacctcaggtcaggagttcgagaccagcctgaccaacatggagaaaccccgtctctactaaaaacacaaaaaatcagccgggggcttggtggcaggcgcctgtaatcccacctactcaggaggctgaggcaggagaatggcgtgaacccaggaggcggagcttggagtgagccgagattgtgtcactgcactccaacctgggcaacagagtgagactccgtctaaaaaacaaaacaaaaaaaagcatggagaggaaaaagacacattgtgtgcagaggaatcaagaagaaggagatttcttgttggaaacagtgcaagcaagaagatagtgtagcaatatctttaaagtactgcaagaaaaaaatccctgtaacctaaaattctttttcttttttctttttagaccgggtttcactttgtcatcgaggctgcagtgcagcggcacaaacatggttcactgcagcctcagcctccgggttcaagggatcctcccgcttcagccgcccaagcacccaaatagctaggactacaggcgtgcgccaccacacccggctaatttattttattttatttttgttttttaaattttttgtagcgatggggtttcaccatgttgtgcaggctggtctcaaactcctgagctcaagtgatccatttgccaatcccagtgctcggattacagcgtgagccaccacgcccagccttaacctaaattctatactcaccaaaaatgtattccaaaaatgaaggcaataccacatccatggatgagcctgaaaaaaataaatgaaggcagctgggtatggtggctcacgcctgtcatcccagcactttgggaggctgagacaggtggatcacctgaggtcaggagtttgagaccaacctggccaacatggtgaaaccctgtctctactaaaaatacaaaaattagctatgtatggtagcaggtgcctgtaattccagctacttgagaggctgaggcaggagaatcgcttgaacccaggagacggaggttgcagtgagctgagattgcaccactgcactccagctggcatgacagggcgagactccatctcagaaaacaaaaacaaaaaaaatgtttttaaataaagacaaaacagacttctgcttcctagaagacagataaacatatgtttccctattccttccacaaaaaaaccctaaatgttataaataaagcaaacataagaagatgctaagtgttacaaagaaggcagacaagctagagacttagagccaaggacgaaatggtggtgtttctctgggttgcctttttgtttttttttttcttattttatttatttattttagaaatagttctcattctgtcacccaggctggagtgcagggacacaaccatagctcactgcaactttgaactcctaggctcaagtgattctcccacctcagcctcccaagtagctgggactacaggtatgcaccaccacccacctaatacttttaaaaaatttttgtagagacggtcttgcaatgttgctcaggctgatcttataactcctggtctcaagggatcctcctgcctcagcctcccaaagcactgggatgacaggcatgagccaccatgcccagcctcctgggttatctttttgactcatgtatcccagactgcatacagaggagctggccacccagaaacaccaatgggtacaggcaaaaaataagtcctaagcaaagccggttctgtctagccaaaagatcaggacaaagacagactaacaagacaaaaatattttagacaataaccactctactcaagctatactactacagaaaaaaactgtggccccaaccctgccctcaatagcaaagaccagtggggagcttagactcctacccttgccaggctgtaatgagatgctccagcctcctactggggtgtcagaggaggccaaggaagacttgggtggaaataggtccccctccctgaccacagtgtcagtggagaccacatggggagcctggacttccactcctaatgtggtaataagggccccctccaggtcctcactatggtactgtcagaggaacctagcagagggtaaggacattcttcattttccagaggtgatgaggctctccctgcccacacatggtgccagtggaggccacgtggggatcagcagcaggcattcctcccatccatgcctggggtatcacaagaggccgagtggggagcaggaactcccagccccacccagcagtcacaaggatccccgtggccccaggtgtcaatggaggtagggtggagaacctggacttccacttctgcctggcagtaaagtgtcccctgtcattgccagaatggtgtcagaggaagcttgctaaaatacaagatttaaataagatccacagtcttgtaataaccaaattatccaagttttgattgaaaataagtcatcaggctgggcggggtgtctcacgcctgtaacccagcactttgggaggctgaggccggcagatcatgaggtcaggagattgagaccatcctggccaacatggtgaaatgccatctctactaaaaatccaaaaaaattagccaggcatggtggcacacgcctctagtccccgctactcaggaagctgaggcaggagaattgcttgaacctgggaggcagaggctgcagtaagccgagatcatgccactgcactccagcctgggcaacagatcaagaccctatctcaaaaaaaaaaaaaaaaaaaaaaagaaaagtcatcataccaagtatcagtaagatattaaactaaattggccaggtacaatggctcatgcctgtaatcccagcactttgggaggctgtgggcagatcgcttgaggtcaggtgttcgagaccagcctggccaatatggtgaaaccctgtctctacaaaaaattagccaggcttggtggtgcacccctgtagtcccagctactccagaggctgaggcatgagattagcttgagcctgggaggcggaggttgccgtgagctgagatcgtgctactgcactcctcctgggcaacagagcaagaccccgcctcaaaaaaaaaaaaaaagaaagaaagaaagaaaatcgacaaagatggcaatgtcacagatgtgagaattacttcatatttcaaagcagaaatgataaaaatgcttcagtgagcaattacagatatgcttgaaacaaatgaaaatatagaaagtcttacaaagaaataagaaccacatagaaattttagaactaggccagccatggtggctcatgcctgtaatcctagcactttgggaggccgaggtagatgcattgcctgagctcaggagttcgagaccaacctgggaaacatggtgaaaccctgtctctactaaaatacaaaaaaattagctgggcgtggcggcgtgcacctgtaatcccagctactcaggaggctgagagaggagaatttccagaacccaggaggcagagattgcagtgagctgagatcgtgccactgtactccagcctgggtgacacagcgagactctgtctctgaaaaaaaaaaaaaaatttagaactaaaatacagtaaccaaaattaaaaaaaaaaaaaaaggtcattggggctgggcgtggtggctcacgcctgtaatcccagtactttgggaggccgaggcgggcggatcacgaggtcaggatcctggctaacaaggtgaaaccccgtctctactaaaaatacaaaaaaattagctgggggtggtggagggcacctgtagtcccagctactcaggaggctgaggcaggagaatggcgtgaacctgggaggtggagcttgcagtgagccaagattgcgccactgcactccagcctgggcgacagagcaagactccgtctcaaaaaataataataataaaaaggtcattggatatcagctggacagcaacatggaagggacataggaaactattggtgaattggaagctagaacagtgcaattttcccatctgggccagccacagtggctcacacctgtaatcctagcagtttgggaggctgaggcaggaggattgcttgaggccaggagttaaagaccaactggccaacacagtgagacgtgtctctattaaaaacaaaattttaacccaattatcccatctgaacaagagagagaaaatcactgaaaaaataagaataaacaaaggctcagaaaatgtgagatcataacaaaagacctaacatccatgtcatgagagtgccaaaaggagaggagaaagggggtggggttaacaaagcattcaaagaaataatagctggaaatttcctgaatttagcaaaaagaaaaagagagagaaaaaaaccctacagattcaagaagttaagtgaggccgggtgcggtggttcacacctttgggggccaagatgggtggaccgcttgagcccaggagttcaagaccaacctgggcaacacagtgagacccctgtcgagagagagagaggagaaaaattaaatggaaccttaaacatgataaactcaaagaaatccacactaaaacatctttttttttggagacagattattgctgtgtcgcccaggttggagtgcagtggcacgatctcggctcactccaacctctgcctcctgggttcaagagattcttctgcctcaacctcccaagtagctgggactacaagcacatgctgccatgtccagctcattttttttgtatttcagtagagacagggtttcaccgtattgcccaggctgatcttgaactcctgagctcaggtgatctggcctcctcagcctcccaaagtgctaggattacaggcggcagccaccgctccaggcccaaaacatcttaattgaacttctgaaacctaaagacaatgcagctagacagaaaaatgacacctcacctattggagaagaaaatgaatcaaatgacagagaatttctcttcagaaaccagggagaccagaagaaagtagcacattttttaagtgctgaaagaaaaaaaaaaaaatctcaatccagaattctatgtctagtgagcatattattcaagaatgaagggggaaaatttttttttcaagtgaaggaaaatgaagagaatttattgccagcaatatatgctgaaagaatgctaaaggatgttccttaaacagaaaggaaatggtaaaataagagtcttggaacatcaggaaggaagaaagaacatgataagcaaaatactggtaaatattaatacaatagattttcttcctcctcttgagtttcctaaattatgtttgatggctgaagcaaaaattattacactgccttaagtggttctcaatgtatgtagaggaaatatctaagatatataattatattataaatgggggagggtaacaagacattaagggaggtaaggttttttgtttgtttgtttgttcgtttttgagatggagtctggctctgtcatccaggctggagtacagtggcaagatctcggctcactgcaacctctgcctcccgggttcaagtgattctcctgcctcagcctcccaagtagctgggactacaggcgcccgccaccaggcctggctaatttttgtatttttagtagagacagggtttcaccacattggccaggctagtctcaaactcctgacctcaggttatccgcctgcctcagtctcccaaagtgctgggattacaggcatgagccaccatgcgcagctgggaggtaaggtttttttttttgttttttgtttgtttgtttgtttgtttgtttttgagatggagtcttgctctgttgcccaggctggagtgcagtggcgcaatctcggctctctgcaagctccacctctgggttcacgccattctcctgcctcagcctcccgagtagctgagactacaggcggctgccaccaagcctggctaattttttttgtatttttagtagagatggggtttcaccgtgttagccaggatggtctcaatctcctgacctcatgatccacccaccttggcctcccaaagtgctgggattacaggcatgagccaccatgcccggccaccgggagataaggttttttacacttcattccaactggtaaaatgttgacacctggagactttgattatataatataaattttatatatatttatcctacagcaaccactaaaaagctatacaaaggtatcaagaagaaaaaaaaaataacaaatgctggtgaggttgcagagaaaagagaactcttatacactcttggtgggaaagtgcacccatctggtaccataaactagcccaaccacaatagagaacagcacggagggtcctcataaaaactgcacatagaaataccataccatctagcaactccatgactgggcattaatccaaaggaaggaagtccgtttatcaaagacacatctgcacccttatgtttaccgcagcactgttcactagccaagacatggaatcaacctaggtgttcaacagcagaggaatggataaagaaaagttggtacatatacacaatgaatactattcagccattaaaaaaaaaaaaaagaaatcctgtcattcatggcaacataaatggaactggagaacaatatgttaagtgaaacgagccaggaacagaaaggttatttatttatttatttttcacttatttatttatttattgagacagagtcttgctctgttgcccgggctggagtgcaatggcatgatcttggctcactgcaacttctgcctcctgggttcaagcaattctcccacctcagcctctcaagaagctgggattacaggagcgtgccaccatgcctggctaatttttgcattttgagtagtgacggggtttcaccgtgttagccaggttggtctcaaactccttacctcatgatctgcccgcctcagcctcccaaagtgctgggattataggcatgagccactgtgcccggctgatgttttattttttagagatggggtctcacaatgttgcccaggctggtctcaaacttctgggttcaagtgatcctcctgcctcaccctcccaaagtgctgggatttcagggaggagccaccacacacagctaagacagagttaaacaccacatattcttattcatatgtagcagcttaaaaaagttgatcttggctgggtgcagtggctcatgcctgtaatcccagcactttgggaggccgagggcgggtggatcacgaggtcaggagatcgagaccatcctggctaacacggtgaaactccatctctactaaaaatacaaaaaataataataataataattagccaggtgtggtggcgggcacctgtagtcccagctactcgggaggctgaggcaggagaatggtgtgaacctgggaggcggagcttgcagtgagccaagattgcgccactgcactccagcctgggcaacagagcgagactccgtctcaaaaaacaaaccaaaaaaaagataaataaaaaataaaaataagtaataaaaataaaaaacaataaaaattaaaaattaaaaagtatatttaaaaagaggtagagctatatgcactgacctggacatatctctaacagatcttattaagggaaaaaaatcattcaagtttatcacattacatatacaatgatactgtgtaaacttaaattcccacaaaaatgaaactatgtaattttttttgttttgtttcattttgttgttgttttttagtgagacagagtctcactctgttacccaggctggagtgcagtggcatgaacatggctcactgcagcctctacttcccgggttcaagcaatcctcccacttcagcctcacaaggagctgggaccacaagtgtgcaccaccacgcctgcctaatttttgtatttttctgtagagagggggttttgccatgttgcctaggctggtctcaaactcttaggctcaagcaatcctctgcctcggcctcctaaagtgctgggattacaggtgtgagccacctggccaaaactatgcacttttttttttttttttttttttttttttgagaaagagtctcgttctgtcgccaagctggagtgcagtggcaggatctcaattcactgcaagctccgcctcccgggttcaagcgattctacctcggcctcctgagtagctgggactacaggcgtgtgccaccacacccagctaacttttgtatttttagtagagatggggtttcaccatgtttgccaggctggtctcgaactcctgaccttatgatccacccacctgagcctcccaaagtgctgggattacaggcgtgagccaccgtgcccagccccaactatgtacttttatgtttatttttatgaatacaaatggacagataaaagtctaaggcatagatgccaaattgatatctattattgcctatgtgtaggagactctgggatttactgggggagacatcagggattttttactttctttgtattctgtactttttctatatttcacgactttctatattgtttgaaagtttacaacataaatgtatttacatcttacctacaaaattattatttctttaatgaacagttgtagcttatatataattccttcagaataaataaataaaagaaaggaagaacacgggggaaaagctatacaaagagacacactcaaaaacactgtagataactcaaaatgtaattttttttttttttttttgagacggggtctcactctgttgccgcccaggctggagtgccgtggcgcaatctcggctcactgcaacctccgcctcccaggttaatgacattctcctgcctcagcctcccaagtagctgggattacaggcaccccccaccatgcccggctcattttttgtatttttagtagagatgggatttcactgtgttagccaagatggtctcgatctcctgaccttgtgatccgcccgcctcggcctcccaaagtgctggaattaacaagtgtgagctacggtggccggcctcaaaatgtaattttaaggaatattcaagtaagccacaggaaagcagggaaaagtaaagagaaatgaacaaaaagagacacaacaaacaaaaaaataaaaataaaatagcactcttgggccaggcgcggtggttcatgcctataatctgagcactttgggaggtggaggcgggcagattacttgaggccaggagtttgagaccagcctggccaacattgcaaaaccccatctctactaaacatacaaaaactagccagtcatggtggtgcccacctgtaatcccagctactggggtgcctgaggcatgagaatcgcttgaacccaggaggccaagaggcagaggttgcagtgagctgagatcacaccactgcacttcagcctgtgacagagcaagcaagtaggcaggcaggcagagagaaaggaagaaaagaaggagagacggagagagggagggtggaggggggagggaaggaggaaggagggaaggaaggaaggaaggaaggaataattactagaacaaagacattacataatgatgaaagggtcaattcaccaagaagacacagcaattctaaatatataggcaccaaacaacagagcttcaaaatatgtgaggcaaaactgataaaactaaatggagatatagataaatgaacaattgtagttgaagcttcaacatttctctctcaaaaattgatagaaaaagtagacagaaaatcaacaagaagacagaatctcaaacaccatcaactaacaggatttactccacatttacagagcactacctaacagcagtggatacacattcttttctagtgcccacagaaccaaccatatcttgggccgtaaagaaacctcaaaatcaatgaaaccaaaagttggttctttgaaaagttcaacaaaattgacaaatcttcagctagattgacctaaaaagagggaggaaacccaaattacctaaatccggaatgaaagaagagatatcacttgtgggcttacacaaataagagtgattttatttatttattctactttattttatttttttgagatggagtctcactctgtcacctaggctggaatacagtggtgtgatctcagctcactgcaacctccacctcctgggttcaggtgactctcctgcctcagcctcccgagtagctgggattacaggtgcccaccaacatgctgggctaatttttgtattttgtatttttagtagacacggggtttcaccatgttggccaggctgatctcgaactcctgacctcaggtgatccgctggccttggcctcccaaagggctgggattacagatgtgagccacaacacctgaccaaaatagtgattttagaggaatactatgaacagttgtatgccaacaaattagttaacctagatgaaattgaccaattcttagaaacatagactaccaaacctgactcaaaaagaaatagaaaatctgaatagatctataacaagcaaatataatacaaaaaattagccgggcatggtggcagatgcttgtaatcccagctactcgggaggttgaggcaggagaatcacttgaacccaggagatggaggttccagtgagtcaagatcgcaccattgcactccagtctgggcaacaagagcgaaactccatctcaaaaacaaacaagcaaacaaacaacaacaacaaaaaacacaagcaaatataacaaacaaacggattgagttaggaaaaagaaaaaaaaaaatccaacaaagaaaagtctaggaccagatggcttcactggtaaattctaccaattttttttttttttcgatggagtctcgctttgttgcccaggctggagtgcagtggcgcaatctcagctcactgcaacctccaccttccgggttcacgccattctcctgcctcagcctcccaagtagctgggattacaggtgtctgcaaccatgcccagctaatttttgtatctttagtacagacagggtttcgccatgttggccaggctggtctcgaactcctgacttcatgtgatccacccgcctcggcctcccaaagtggtgggattacaggcgtcagccatggcgcccggccctatcaaatgtttaaaaaacaactagcaccaatccatctcaaactctcttacgaaaaagaaaaaaaagagagagggaattcaatccattctatgaaaccaatattactttgacaccaaaagtaaagcaaaaaaaaagaagaagaagaaaggaaaaagagagaggaaactacagaccaatattccacatgaatatagatgcaaacattcttaacattttataaaataaattcagccgtatataaaaataattatacaccatgatcaagtgggatttattcctagaatacaagcttggttcaacttccaaagatcaatcaatgtataccaatgtaagctaaagaagaaaaatcacatgattatattaattgacacaaaagaagcatttgatgaaattcaacacccattcatgataaaagctgctggtaaccagtaatagaaacttcctcaacttgataaacagtgtctacaaaaaacctacagctaaaaattatacttaatagtggaaagctgaatacttttctgtgaaaattagggacaaggcaaaaattctgccttcactactcttactcagtatagtgctggaagttccagacatcacagaaaggggagaaaaggaaagagatagagatcagaaaggaaaaaccaaagctgcttctatttgcagatgacataaatcaattcccatggaatcttttaaaaagccttagaaccaacaaatgagtttagcaagatacaaggattcaagatcaacatacaaaaatcaattgctatttctatgttctagcaatgagcacatgaaaaccaaaataaaaaataatatcatttgcaatcactcaaaaaatgaactaggtgtaaatctaaccaaatatgggtttgtatggataaggacttgtatgctgaaaactacaaaaccctggtgaaagaaatcaaagaagatgtaaataaatagagaggtatggcctgttaatggactggaaaactcaacatggtgaagatgtgaatagttcgattcctttcaaaattctagaaagatttcttggccaggcacggtggcccatgcctgtaatcccagcactttgggaggccgaggagggcggatcatgaggtcaggagtttgagaccagcctgaccaacatggtgaaaccccgactctactaaaaatacaaaaatcagctgggcgtggttgtgtgtgcctgtagtcccagctactggggaggctgaggcaggagaatcacttgaacctgggaggcagaggttgcagtgagccaagatcacgccactgcactccagcctggacaacaaagcgagactccgtctcaaaaaaaaaaaaaaaagaaaaagaaagatttcttatagatataggcaagattattctaaaatttataagaaaaagcaaaagaattaaaatagttaaaacaattccaaaaaagaagaataaagtgggaagagtcactctaccaaatttcaagatttgtatagactgtttggcattggtgaagggatagatacattttgttcaatgaaacagcctagagaacccagaaacagccccatgcaagtatagctggctgatttttgacaagcatgtacaagcaattcaatgatacaaaggaatcgaaaccaggaactcaaacagacatttgtacctcagtgttcatagcagcatcattcacaacaccccaaaggtggaaaaacccaaatatccatcagtgaatagcaagataaacaaataaccaaacctaaaagtggcatatccatacaatggaactttattcagccttaaaaagaaagaagattccagtacatgccacaacatagatgaaccttaaagacatgataccaggtgaaataaaccaaacgcaaaaggacaaataccgtatgattccactgacatgagggagaggcctggagtagtcaaattcatggagacagaaagtggaatggggattgccggggtgggggcgtgggacagagtgcaaaatagggcttttctgtatctattgaaattttgttgctgttgttgttttattctgttaatgtcgtgattcacactatgtaattttatatcaaccctgtatttttgcgataaacccaacttagtcatgatgatttatgttgtttttttcttttttgagacggagtctcactctgtcgcccaggctggagccatctcggttcactgcaaccttcacctctcgggttgaagagattctcctgcctcagcctccgagtatctgggattacaggcgcgtgccaccactctgcctggctaatttctgtatttttaatagagacggggttttaccatgtcggccagactggtcttgaactgctgacctcaggtgatccacctgcctcggcctcccaaagtgctgggattacaggcgtgagccaccgcgcccagccaatttctgtatttttaatagagacggggttttaccatgttggccaggctggtcttgaactcctgacctcaggtgatctgcctgcctcggcctcccaaagtgttgggattacaggcgcgagccaccgcgcctggtcgatttatcttttttatacattattggattcagtttgcatctctgttcatgagtgaaatttaccagtaattttatttttttgtcctgttcttgttcagtttgtatgtcaagattacgttagttttataaaactgaagtgaaagtgtttctcacttttctattctctgaaataatttgtacaaggttggaattatctgttttttgaaaggcagaatttgcttgcaaagttattttaacatttttgggggaggaggggaatattttaaattactgattacatttctgtaattgttgttaagacaattgaggtttatttcttttttattccattaaaagaaacctgtgtttttccaagaaattatccagttcatctgttttcaaacttgttggcataaagttgatataagagcctcttatattttcatatacttgctgacacacccatgttaaatctgttttgtcctggtgttttttatttgtgcatcctctcttcttcttgttaatacttccagaagcttggctttatatttgtatttccaacaaatcaatgtttgactttgctgccttaaattttatttaatctgatattgaccaaattaacaatttttctcttggttagtctttgcacagtatatctttctttcccttgacattcaatttttctttttctttctttttcttttcttttctttttctttttctttttttttttttgagtcagggtctctgtcacggaggctggagtgcagtggtgcaatcatagctcactgcagcctccaactcctgggcttaagtgatcctcccaactcagcctcccaagtagccgagaccacaggtgaaacaccaccacaccaaacttctttttcttttgcagagacagggtctcaccatgttgcccaggctggtcttgaactcctgcctcaagcaatcttctgccttggtctcccaaagtgctgggattacaggcgtgagccatcacacccagcccatttgggtttatttgtgacattttctgcccagctttcccactcattcctcctttcttgcatcttttgggtgtgagagagagaatgtgtctttttttttttttttttttttttttttagagacggagtctcgctgtgtcaccaggctggagtgcagtggcaaaatttcggctcactgcaacctctgcctcccgggttcaagcaattctcctgcctcagcctcctgagtagctgggactacaggcacacgccaccatgcccggttaatttttgtatttttagtagagacagggtttcaccatgttggccaagctggtcttgaactcctgacctcaagtgatccactcgcctcagcctcccaaagtgttggggttacaggcgtgagccaccgcacccagccacgtgtgtgtcttttattccctgctttcccttctgcctgtttggcacttataactactgtgcctatttcatggatgccctccaaagttaatatctgaggttaatgtttttccctcctcccattccaatgggtattctcccaataccagagccttagcatgtatcacctgctaccagctcacatgccattgttgcccagcgcacgtgctgggtgtactggtgtgcagagtccaacgggagggctgggagaaggcccccgacctccctgccctctcagactgtggccgcacccagcttgccagacggagagcccaggagcaggaagctggtgtaaacacagggcgggcacccacactgttcccaggagccagtccttagatcctatctggctctcaccctgcctttgtcaagccctcaggacttggcacccaggtctgatctgggtgggcgtttgtccaaacaagaagtgagccagagctggacatccaggaccagaccataccacacagagggcatggggacactctcccagggcctgcagcccttcccggggctgctcttggcagcccaggcaccctggaggatatgcagtgcctctctgcccacccacacccctctggggctggcagggcctggagtgtgcgtgggcatgcagacgcatacacatctagcccttggctctcctcattggaccccttcagacactcctttctcttcacacttttacggaaaaggcacaagtggggatgtcctgccctgtgactggccttggctggcctggcccctgtagcacacgctggtggaaggaatgtccacagtgcagaaggcgctgctgcagaccgtgggctcacccgttctcattccacctgcaggtggaccaagcctggggtggcggggacaggccccacagactgaagtgacaggggatggagaagggctggggacagaggggacacagccacctacctggcaagctaagaggtcgggaagagtagctgccacttacatgggtttagacaaacaaacaggagttcaccagggtgaagggaaacgggagacctggctaaaagcaggaaaaagtaccagcatgggagcgggggcaacagcagaaccccagggagggtcagatggggtgcagcgccgggaggccagccagttccctggaagagagtttgcaggactaaagcctagagcctagattgctgcaaagtttcccagaagcggctgttgaacaatagtcacggccgggcacggtggctcacacctgtaatcccagcactttgggaggccaaggcgggcggatcacgaggtcaggagattgagaccatcctggctaacatggtgaaaccctgtctctactaaaaatacaacaaaaattagctgggcatggtggcaggcgcctgcagtcccagctacttgggaggctgaggcaggagaatggcatgaacctgggaggtggagcttttagtgagccgagattgcgccactgcactccagcctgggcgacagagcaaaactctgtctcaaaaaaaaaaaaaaaaaaaaaaaaacaacaatagtcacacggccacatctagctgggaggaaaggtgaaatatgttttagctgggtggccacgactagtgaaacatgaggcctgtatttttgctggggcagtgagcatccttggccacatgctgggctccagggggacggccaggggcattggccagggaaggagcccaggagagcaaacagaacctgcatactcactcccctccctcccagtcccatttaatctaactgtgaagacagtgaaaactaataagcccacagtaagaggggaaatactcgagactgccatcagttgaccagaaattttggaagagtttgaagaatttttgggagacaggaagcagataggatcagggcatagttaagggcacccaggcagaagccacggccctgaaggagcccccggcaagggcagggatggctgcagttgccagctttagccctgagagcagctttgtgaggcaggcagagcagttcccgggagggcccaccacagtggtcagagaggcagcaaactggctccgccgtgcagctttgggcggaaaggcaggtcctgccaggaaagaaaccaagcagagtcagttaaaggaggtctcctggtggtcctagagtgttgtgggggaggttacgaacaggtcttccacacacctggtgggagtgtgaggtgacacaaccacttggagaacagttccccagtatctcacaaagcagaacgggtgcgtagcccatgagccagaaaacaaggacccgtgtgtgccagagtagtgatacgagaatatccatgggagcattgcccttaatcccttaatagtgctaactagagtgcacacaagtgtccatcaacaataggctggatgaatgcactgtggtatattcacacagtggaatacatgcaatgcagagcaacacacagcttgtatgaattttataaaggtaacagcgggtgagaggcacaagcccctgaactgtctactgtatgattctgtggcagattgtattttccaaagatgccaccaaatgtagagacattcaaagatatcacccattggacattctctttttcattttacttttgtaaaaattgcgggcggtggtgatggttgtacaacaatgtgaatatactattgctactgaactgcatactgaaaatggctaagatgaggccgggcgcgttggctcatgcctgtaatcccagcactttgggaggccaaggcaggtggatcacttgaggtcagaagtttgagactagcctggacaatttagcaagaccctatctctaccaaaaaacaacaacaaaaaacacatttttttttcattagccaggtgtggtggcacatgtctgtagtcccaggtgttcaggaggttgaggcaggaggatcacttgagccacgaggtcaaggctgcagcgagctgtgattgtgtcattgcactcctgagtgagatcctgtgtctaaaaaaagaatgtggtaaaatatacatgacatgcactttacttttttttttaaccgagttttgctctgtctcccaggctgcagtgcagtggcgcaatcttggttcactacagcctccacctcccgggtttaagcaattctcctgcctcagcctccctagtaactggcattacaggtgcacaccactacacccagctaattttgtatttttagtagagacgggattttgccatgctgaccaggctggtctcgaactcctgacctcaaatgatccacctgcctcagcctcccaaagtgctgggattacaggcatgagccactgcgcccggcctcatcttaaccattttcagtatgcagttcagtagcaataggtacattcacattgttgtgcagccatcaccaccgcccatctccagaactcttttcatcttgtaaaactgatactccatacccgccaaacactacctccccagtaccctcctgttccagtccctggcaaccatatctactctctgtctctatgaatttgactactctaggtacttcatgtaagtggaatcatacatgaggtatttgcccttttgtgactgacttgtttcactaagcataatggcctcaaagttcaaagttcatatattttgtagcatgtatcagtacttcatgaatttttttttgttttgagacagagtctcactctgttgcccaggctggagtgcagtggtacagtctcagctcactgcaacccccacctcccaggttcaagcaattcttctgcctccgcctcccgagtagctgggactacaggtgtgcgccaccataccgggcttttttttttttttttttcgtagagatggggtttctccatgttggccaggtctcaaactcccaacctcgagtgatccacccaccttgacctcccaaagtgctgggatgatacaggcatgagacaccacactcagccttgttgttgttgttgttgttgagacaggatctggctctgtcacccaggctggagtgcagtggcctgatcatggctcactgcagccttaacctcccaggttcaatcaatcctcccacctcagcctcccgagtagttgggactacgggtgcacgccaccatgccttggtaatttttttgtattttttgtagagaaagttttgccatgttgcctgggctggtctcaaactactgggctcaagcatccacctgcctctgcttccctgaatgctgggattacaggcgtgagacaccatgcctggcccttcattccattttttttttttttttttgagacagagttttgctcttacacccaggctgaagtgaagtggcgcgatctctgctcactgcaacctccgccccccaggttcaagtgattctcctgcctcagcctcctgagtagctgggattacaggcgcctgccaccacgccctgctaatttttgtatttttagtagagatggggtttcgccatgttggccaggctggtcttgaacttctgacctcaggtgatccacccgcctcaacctctcaaagtacaggcatgagccaccgcgcctggccccttcattcctttttaaggctgagtaaaattcccctatatagttatattacatttgtttatccattcatcaaccaaaagtccacttggggccagggatggtagcttgcgcctgtaatctcaacactttgagaggccaaggtgggaggaccacttgagcccaggaattcaagaccagcctgggcaacatagcaagaccccttctctacaaaaaaaattggccaggcatgatgatgcatgcctgtagtcccagccacttgggaggctgaagtgggaggatcgcttgagcctgggaagttgaggctgcagttagcagtgatcgcaccactgcacgtgagtctgggtgacagtgagactgcctcaaaaaatgtttttaaaaatacagtcgtattggctgttccaaatgatggtgccatgaacatgggtgtacaagcatgtgctgctcttatgatacaatgctgatgtgctccccatcaaaagctggggtctatattccctctccttgcacctgggaaggttgtgacagaaatgatgctatgtgacttccaggctagatcataagaggtgatacaacttgctcctcatcctctttagtggctcactcttggagcccagtcgccatgttgtgagcaactcagaccagacttagaggccacatgtagatgttccagctggcagccagcatcaactaccagatagagggaaagagttttccaagcaaccccagcctctgtgactatctgagcaagaaccacccaggcgagcccagtcaaccccagagccatgagagatgacagaaatgactgttgctgtttcaggccactgaggtttggggtgtttggagtgcagccactacatgcaccctacaaagaagtctgccctgggatgggaccccccacatcccacagccacctccaaacacaggaccagagaccccaggatcagcaggccaaaatgaccataaaggaagcccaagcttgccaccctgtcaacgaggaagtcccagatgggagatagtaatgcgagaacaaaggaaaacgtaagcaaccttgatgatgtgaaataatagtaaagctgatggaaacggggaggtagagcaggaagatttcttcatcttgcacagtggggtccgtcataaaatatctacagcaatagaggtctggggcaggtccaggctccactaggtggctgtaaggtggcttgttggacggacccgagtcactggtgtcactagtccctgaaatcacagcatctccactgctctgacaatgacaggtttagaggttaggccccagcctgctgggtatgcatttcctttagtgctggagatggactcagaatgcgtatgtgaccctatgtgggccagcaattggccagtgcaagattgctggggattctgggaccggggtccttattttcaagatacagccatgtgaaaaaatggctcctaccaacacacgaagagggaaactccgcactcctattgcttggcagccatccttccatcactaagggaaccagccttaggataaagctgaggggtggagcaatggaaggtactcaggtttctatcacagtttttgtttgtttgttttttgagacagagttttgctcttgtagcccaggctggagtgcaatggtacgatctcagctcactgcaacctctgcatcttgggttcgagcgattctcctgcctcagtctcccaagtagctgggattacaagcgcccaccaccacgcccagctaatttttttgtatttttagtagagatggggtttcaccatgttggccaggctggtctcaaactcctgacctcaggtgatctgcccgcctcaggctcccaaagttctgtgattacaggtgtgagctactgcgcctggccccagctaatttttatatttttagtagagatggggtttcaccatgttggccaggctggtcttgaactcctgacctcaggtgatctgcctacctcagccttccaaagtgctggaattacaggcatgagccactgcgtccagcctctatgatggttctgtaaagcctgtaagctgaacagccctggagcctgccttacctctgaacatccactggcatgagccaataaattgctatattaagaccgttctagttggatttttttccttttttttttttttagacagggtgtcactctgtcacccaggctgcagtgcagtggtgtaatcatagctcactgcagtctcaaactcctgggctcaagcgatcctcctccttcagcctcctgagtagtttggactacaagaacgtgccaccacacctggtgaatttttaaatttttcttttgtagagacgaggtcgtgctatggtcaccccggctagtttagaactcctggtctcaagtgatcctcccacatcggcctcccaaagtgctgggattataggcatgagccaccatgcccagctgtttctttcctttttaaaacattttttattgagatacaattcacataacataaaattaatcactttaaagtttatacttcagtggctttagtatattcactatgctgtacatgcatcgccacggtgtaattccagaacatttccatttccccaagagaaaccacaaatctgttggcagttattctccacttctccccaccccatgccctaggtatccaccaatctactttctgtcttcgtggatttgcctgttctggacatttcatagaactggaatcacacagcatgtgggcttttgtgtctggcatctttctctccgtagattttcctattctggacatttcatagaaccggaatcacacagcatgtgggcttttgtgtctggcgtctttctctccatggatttgcctgttctggacatttcatagaaccggaatcacacagcatgtgggcttttgtgtctggcatctttctctccgtagatttgcctattctggacatttcataaaactggaatcacacagtatgtgggcttttgtgtcgggcgtctttctcttagcacagtgtttccaggttcatccgcgctgtagcctcattcaacacctcattatctgtgacgctaaataatattcctttattctgtttatccatttacctgttggtggtcatttgtgttgtttccatttttgggctattgtgaatagtgctgttatgaactttttttttttttttttttgagacagagtctcgctctgttgcccaggctggagtgcaacggcatgatcttggctcactgcaacctctgcctcccgggttcacgccattcttctgcatcagcctcctgagtagctgagattataggcgcccaccaccatgtccagctaatttttttgtctttttagttgagatggggtttcaccatgttggccaagctggtctcaaactcctgacctcaagtgatctgcccaccttggcctcccaaaatgctgggattacaggcgtgagccaccgcacctggtcgattactatagttttgtagtaagttttgaaatggagaagtgagtcttctaacattgttcttgtccaagactgctttggttctttctgtgtcccttgcagttccatatgaattttagaatcagcttgtccatttctggaaaaaaaaaaaaagctgttgaaactttgataggtattgcattaaatctgaagatcttaatgttaagttttctagtccacgaatatagaatatctttccattttctttcaacaatgtcttgtagattttttatagcagccttgcactttttaaattaaatttatttctaagtatttcaagactattcttttgatgctgtattttcttaatttgattttcaaattgttcattgccagtagatagaaatgcaactggttttgtatattaatcttgtatcctgcaactttactaaactcacttattagctctaccagtttttgtgcagattctttagggttttgtttggttttgttttgacagggtctcactctgccacccaggctggagtgcagtggcatgatcatggctcactgtggccttaatcttccaggctcaggtgatcctcccacctcagtctcctgagtagctagaactacaggtgtgtgccaccatgcccagctaattttttgtagagatggggttttgccaggttgcctgggctggtcttgaactcctgggctcaagcaatccacccacctcaacctcccaaagtgctggtattaaaggcataagccaccatgcccagtttctttagggtattctttatacaagatcatgtcatctgcaaatggagttttacttctttctctccaatctagatggctttttgttattttttcttgtctagttgcccagcctagaatttctagtacaatgttaagtaagtggcaagagtggccatctttgtcttgttcctaatctcaggggtaaggctttcagttttttaccattaagtatgatattagctgtgggcttttcacagattccctttatcagactgtgcgagttccctcctattcctagtttagtgcatgatttttatcactaaagggtatcctgactttgttaaattttttttttttttttttttttttgagatggagtttcactcttgttgcccaggctggagtgtgtgatctcggctcactgcaacctctgcctccccatttcaagtgattctcctgcctcagcctcttgagtagctgggattacaggcacccgccaccacgccccactaattttttgtatttttagtagagatggggtttcaccatgttggtcacgctggtctcaaacttgtgacctcgggtgatccacccgccttggcctctcaaagtgctgggattacaggcatgaacgaaccaccacaccctgcctgttaaaggtttttgtcaaattcttttgtgcctatttagatgaccttgtggttctgtccctttattctattaatatgatgtattacattgattaggttctgtgttttaaaccaaccttgcattcctgggatagatcctacttggtcatggtgtacaatcctttaacatgttgctgaatttggtttgttagttgtttgttaaggatttttgaatccaaatttataagggatattggtctgtattttttattgtgatgtctttgtcgggcttcacagcataagtcagtaagtgttccctcctcttctgttttttggacacatctgagaagtactggtgttaacccctctttaaacatttggtggaatttgccagtaaagccgtctgatcctaggcttttcttgctagaactttctttctttttttttttaactagtaactccaaattcatcaaatttgggaagatttcagcctttatttcttactaagaatgaggcatttctcttgaatgttttcctcatgttgctacaaacctttttttgtttgcttgcccttttttttttttttttttttttgagatagagtcttgccctgttgcccaggctggagtgcagaggcatgatctcagctcattgcaacctctgcctcctggttcaagcgattctcctacctcagcttcccaagtagctggggttacaggcatgcaccaccatgcctgttttctgtttgtttgttttctttgttttgttttgttttttgtatttttagtagatactggatttcactataaggctggtctcgaactcctgatctcaagtaatccacccgactcggcctcccaaagtgctgggataacaggcatgagccaccatgcctggcctgctgcaagccttttaatgtccagagctatttttaaaaagttgatttttgagttttttcccttttttcattgttttttgtggaggggtgaaatttgtatttcttcatcctccatcttcactgatgtccttccttagctgggtttctgatagggcagacaaaaatgccccaactcctaagacacttatttagttataaggatgatggttttcaaactttagtgaacacaattaactaggggagactattataaatacacattcctaggtcccaccacaaattccaatgagtttgtctgcggcctgggaacctgcattttgaaagcactggattacaagatctaaaagtaatgaacaaattgagaggttgagaggaggagaggttgtctaaatatgttaacttcacattgatttcatacaatagagccaaaagaaactacacagttgagaaatcaagatgtgggttgtatgctttagaattacgaaggcaaccactgtaagaattagaaacaaaaatagttaagacaggccaccttcagggaatggagttggagtaagacagggcaattttaaattttctttatagtttgagctttctttctcaaatacagctgttatctttataataaaacaaacacaaaaatgacaagaaaatcagtaaaaggggactattggccaacaattctgtcttcccttcccagtgcctctgccagtgtactcatccatccaccagcagctatggcccaggggcgtgcagcctggctcctcagaatggcacatggagctgggctcctcccaggagccacattccttcccacctccccccagaggcaggcatgggcaactgaatgcaaacaagatgaagaggaaggacactgtaaactaaacaattgttagcttccagacgcagccacaacctggagtcacagagccctcctggactcagggccaaaagagacctacacaaggtcacatagtgacccagtccttcccagaaccagtagtctttggagcttaaaaacataagcataggccgggcaggatgactcatgcctgtaatcccagcactttgggaggccaaggcaggcagattgcttgagctcaagagttcgagaccagcctggggaacacggtgacaccccgtctctactgaagtacaaaagaaattagccagcgtggcggcgtgtgcctgtagtcccagctactggggaggctgaggcaggagaattgcttgagccagggaggcggaggttgcagtgagccgagatcgtgccactgcactccagcctgggtgacagagtgagactctgtctttaaaaaataaaataaaataaataagcataaatctaaaacactttgcttggaagctggcctcaggcttagcttataccatgaattcatctgccaactgtttcagaggtctgggcagaagggctgcccagcaggaaccagaggtctggaacaaccaagtggggatggctgattctgagggagggatgggcatgtgacagtgtgccctctgaactgtgggggaatgtggctcccccgacccctgggctctggggggctgttttctgggtgaaggtgatccagactgttcaggccaaagccccagtgccagagactcattgtccctcccacggtggagatgttcctctctcaaggtgtcctgcattagcatgggacgttctcctccactccaccgtgcctggaatccatgtgggcaaggatgaggagggaagcagctgttagtgggaagtgaggctgtgggactccagcgttctggacagtcccagcccgaggtgacactactctgatgtgctgagtggctgacttggtagggagttagtgtttggaggttttctcacaattccatgagaatccagggcaggccatgatagtggggaaggctttcacatgacgcagcactggagctggacctgctggctgggcaagcttcagacacaggagggtggtggcatatcctttgctgtaacaggcagaaaatataatgatgtgacatgccccacctgggcccatcttgcctctggccctgcaggccttctgaaaccagctctaggaggcccagggaaccccacaggcaacaccagatttgaccccaccaaggaggccatgacaggtcccagtccacaagatgaacactatgctctttaaaaagaactcctgtcttagttggtgttagttcccagccagtgaagtcacaatgatggtagcaacaggtaccatcacctggcacctgctgagtgccaggcatggttcccagggatgcacacacacaacgctaccccgcagccccagccatccatgtacccctgtggaaaggaaggcacagagacacatcacgggacttgagagtggcagagtcaggatctaggcgggcagtcagctccagtgggggttcacagcccctcgctactctgccgttaccttcatccatgacaatgtgaccagtcatctctgcagctgcaggggccagtaaagtgcgagactcctaattccagtgcatatttgctgaatgagagaatgaaaatgtgtacccacatacctcaggtacctacaacagactgtcattataactgcaagagacagagtgaaattaatagacaccgacatgtcctcagcaattccaacaaaacaaatagtgacaagtacccaagttagtatgacctactagtctccaaatcatagtaactggtggtcaaaatgaagaggcaggacattccacaacagtgtggacgcaccaaaggaatgggcaaaaacacacacctccttcttctcaaaagtatgtgtactggttttctatggctgacatacaaattatcataaatttagcaacttaatacatcctagcactttgggaggccaaggtgggaggatcacttgagcccagcaattcgaggctgcagtgagctatggtcaagccactacactctagtctgggcgacagagtgagatgttgtctctaacaacaacaacaaagcccagttcgggtggtaaaggtggcatttcatagcgatgggatggtgcagggtgatcctggcagggcaggtgatgagagtgtggaggcagagcctgggaaacctccatgtcaatatgatcacagaaacaaggagcgctccatcgcaactggggcaaagtagaaaacgcactgagggactgacctgatgaaggtggagggtgcgaaatgcaatccaaagtaaagaagagatgagggtgcagaaaattatgggcaagaaacaatgctctcaggttctagatttgtggtcttaattgaatcacaatttggagaggcttattttgtttttatttttttgagatagtctcgctctgtcgccttggctagagtgcaatggtgccatctaagctcactgctacctctgcctccctggttcaagcaattctcctgcctcagccccctgagtagctgggattacaggcatgcatcaccacgcccagctaatttttgtatttttaatagagatggggttttactatgttggccaggctggtcttgaactcctgacctcagatgatccacccgccttggcctcccaaagtgctaggattacaggcatgaaccactgtgcctggccggagagtcttaatttataaactttaaaacttcagaacactaaaaaaaaaaattaattaaaaaaaaaaatatatatatccatttgggccacatgtggtggctcatgcctgtaattccagcactttgggaggccaaggcaggagggttgcttgagcccaggagttcgagaccagcgggggcaacatagcaagaccccatctccaccaaaaaaaaatacaaaaattagctgggcgtggtggtgtgcacctgtggtcccagctactctgggggctgaggtgggaagatcatttgagcctgggaggcagatgttgcagtgagctgtgatcgctcaacctgtcccccccacaacaaaaattttgagaatctgtctcaaaaaaaaaaaaaatttgttttgttgaaccatggtctagagaattattaatagtaaagaaaatagaagtaaaaacttatttttaataattgctcatttttgttttctaaatataactcttttatttattttatactattcatttatttatttttgagacagggtctcactctgtcacccaggctggaatgcagtggtgggatcacagctcattgcacccttgacctcctgggctcaatcgatccttctgcctcagcctcctgagtggctgggactacaggcatatgccatcacacccggctaatttttttgttttgttttttgagacagagttttgctctttttgcccaggctggagtgccatggcatgatttcggctcactgcaacctccgcctcccgggttcaagccattctactgcctcagcctccagagtagctgggattacaggcatgtgccaccacacccagctaattttgtatttttagtagagatggggtttctccatgttggtcaggctagtcttgaactcccaacctcaggtgatccgcccgcctcggcctcccaaagtgctgggattacaggcgtgagccaccacgcctggccaacacccagctaattaaaaaagaaaatttgggggatgggcacggtggctcacgcctgtaatcccagcactttgggaggccgaggcgggtggattacttgaggtcaggagttcaggaccagcctgaccaatatggtgaaaccccgcttctactaaaaatacaaaaattcgctaggcatgggggcacgcacctgtagtcctagctacttgggaggctgagacaggagaactgcttgaactggggaggtggaggttgcagtgagctgagatcgtgccactgcactccagcctgggcaacagggcgagcgagactgtctcaaaaaaaaaaaaaattttttttttgtacagatggagtctcacgaggttgcccaggctggtctcaaactcctggccacaagcaatacctcccaccttggtctcccaaagtgctgggattacaggcgtgagccaccttgcccagccaaataaactcttctaaagattgttcccaggacaagtttagggcaaatgttccacaaactactacatgtaagcacatgtgtgattacgactgaactttcacctgatttgtgaggccccaaagtagcctcagaaggaaagagccaggcccctcaaactgcggggaggtgagtattccacgctcacctgggccagctcctcctcctgcagctcaagggctcagcctggtggggtgctgttccccagggcgctaaggaggagccagtttctgtctcacatgggttgatggccatgcagcttgatttcctctctgagtcaaaggaatcttgtcagggccaggcccgcagctgccctcctgtcttggaaaactaagaactgcaccccacccctgcaagtctgtccatagccccggcaatgccacgtgctgccttccttttctgcatactggtcttggccacctgccatcaccatgtggccccagtcaccttccatcaccatgtggcttctcctatgccctggtccttgcccctgaggcatttaagcacatctccacacccgctcaacactgcagtgcagccattgctgtgtgcttctgatctcggtgagttcgcatgctcaagaagtctttggcacagagtttacgacctcaggctctccagttcaatgggcctaggttcatcccagacctgttctatttactagctaagtgcagttgtcttaacctcagtgagctcatctagttatatacagaatggtgatggcaatacctaccttataacattggactgatccacccaacaagcataccttgggcaccttccagtgttctctgtgtgggggtacagctgaactgccacagggtgacaaaggaactagagctggggttgggggtgggggctgctggggctggcccaggcaggaccttcagtgcctggctaggagccttggactctgtcctcagagcagtgggaacccaccggagggcttccgttgcagggtgggaagggtgatggggtatgccagactcatccaaacaaagccacagtctttggggagggggcagcaactggaggcagggggactgcacaggcagctatttgcaaggattctgcaggcaaaagtagtgtggggggaaattggggatgaacttgaaacttaggtgatgggtggggatgtaaattcattcaacctttatggaaaacactaggaagatttctcaaagaactgaaaatagaactaccattcgatctggcaatcccgttgctgggtatctaaaggaaaagaaatcattacgtcaaaaagacacctgtatttgtatgtttactgcagcactattcacaatagcaaagacaaagaatcagcttgagtgtccatggatggaagaatgaagaaagaaaacatggtatatatacacaatggaatactatttggacataaaaaagaataaaatcatatcttttgcagcagcatggatgaaactggaggccattatcttaagtgaaacaagctggacacagaaagacaaataccacaggttctcacttgtaagtgggagctaaataacatgtacataaggacttagagtgtgaaatgatagacaatggagactttgaagggtgaggggtgggagagaggtggctggtgagaagttacttaatgggtacagatatttgggtgttggataccctaaaagtccacacttcaccaatatacaatctatggatgtaacaaaactgcacctataccccataaattcatacaaataaaaaagaaatttaggtgataagagctatgggccttggttaccagttctgtgcatgtgcatgagtgtgtgacttgtggcatcacacggtgtcagggagccgatcggggcactgggagaggtgataaactagaatttggaaatgctgaattcgaggtgcctgtgaggtagcaagtgaggaagtccagtaggcagtgggctagacatctggaatttaggagagatcttaatggaagaaaaagatttgggaattagggttttcggggggtaattggcagagaattgagggaggagatggtgtggggtatcttcttttttttttaaatagagtcttgctctgttgcccaggctggagtgcagtggcacaatcttggctcactgtaacctctgcctcccaggttcaagcaattctctgcctcagcctcctgagtagctgagattacaggctactcgggattacaggcctggctaattttttgtatttttagtagagatggagtttcgccatcttggccaggctggtcttgaactcctgacctcataatctacccgcctcagcctcccaaagtgctgggattacaggcatgagccactgcacccggcccatatcttaattttttttttttttttttttgagacggagtctcactctgtcacccaggctggagtgcagtggcgcgatcttggctcactgcaagctctgcctcctggtttcatgccattctcctgcctcagcctcccgagtagctgggactacaggcacccaccaccatgcctgcctaattttgtgtatttttagtagagactgggtttcaccatgttagccaggatggtcttgatctcctgaccttgtgattcacccgtcttggcctcccaaagtgttgggattacaggcatgagccactgcgcccagccccatttccattcttgtttccaaaggactgtatcggctgtactatcacccctgtagggacactccctcaaacaccaaggactccttggtataacagctgcactttcagtatctgctgatcaagaaaatatataatgacaaaagtgcattataaggtcagcaatgtaggtattattttataatttttttttttttttaaagacagggtcttgtcatgtccaagctgatctcaaactcctgggctcaagtgatctgcctgcgttggcctcccaaagtgctgggattacaggcatgagccactatgccaggccaagctcagcaatatcttaagtgagtccgtattttattttttaatttttttaaatttattttatttatttaatttttgagatggagtctcgctctgtctcccaggctggagtgcagtggcgcgatctcggctcactgcaagctccacctcctgggttcacaccattctcctgcctcagcctccggagtagctgggactacaggagcccgccaccacgcccggctaattttttgtatttttagtagagacgaggtttcactgtgttagccaggatggtctcgatttcctgaccttgtgatccgcctgcctcggcctcccaaagtgctgggattataggcgtgagccaccgcacccagctgagtctgtattttattaactgcaatggcatctatatatatttggaaaatacagtactgtgtccacatgctctgtggaagctctgttatactaatttaatgataaatgcaaattactgagctatctcatctcaggaggtataaattactttctctaattgctaccttcaatgaatctctgtcaaatttcccatatttcccttaacaatactttgggcagatcccgtaagttcccaagcagttattcaaagtccagctagttcaatctcaaatacagggtaagcctttgcccactcccatcaccatgtgggtttatggcttaggactctttaagagaacaggtgggatgtgctgcctctgaattcccaccactctccttagggtctcccttctctgatgtcaggtcatggagaatgaattagggaaaacggcaaaagtctttccacgtacagggtacactggccgtatttttctcaggctaacactaatttaatttttttttaaattgaggtatactttacttacaacaaagttcaccaattttaagcacacaattcaatttttgacaaataactaccacaattatgatacaaaatattttcactgccgagcccactttgtgctccatgcagtcaatcctttcccccaacacctagcccctaagtactcatctgctttctctcaccacagtgttgcctttctagaatttcacagtatgcagcccttggtgtctggcttctcctgctgagcctgacaaatgtgagactccttcttgctgtgtgcagcagcagtctgttcctttattctgccaagtgttattccactgtatggatctacctgttccactttttgtttgtttgtttgagacggagtctcgctctgtcacccaggctggagtacagtggtgcaatcttggctcactgcaacctctgtctcctcggttcaagcgattctcttgcctcagcctcctgagtatcttggattacaggcatgcaccaccatgcccggctaatttttgtatttttagtagagacgggtttcaccatgttggtcaggctggtctcgaactcctgacctcaggtgatctgcccgccttggcctcccaaagtgctgggattacaggcatgagccactgtgcccggcctccactttttgactattattcataatgcttctatgaacattttgctataggtaagtcttgtggtgacatgtttctatgtctctgggctaagtacctagcagtaggattgctgagctgaatggttaagcggttacaacttcatgagaaattaccaaaatgttttccaaattggcctaatcattttgcattcattcctacctgctatatgtgagaattctagttgctccacatcttcatcaacacttgctactgttagtctttttaatttgggtcattcaagtggacatgtactggtttagtgatgtctcactggtggttttgtgtttctctaacaacagatgatggccaagcatccttcaggtacttatgtgtcatctgtattgtatttcttctttggtgaaatattattttgtttgtaaatcaatcaatcaatctacctatctgtctatctatctatctatctactgagacagggtctcactttgtcactcagctggagtgcagtggtgcaatcacagctcactgcaacctttacctcctggactcaggcgactctcccacttcagcctcctgagcagctgggactacaggcatgcaccaccacacctggctaacttgtttttttttttgtagagatggggttttgccatgttacccaagctggtctcaaactcctgggctcaagcgatctgcccacctcggcctcccaaaatgctaagatactgcattcagcctgtttgcaattttcttatagagccaaatgagttctttatgtattctgagtagaaatactttatgagatatgtgtttagatattctcctagtctgtagcttgtctttcattgtctaaatgaggtcttattaaaaattaattttctctgggtttattgaagtataatttacatttaataacactcaccctttttaggcagagttctgcgaattctaccactacaatcaagatatagaattttcccatcaccctcccaaaatttccctataccctcttctagtcaatcccctcccctcaaatgcaacccctggcaaccaaccactggtctaatagtgtcttttgaagtggtcaaagtttaaaatttgatgcagtatgattaatcaatttttaaaattatgtgtcttagtctgtttgtgctgctataacaaaatacctgaaactggataatttgtaaacagcaaattcatcacttacagttatagaggctgggaagtccaagatcaaggcacctgcaggtttggtgtccagtgatggctcgctctctgcttccaagatggtgccttgttgtgtcctcttgaggaaatgaacactgtgtactcacggtgaaagagatggaaaggcataaaagggctagctggttcctttgggcccttttataagggcactaatctattcatgaagttggagtcctcatgatctaatccctccctaaagtgttaaaatcaggtaacttaagttctccaactagctgtttttgatctctgtgaggccagtctgtacactaaccttttttttttttttttttttttttgagacggagtctcgctctgtcacccaggctggagtgcagtggtgtgatctcggctcactgcaacctctgcctcctgggttcaagcaattctcctgcctcagcctcctgagtagatgggattacaggcaagtgccaccacgcctggctaatttttgtatttttagtagagacggggttctaccatgttggtcaggctggtctcgaactcctgacctcgtaatctgcccgccttggcctcctgaagtgttgggattacaggcatgagccaccgcgcccagccccactgaccttctttcatggggagttcatgtaagtttttccaaaggctctgcagggtatcttcagtatagagtgttctgatatgggaaacgagctctagctcaacctccttcactcccaactccaactagctttgccatcagtgttactccctattgctgtttgctccacagcctcttgcctagtggatgtggtctggcattggacagcacaagcaatgacagggaagccccctgaagacccttgcccagaggtctctgagttttctagatttcttcaaagccaggtataaaggcagtctagcaagctcacactgtccaagcagacatccaatcagggaagatgccagcctctcttttttaggcatctgaagtcattatggtaactctctttgagctacaccctgttggctttagtaatagcaccgcaccctccctatttctgcacccaggaagctgcttagggaaactcttacccttcctcccgccccatccctcccccgttgtccagttatgtaagcctgagggtagggtggtggtggttcagaatggcagggctggctcttcagccctctaacaataagctctgggtgctgccatgttgtgctgcctttacagtgtgggatactgaatgcctctgggtactcacctttgtgccctgactcactaattccagggtaacaggaaaaggctcattaaacgtcccgttacacacagctctaataaaaacagcaataataacatcaaaacactcacatagtgcttgccaggcaccagtctctttctctacttatgttaactcatttcctcttcacaacaacccaccccattaagcaggatcagtaacccctttgcacagctgaggaaactgagacatagaggaggtaaactgcccaaggtcacagggacagagagccagagagctgcaatccaatcgagggagtttggctggagtccacgctgcgctgctttccacataggagaggcagagaaaagctgcacctgcaagagcgatggtttcggctgcgtatttggaataacgaagtcagcggtcaggagcaaggagaaggcacacatctcgggcctcatttctgtccccgagcgctcccccacactgcgagatcatggcggtggaggggagtcccgcatcctgacccccggccgccgcgcactggggggccctcaacctctgggttacttgggggcacgcagtagccacccacggggcagaaaagacgggggcggtcaactttctccactccagccgcctggggtcccgccatccctcagccaggacgcttggcagccgcctctaggctaggtggccacgagttgcgtgcgagagcgagggctgcgcatgtgcgaggcgtgcgtggtgcgtgtgtggcgccgcgggcttccgctccgacgtggggatcactagacagcaactgccccccaagttctcgtatcagctgcgggaaggagagaatggttctagtcaaccgagagtggaaggagaccaaatttcagcaaatgcacggacttgagtcctcatgagcagggtggccatggtgcggaagcagctggcacggccccctcaaccccggacccctggggtcctcactgccgacccgcgcattcagtgctgcgcataaataagatttccaattagaaggcctaggtcccagctctgccccacagcgtggctttgggccaggcacgtcatagccctggaactctttcttcccattgttgagatgaagagggtgcacgatatgttcgacgcagcaaggttaaatggaaggaaacggggcggccgcttaatgactggttgcacgcgcttgcgttgggtgctgcagcctggtgccaggaaggtggggcagggaccttgtggtgtaaggagtggcggtgaaagtgcctggggtcagagaggagaggcaggggatgagttctgagtgggaggagggggcagctcaggtttcgtcaagtagatgacctctgaaccagaacttgaaggataagacgggagatggccgagacgagagatggccctaggagcatcctggcacagcaggtgcctgaaagcctgcatagggcatagatgtgtctagagagttctgggaatgatcgctagagcggtgttgggctcgtagggaggcaagaggtgggcttggagcgggaggtgggaaaggcatggggagtgtcttgaaagcccccttcatctgcaggtcctgaaacgctgcagagggtctttaggcgtggaatttacataagatgtgtgtttcagtaaagtgacttacaggaaccagacaggaattgtaattatacaaaggggatttcggaggaaggaagttagtctcagtccagggaataatgagggcctgagctcaggagtgcagtggggagggagaaagaaggattccagagagattttgggcagagtaattgacaggctcccgattagagcagaaactaagatgatgcctaggtttggaaaactgggtgaattgaatcattaagacactgaagtgtccaccaagtgcagaccttgtgccaggcactcagcatccaaagatcaaaaaagacctagtctctgccctcaggtgcttctacttgaatagggcaggtggacacataactaggtaattgtatctataccctgtgatgttgaggattacagctgtccctgcctgacctggacctaggggtgagggcaggggggcttcctagagaagtgggacctgagcttggcagaaatgggagttcacaggcagtgtgagatgggtcccctaggtacagtaggaacgcaagcaggaaggccagggagtttgtgatgtgtttggagaactagaagcagatgctggagtgtaaaaccggagcttgacttttattctctagagggtggggagccattgcagagccttaggcagagaagggcctggtcagatttgggtttagggcagcttgccctggtgcctcgtggagaacggttgtaaaggcgagaagctaggagcgagaggtggctgtaggaagtgctggtgaaagagagtggaagctggagctgacacagggagttcaggaaggagagtgggctgggggatggtggggtggggaagtgcaggatgaggagggagggctgaggtgaggtcagtgctgcacaccaggtgcatgaggcctggggagcatctccatggaggtacctaatggcaatttactagccaagtcatcttgaccagttcacttagccttggcgatttgcctcatattgcagaatgtggatgacaagacctacctcataatgttggagtgattcactcaacgagtatttactgagtatctgttggtgttctgggtgccagggattcagctggatggcctcagcagaaaatacacaggaaatatgggttgagctaaaaatcaagggcccaattagaacagatttgactatcatccatattaacactcccagaaaagagggagatgagcagagagagagagagagagacttttccagttgcaaggcaagagtaggctgcagggtcaccttgtgctggctggcaggagccaggggctggcatgtatcctgtttggccaaaccatcattaagtggcagttcgagaataggccctctaagctcttgcactggtgtcataacatctggggatttcctgtgtgtcagtgtttgtgtggatagagggagctggtggtaagtgttcagccaggtgcatccaagatcccagggtctcatgggaggacccagggctggaactggcctcctcataccgctgtacagctctgcctggagcctggagcctcctcctctgctgagtggtgctctcagcacaaaatgagtgttatcaaaggggcatatattctgcactcactagctgcacaagagaagaacagcggttgttggtatgccttataactactcttcagaatacacacccctttgacaacattcactttgttctcaaccataaacaaccacaccccttgtttatggttgagaagatgaaggcctggtggaattagcttcttgccagagactacactgtggccagaaggactctgccttttccttggctatctgagcttcatctcagaggtgtttaattgctccagccagatccatgtgaatagcaaattaagcccacacagtggctcatgcctgtaatcccagcactttgggaggccgaggtaggcggatcacttgaggtcaggagtttgagactagcctggccaatatatgaaaccctgtctctactaaaaacacaaaaaaattagccaggtgtggtggcacacgccagtagtcccagctactgaagcggaagctacatcgagttgagatcgtgccactgcactccagcctaggtcacagagcgagactccatcttaataaataaatagcaaattaatgttttaagtgaagtaacaataacggtttactctgatttaatttacaaataaacatggagtttttgtttataaattttcaccaaatttaaaatcttcaaaggctaattaaaatagttaatatttattgagtgcttcatatgtattttctcatttgattttcacaacatccccatgagttagatatgattatcattgccattttactgaaagtaaggttggagcaaggtggagtaggatggagtaaggatgaggttaagggtggagtaaggttggtatacggtggctaaagttggggtaaggtaaaataaggttagggtaaggtgggataaggttgaggtaaggcggagtaaggttggggtaaggtgggctaagatgaagtaaggtttggcaaagttggggtaaggttggagtaagatgagtaagggggtaaggttggagtaagcttggggtaaagtgggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaagcttggggtaaggttggagtaaggttggggtaaagttggagtaaggatggggtaaggtggggtaaggctgggataagatagagcaaggttggggtaaagtggggtaatgtggggtaaggctgggataagatagagaaaggttggggtaaagttggagtaaggatggggtaaggtggggtaaggctgggataagatagagcaaggttggggtaaagtggggtaaggtgggataatgctgggataagatagaacaaggttggggtaaagtggggtaaggttggggtagggtggcctacagttggagtaaggtgaggtaaagttagggtaaggctggggtaaggtggagggtaacttttcagatgtgatactgtttttgcacgccttatctttcccttcttgctgctcagttaggagcagcttttctcctcaatttaactgaagtgagcatttgctggagaagttgagggaacacgcacattgtgcagccctgtttgtctgagctgaggcttgtgtttgtcctaggaagggccatttgggagctgtttgagatggcatctcacagcgagcagaggagggcacagtcagggtggtgattggggtgaaaactctgctcatgaagaatgatttggtatgtgcacagatgatagcttttctaaatcctattttgtttttctgaaaaataagtgacagtaacctgaacacctttgagtttctccaatgctggcttagtctgaggctggggcctgcctgccatccctttccctctctcactgagtggctgctgcttgcccgtctctgacctttgagagtctcaggtctgatggtggtggagatggagcacaggtgactgattcgggggactcggagacacaccccttggaggagggacagggagggttggaggtagctggtttcatgtgggcagaacacaggacatagacatcctctgtcaacgttggtcttctctgtagtattttgtgcagggtcctggtcagtaaatctggccaagtgagtcatctgaaagcagtcatgtgatctgtgttgataagtggataaagcattggctttcatcactctctggatttgttagtgaactttaaaaaagaaacctttcttgtgcttttaaataatgactgtgttttttaatcttaccatttaaatctagttttcctgaagatgcctgtgtgcctttggccaacaggatctttgtccgaggtgacaatgaagatagtataccatgagcccatactgcctgcagagtcgtggctgccaaaattaacagctgtggaattatttgtgaccctgttaaggataaacatatttgtcccttttcattttatgatcagcaactgctaaagttcttacttgtaattgcaatttactgccctcactgtattgcttagtttagaggtggacacagaaagaatggaacatttgttttcttttgggtctgagctatgaatttgggccgcattatcatgcaggccttggcccctctgtctctgcaagattgggctttcctgtttttgtcattctcagcttacttcgcaggcatgctttgtgtagaggagaaaaataccctccaaagaacctcccaaggaggttaccaggtacacggttcagccaagtgggtgactcaatgggatgcatctctttgtgtttgtcagggccgggaagggtgtgacagcatgtggggagagactcagttcccagccaaataactttaccacctgagctatgaggcagttcctgcacatcaccactccagcagggtccagccttgctgcggcagaaagcgagtgtgtgggaaagcaaatggctccacacgacgcttgcagtgttcagagggatgagtatgaattgtgtgtatctcagggacccctttgacccatgaatacatgtatagagtattctctattatgtgggtgaagtgtatctacttacatacttaagtatttgtgagtaaaacgagaaaaaaaaaagatgtgaaggatggatagagaaaataaaacagcaggaggctggtagttcctgaggctggatgctgggcacatgggcatccattctactcttctctctatacttctgtgtatatttgaacattttcaaaataagaggttttattttgttttttgattttttttttagatggagtctcactctgtcgccaggctggagtgcagtggtatgatataggcttactgcaacctccgcctgctgggttcaagcaattctcctgcctcagcctcccaagtagctgggactacaggtgcgtgccatcatgcccaactaattttttttgtatttttagtagagacggggtgtcaccgtgttggccaggatggtctccatctcttgaccttgtgatccacccgccttggcctcccaaagtgctgggattacaggcgtgagccaccgcacctggccttttctctttctttctttttttttgagatggagtctcactctgtagcccaagctggagtgcagtggtgcgatcttggctcactgcaacctctgcctgtggggctcaagcgattttcgtgcctcagcctcctgagtagctgggactacaggtatgcgccaccacacccagctaattttttgtattttagtagagatggggtatcaccatgttgcccagggtggtctcgaactcctgagctcaggcaatccacctgccttggcctcccaaagtgctgggattataggtgtgagccactgtgcccagacagaatcaaaggattctttttttaagtatgtacagtatttgtcttagtctattgtgctgctgtaacaagatacttgagacagggtagtttataaacaacagatatttatttcttacagttctggaggctgggaagtctgagaccaaggcaccagcattcagtgtctggtgagggccttcttgctgtgtccccatggggcagaaggcagaagggcagaagggcagaaggcagaagggcaaaacctgcctcgctggttccttcaagccgttttacaaggtcactgatcctgtttatcagggctccccctgcagaacttaatcacctcctaaaggccttgtatcttaatgctgtcacattggcagttaagtttcaacacatgaattttgggggcatccaggccatgacagttttcaaacatttttctgcatatgtaggacccatcaaacgctgtactcctgctctggtgcacacactgagctgggcatctgggttcaacaatgcttcactttcctggcacgcagagctgaggggcagggacagagatgaaatctctgaggcacagtgatggtatcatggaaaccttgaactgaggggagggtcggagttggtttcactgaggaatcgaggactgagctgagaaccgaaggatgactgggaacctcctgggtgctgtgggactgggactgggggcgagggagagggagtctcagatggtgggaatcccctgtgtagtggccctggggcctgatggtggccagaggatggagcccagagggaggggaggatggtgaggcaggggtggaaggtaaggggtgttccaggcccggttaggggattggccttggtattcgtgccatggacagccattgaggcgtctaagcagggagtagccacagatcaggctcctgttttccagccaccgtttatttgtggcttggaggatggatggcacaggcaggcactggcatccaggtgagagatgacagctccccagactgaggctgttgggggtgtgtggtggcaggagtgggagcagaggtgtgtttgagagagatggaggatgtagtggcggtctaggcatgggtcatggggaggaggggtgagcataaacggtgatggagccattgcagagatagaacgccagaacaggacctgatgtggaagggaagaccaagccttgtgtctgacttgggtggatctggagggagattttgcaaagcaacttggtcatgtagacttggggctcagaggaggcccctgggaaatgagtctgagggactcctccgcatgcagacactactgagagtgtggaggagttgcttagggagaggtatgagccaagggaccacatgaggtggctccagcagactgttgagccccagctcgggtctttttaaaattaaacaagccacacttaggtgtgcttgttgtaaagatgtgaagccatagctactatatacagatgcagacacttgcagacacttttctagacagcacagctacacgtatgtacatatgcatatatattattttccgttttatgtaaatgggatcataccatcatcccagcaactcatttttttgaaggtttgttttctgattataaatgtcatgcaaaggtataatgggagtcctctcctaaaatcccattctccagagataacatcattgttaacatagtccttaaacgttttcttctatacctatatagtattttattatatggatgaatcattatttataattattcctctgtggaagaacatttaggtgcctgtaagttttcttctgttaaaatatagccctacagtgaacattcttgagtgtgtgtattcacttgtgtgcatttgtgagtagttttgcaggctgggctcctccaagtggaattgctaggctaaagggcatgtaccttttagaggtttttgtttgtttgtttgtttgtttgttttttgagatggagtcttgctgtgtcacccaagctggagtgcagtggcgcgatctcagctcactgcaacctccgcctcccgagttcaaacaattctcctgcctcagcctcccaagtagctgggattacaggcatgcgccaacaagcccaggtgattttgtagttttagtagagacagggtttcaccatgttggtcaggctggtcttgaactcctcctgacctgtagtgacccacccgccttggcctcccaaaatgttgggattacaggcatgagccaccacgcctgcccaaccttttagagttttaacagatgttgctccgtggcctgagaatgcctgtttccccacactttctccagcactagatttaacctaatctgttgggtgaaaaaggttgtcttattgatgccttaatttacattctatccatgacttgcaactttaagcatcttttaaaatgtttattggttacaggcaatcttcatgagaacattgtatcctctgtctgtttttcttttgggtttcctttatttttccttaatggagttgaaacagttctttgcaggatctggcagttgattgacagcttcttaattctaagaatgcccccaacttaaaagcagccctggagggtccccttcttccgtgtcacccccagtgtcttgtgtgagttgtcaccgggccccacttgttttcctctgaagcattctgacagctctgctcgtggcccctgcgtttaagagacatgctgggccgggcgcagtggctcacgcctgtaatcccagcactctgggaggccgagatgggtggatcacgaggtcaggagatcgagaccatcctgcctagcatggtgaaaccccatctctactaaaaatacaaaaaattggccgggcatggtggcaggcgcctgtagtcccagctcgggaggctgaggcaggagaatggtgtgaacctgggagatggaggttgcagtgagccgagactgcgccactgcactccagcctgggtgacagagagagactccgtctcaaaaaaaaaaaaaaagagacatgctgcaggccaggcatggtggctcatgcctgtagtcccaacactttgggaggccaaggcgggcggatcacttgaagtcgggagtttgagaccaccctggcaaacatggggaaaccccgtccctaccaaaaatacaaaacagctgggcgtggtgcctgtaatcccagttaactcggtaggctgaggcaggagaattgcttgaacgcaagaggtggaggttgcagtgagtcaagatcatgtcactgcactccagcctggacaagagtgagattctgtctcaaaaaaaaaaaaaaaaagagagagagagagaaacatgctgctgcagagcacccctgcagtgttcccgaggtgtgaggtgacagagccctagtctctgattctgtgacagcttcagagggtgacactctgtgtcgggcccaaaagggctcccctgggctgtcagtgatgagcttctctggtcacctttggggggtgccgtaacctcacctctgttcagtttctcagatggccagtcagggaaaagagtggccatcaacatatcatgaaaatgttctatttgaaaatgcagagtacagttcctggggacacggggatctcccagtgctcggtgcttcaagaccctgggcagttcatattagacaatgtcacaggaaggtgtgagtcattctgggcggttgctagtgtgccgtgcctgtgggcttggtgctggggaggccaggcaggcttggtggtggggaggccaggcgtgggagtgatgctcctgactatgccttctctcccagtcactcctttctgggttttgttaggggagggggtgtctagggcccaggccatcaccagaagcttggccccctgctcttgcttctgccaaacactccacagttcagctggaagcgccctcagggttgtccaagctgcctgcagttggttgtgcctccgactggctctggccccgcctcccagcctccgtagctggttcctgagccctactcctggggccgccagcctctcctacttccctcctctctctctgcttgctttgcagcagctttactgagatatgattcacataccctacaattcacccctcggaagaagagttcttagtagagttttccatcatttttagtctgttcacagagttgtgtaaccatcaccatccagtttagaatatttgcatggccccaaaagaagcccagtactcatgaatcagtcactcccatttccccctcacctacctcctctctcagcctctcccagcctctcacaaccaccagtctactttctgtccctatggatttgccctttctggacatttcatgtaagtggaatcagatggtatgtggccacttgtgtttagagtggtgagcagagcccaggctgcggcagacatccagaccaaggcggtctgggccaggtgacagcctggctagggtttggcgaggtcagttcctcctgcctccgtggggcccatgagccgcagtccccagggatgcatccggagggcatcagaggcaggacgccgagcaagctgatacccaaggagtcacagccaccctgggagcttaaagggccgatgcagggattgggaggccgtggtctgggtcagttgggaactgggggtgatcagggatggccactcatagaacctctggatcctgtaatctagagagacacggaacatgagctcccctgttggtgtctctcctgaacccattccctcaatatagacacgcttctcctttgatgttgtagacagtctgagatatattctactaattttaccagttaggctttccgtgaattgatgccttgttaaagttctctagagggttttgacattcattttcattcattcacatcttagggtgaattattttaatctaggtactttcttcctaacagaagaatcaagttaatgaaactggaagtccctagtctccttagatttcataattggcctcacaatgtcacaagaaccctgatcctggcactcgtcctatcaggtgctgtgcaagggaagcgctgtgagtgacagagcaaagccaggcatctttcagtcaaggattttctctccagttgtgtgcaagataagaagtgactgactctgtgtagccaggaggctgaggcaggaggatggcttgaggccagcggtttgggaccagcctaggcaacatagtaagactcggtctctacaaaaaatttaaaaaatatccgggtgtggtggtgcgtgcctggggtcccagctgctgggaatgctgaagcaggaggggattgcttgagcccaggagttcgaggctgcagtgagccatgattgcaccactgcactccaatctgtgtgacagatgagaccctgtctcttaaaaaaaaaaaaaaaccaaaaccaaaaacaaaaaaccacctctctagattatgttgctcctctgctccacaccatgctgtggcttctgttcacagtcaaaggtcccaaagtggccatggcctgtgctgcctgctgccgctctccacaccctggccgctcggtccccaggagaccaggcatgctcctgccacagggcctttgcactgggtgctctctgggtctggaacaggccccacacccactcacttcccccaagtctgctcagatgccacttccacacttcctaacaaaaggaagctgttggtgagcagatgctcagtaacttatgtgtggccagaaggagcgagtggctccagcctgcgcgtggaaagctggctctcctgggtcactgctctcactgagcctcgggtttctgctgcccagaggactgcgtggctctttcttgtacctggcagttctgacactgctggaattgggaagaaaagggaccctgagactaggtcactccctcctggggtctcaaggggccctgtccctggggctggaggctgagcttcctcctccttgtccccaccctggggatggcctgtgttctgtcttccttgtgctcaccactggcgcctgttggctgaggcaagagggcctccagctgggttcttcctgtcctctagttggtgcctgaaggccccagttgggtggggtctctctttaccctctggtcatatagcaaactgtggctggtgtgtggtgagtcagccctgtgtgcaggcagggtcccatttccctgtgtgcaggccacagtctgtcccagtgcctgcaaggcctctgccccagctggcctggaccccccttgccagactctgctctttgtggggctctgcccacatctactgcccagtaggacgcccagtctccactgctctttggaggtaaaagagggcctggcacactggcacggggtactttcccaaaggtcaaagatgtgttgagtgaacgaaggtagagagttcatttctgagacctttgctggcctaattcagctcagtggggtgaagttattactgttgagatgcttgctgttttgattgtctttagagagcattcttaatatttggatggtttaaaataccaaggagaaaaaagggaggagaggcttcttttttaaaaataccaacttcattatgaaaacacacaaatgtacacacaaatagaataatataatgacacccctcccaccaccacacggcctgtttcagtctgtgtccacagcgaggcttctgaaggaaaggctgtggagggggtgagctggtggagcccatgttctcccgggcctggccgggatgtgcttgccgctgtcacagctcccccatctccacccgtcacatgacatcgaatgaggccggcctggctctagccactgcacaggtgtcccgtggtcatttccttcctgtgctgctgaggcacacagtcacccgtttgcaaactctgaggtgttttcccttttcccatttcctgtcactgttttgaagctgtgagaggaagagagagacctcgatctgataaccattcatttactatcaaagttggggtcacatccttataagaacgtgtggcttgaggtcatgaatagcagtaatgcgagggaagctaagattctggcaggatgcaaatgatctgggagttttcattttgtcgttatgtatgggctgttttctgctgcattgttaactattggaaaagattttccatggattattatatggattatagaggaaaatgcaaatctccaacctctatacatttaatcacttaaatgaaatgtcaagttttcttgttaagaattatggtgctgactggaagaacaacatggctttaaatatgacttattagtttctttccacttctaaagttcaaaataaaacatcataggtggcaaaacaaatcaaggtaaaatacgttttgaaaagtcataactttactcaacaacaaaaaataagaaatagacagaggacttgaatagacatttctccaaagaagacatacaagtggccaagaagtacatgaaaagatgcccaacatcactggttattagggaaatgcaaatcacaggcattaggatggctattatcaaaaaaagccaagcaaaaccaacaacagaaaataaaagcattggcaaggatgtaaagaacgtgaagatgtggagaaattgaacgttggtttactgttggtgggaatgtaaaatggtgctgccaccgtggaaaagtttggtatttcctcaaaaagtgaatcagaggccaggcgcggtggctcacgcctgtaatcccagcactttgggaggccgaggtgggcagatcacgaggtccggagatcaagaccatcctggctaacacggtgaaaccccatttctactaaaaataaaaaaattagctgggcgtggtggtgggcgcctgtagtcccagctactcgggaggctgaggcaggagaatggcgtgaacccgggaggtggagtttgcagtgagccgagatagcgccactgcagtccagcctgggctaaagagcaagactccgtctcaaaaaaaaaaaaaaaaaaagtgaatcagaattaccgtgtggtctaggaattccacgcccagaataggcatgcactgaaaagaattgaaagcagggactcaagacacttgtgcatcgatgttcacagcagcatcattcacgctagctaaaaggtagaaacaattcaaacatgcaccgacagataaatggataagcaatgtggtctacagacatggacaatggaatattatccagccttaaagaaggaactctggccggtcacggtggctcatgtgtgtaatcccagcactttgggaggccgaggcgggtggatcacgaggtcaggagttcaagaccagcctggccaagatggtgaaaccctgtctctactaaaaatacaaaaattagctgggtgtggtggcaggtgcctgtaatcccagctactcaggaggctgaggcagagaattgcttgaacccaggaggcagaggttgcagcaagccaagatcatgctactgcactccagcctgggtgacagagcaagattctgtctcaaaaaaaaaaaaagaagaaggaattctgacacatgttactacatggatgaatgttgaagccatgcccggtgaaataagccagtcacaaaaagacaaatattgtctgatttcacttatatgaggtatctcttatataaggtaatcaaattcatagagacagaaattagaatagtggttaccagagggtggggaagcagggaatgggaagttattattgaattagtatagacttacagtttgggatgacaacaaagttctggagatggatgatactgatggttgtacaacattgtgaatgtgcttactgccacagaactgtacaattaaaatgattaaaatgatccttttggccaggcgcggtggctcatgcctgtaatcccagaactttaggaggccgaggcagatggatcgcgaggtcaagagatcaagaccagcctggccaacatggtgaaccccatctctactaaacatacaaaaattagctgggcatggtggcacgtgcctgtaatccccgctactcgggggctgaggcaggaaaatcgcttgaaccagggagtcggaggttgcggtgagccgagatggcaccactgcactccagcctggtgacagagtgagactccgtctcaaaaaaaaggatccttttgtgctgtgtatattttaccacaattaaaaatgcaggagttagtaaaggaatggaacaagatcatgtgaacgtgagttatgagaatactggaatggcatccggcaaagcagactcagaacaggactgttcctagagatagggaggactgttttatgcggataaagtggtcaagtcatcaagaagacattatgatcctaaatatgtatgcacccaatacagagcaaaaactgacagaaccaagagaacaaatagacaaatgcgcagttatagctagagatttccacacttctctctcagtaaatgacagaacaaggaggcagaaaatcagtttaagaatgcagaatactgcctgggtgcggtggctcacacctgtaatcccagcactttgggaggccaaggtaggcagatcacttgaggtcaggagtttgagatcagcttggccaacatggcaaaaacctgtctctaccaaaaatacaaaaattagcaaggtgtggtggtgcatacctgtaatcccggctacttggtaggctaaagcagaagaattgcttgaacccgggaggtggatgttgtagtaagccgagatcacgccattgcactctagcctgggcgacaagaacaaaactccatcatgacaaaaaaaaaaaaacaacaacaacgacaaaaactagccaattgagttgggcacagtggctcacgactgtaatcccagcactttgggaggccgaggcaggcagatcgcttgagctcaggagatgaagaccagcctgggcaacgtggtgaaaccctgactctacaaaaaatccaaaaaattagccatgtgtggtggtgtacacctgtggtcccagctgcttgggaggctgaggtgggaggatcactgaagcctgggaggtcaaggctgcagtgagcagagatcgcgtcactgcactccagcatgggtgtcagagtgagaccctgtctgaaaaaaaaaaaagtcagttgaatctagcaacaaaaaaaaggataggccatggacaagtagagtttatcccagtaatgcaacatcagcttaacatttaaaaatcaatataatcctccatattaacacaaaaaaagtaggaaaacactatcaataaagagcagaaaactgatggtacaacaagtggatgaatctcacaggacttatgttgaatgaaagaagctggacaaaacagtatgcactgtgattccttttatagaaaactctagaaaggacagatctcatctagaatgatggaacacagatgggtggttccctgggtcctggtgtgaccaggaggagtcatgagggaagcttctggagtgatgggatgttcttggttttgactgtgatgatggttacttacacaggtatacacatttgtctacatgcattgagctgtatacttttatttttttttttgagacagagtctcactctgtcacccaggatggagtgcagtggcacgtcttggctcactgcaagctccgcctcccgggttcacgccattctcctgcctgaggctcccaaatagctgggactacaggcatgggccaccacacccggctaattttgtttttgtatttttagtagagacggggtttcaccatgttagccaggatggtctcgatctcctgacctcatgatctgcccacctcggcctcccaaagtgctgggattacaggcgtgagccaccatgcccggcctaagctgtatacttaagatgtgtgcactctctcgtatgcaagctgtacatcaataatattgatttttaaaaatcctttaactgaggtaaaacactgatgtacagtgtagttattctgcattttctgaaataaccatagtttatatcagaaagaatagggagctacagaagatacagaatagtgcatataagttgctactttttattgataaatttttacatgtttatgtggtacatggagtagttgttacattacacattacagaatatgtaatgatcaactgagagtatctgaggtatccatcaccttgagtgtttctttcttttttcttttttttttttttttgagagggagtcttgctctgtcacccaggctggagtgcagtggcacgatcttggctcaatgcaagctctgcctcccgggttcacgccattctcctgcctcagcctcccgagtagctgggactacaggcgcccgccaccacgcccggctaatttttttttttttttttgtattttttagtagagacggggtttcactgtgttaaccaggatggtgttgatctcctgacctcgtgatctgcctgcctcggcctcccaaagtgctgggattacaggtgtgagccaccgtgcccggccttgagtatttatttctaagtgtttgtaatgaggtaggaggcaggcgagactcaactccggaccagattgaggactggccaaaactaggaagaagtgcacaaaggacctctccataagacatgcccaccagtgccatgacagtttactattgccatagcaacacccaaaacttaccacccattttctagctgtttctgaataacctgccccttaattagcatggcactaaaagtgggtataagatatgactgcaaaactgcccctaggctgcgaccctcagcacactgcctatggggtagctctgctctgcaggggcagccagccagagctatagcactgcctccaccgcaagaaagctgttttcttccactaccagcttgctcttgaattccttcctgaggaagccaagaacctgccctgcatcagtagcatttcaagtcctctcttctagctgctctgaaatatgcaatacattgttgccagctacagataccctactaccctgctatggaatgttagggcttatttcttctacctaaccatatgtttgtacccattagccaacttctctttatcctcctcccacccacacatgcttcccagcctctggtatctatcattctattctctccctccatgacatcaactttttagctcccacatatgagtgagaacatatggtagctgtctttctgtgcttggcctatttcacttaacgttatgatcatcggttccatccatgctgctgcaaatgacgatttcattcatcttatggctgaatagaattccattatatatatatttatatatatatatatatatatatatatatatctatctcacattttctttatttcttcatctgtcagtggacacagtttgattccatatctttgctgttgtgaataggagagtgctaccactgttaaaggatctatttacatacatgcttataaataaatgcatccaggatttttgtaaagatctatcattactttcactcttttgtagcttttgaattttttcatcatgtgcatccacttcctaaaaacaaaatttctttttttaacttttcttttctttttctttttttttgaggcagggtctcattctgtcacccaggctggattgcagtggtgtgacctgagctcactgcaacacgtacctcctgggctcaaacaatcctcctacctcagcctcctgagtagctgagactacacactcatgccaccacacccagctaatttttgtattttttgtagagatggggttttgttatgttgccaagactgctgtctaactcctgggcacaagcaatctgcctgccttggcccaaagtgctgggattacaggcatgagccaccgcacccagttgtgtttttttgtgttttgtttttgtttttgtttttgttttgagacagagtctccctctattgcccaggctggagtgcagtggtgctgaaacaggaaaagttcccgtgtccccctcgcagggcaggcgatgggggtgtggttcgcttcttcagtgccccactgctcaaaccgctaggggagcatacagatgggcaggctgtggggctccggccccagggcaatgtctaggggttaatgtttacagccaggacccagtgggcatgtgctactgtttgctcttttagttttgctgtctataggtggcttttgttaaccagttcaattagaccctctaggcctggcatggtggctcatgcctgtaatcccagcactttgggaggccgaggtgggcagatcacttgaggtcagaagttcaagaccagcctggcccaacatggcgaaaccccgtctctacttaaaaatacaaaaattatccgggtgtggtggctcacacctgtaatcccacctattcgggaggctgaggcatgagaatcacttgaaccccagaggcagaggttgcagtgagcagagattgcaccactgcactccagcctaggcgacacagggagacaccatctcaacaaaaaacaaaaaaaaaaaacaaaaacaaaaacagaaaaaaaggaccctgtaccttgttgcgaggacagaggacttcctgtatccgggtttttgacttggtgtaccggaagaattggatcacacgtgggcttggagaatgagtgcaaggttttgttgagtggaagtagctctcagtagatgggggagccagaagggagatggagtgggaaggtggctttcccctggagtcgggtcgctcagcagcccaggctctcctcgactgccctggccaaactccacgtcgttccaccagtcgagagcctgccagtgtctgccagtgtgctcttctgccagagtgctcctttcaacatcctctcaaagtccagcggcttgcgtctccttctgccagtgtgttcctcatgatgtccagccacttctgtgtctgcctgctagggtcttgggggttttcataggcacatcatggggatgcagcaggccagggcattctgggtaaatgcaatgtttgggcaggagtgcctatcctcacctaggtacatagtggtggagctctagccagggaccatgccctcctctacccagcacttctcttccccactcctgtatcatttaaagggaccacgctgttcccttcccagcacttcccttccatatcagcgctatcattagctccctgcagccacaaactcctgggctcaagtgatcctcctgcctctgcctcccaagtagccaggactaaaggcatgtgtcaccatgcctggctaatttttttaaaaagttttgtagagatagggtcttgctatgttgcccaggctgaattaactggactattgttcaggaaaccaaagtaccaggcagtacaatgctagatttgaagtctatgaaaatagtaccctctgaatcattaaggcgcatcttcctatgagaggtggcttgagccagaccctggtggccaggggcagtgtctgtctggaccttcccaccaacaggctgtgcagccctggccagcccctattgctcctgtactctttccttacctgctaaacacacccaaatcacagcagaaatccaattcacttgaagacaagggctaagcctttctcataaccaaaggccgtgcgcttcccagagcaaaagtctgtatttgtcccctcatgttctgagctgccaggcagtaattctagcctacagttactcagtgtgacctaaaataacaattacccaagaaatgaaattctgataatttcaagtagaataaaatggaacatattttagtgaatggattgtaaggaaaagcctaaagatttggaactgcccatacgtggcactttaaaaatcttgggccctttatttcaggtaatcagttcatagagtaaaaacccatgtgactgccaagactggttattagttcaagcccaagaacacatcttcaaaggaagagaatgaatttatccacagttctgattgttttttacgttctaaaatcacacttattattaaaatataattcacttaatggtgatggtaattacatcagccaattcacttaaaatgaatgcgcaaagatgaatgcacaaaaatgcaccatttttcaatgaattggctgatgtacttaccgtcaccatcaaaacgcagggtgttcccctttccccgggaagcttccttgtgctgcagtctctgtcaaatcccttattcacagacctggccaaacactggtcactagagattagatttagctttcagggtttcacagaagtggaatcattcactctatgctgcttcttgtctggtacctttcgctcagcacaatgtttttcagctttatctgtgttgttacatgtgccaaacctttattcctttgtcgttgttgttttgaaacagtcttgcttcgttgcccaggctggagtgcatcggtgccattgtagctcactgcagccctgaactcctgggctcaaattatcctcccgcctcagcctcccaagtagctgggatgacaggtgtgtgccactgtgccctactaattttttatttttattttattttattttattttgagacagagtctcgctctgtcgcccaggctgagtgcagtggcgcaatcttggctcattgcaagctccgccttctgggtctacgccattctcctgcctcagcctcccgagtagctgggactacaggcgcccgccaccacaccaggctaattttttgtatttttagtagagacggggtttcaccatgttagccaggatggtctcgatctcctgacctcatgatccacccgcctcggcctcccaaagtgctgggattacaggtgtgagtcaccacgcccagcccattttaattttttttagagatggggtcttaactatgttgcccaggctggtgttgaactcccggcctcaagtgatcctcccaccttcgtctcccaaagtgatgggattacaggtgtgagccactgcacccggccacatttattccttttgatcgctgaacagtactcctcaaatgattttttaaaaataactatcttcttcctcatgacctgctggtaactcctagaacagtgatggaggagaattatggaatggtccttctaagctcctgaataattaaaccagtgagcagagccactgtcccatcccgttggccacaccagacacttgggaattatttttggttccttcttctacctcttttcaattccaataattaccaagttctatcaattttaatcccctaatatctctctaatcgatctcttcagttgctatttaagtaactcttcatttcttctcacctgtgttactacagaaattcatttttctatagttttgccttccatcaatcccttctccatcttaaaccaaactgatcttactgagaggaatgttgtgatttcctctctctctctctctctggaatgaatatatacatacatacatatatatatatatatatatgtgtgtgtatatatatatatatatatgtgtgtgtgtgtatatatatatatatatatatgtgtgtgtgtgtatatatatgtatatatattccagaaccttttcatcaccctaaagagaaactctgtccctaaatcccattccccctcccctagcccctggtaaccaccaaccaccatctcactttcgctctacaaatttgattattctaggtaccccatataacgactcgtacggtatttgtccttttgtgtctggcttatgtcacttagcccaatatttttcaggtttatctatgttgtgtcatgtgtcagtatcaggatttcatctctttctgaggctgaatgatgccccactgtgtttatccattcatctgttggacacctgggctgcttctatctcttgctattgtgaagaatgctgctgtgaacatgggcgcacaagcttctgttccagttcctgctttaattatctagggcatacacttaggactgggattgatggctcatatggtaattctgtgttcaaatttttgagaaaccacctaactgttttccacagcggctgcaccattttgcattcccacaagcaatgcgcaaaggttccattttctccaaaactggatacagtgaacaacaatgaaggtttttggttttaaacatatatacatatgttgtttatatgctctacacacatctctgtgtgtgtatcttaaaatgggtgccagtgactcgccattcagttttgggcaacgtggactctcggtgcctcagtttcctcacccctaatggaggtactgatactgttatcattcttgaagtgattgtgcagtttaaatgagcaaatatatgtaaatgacttaagtgggacctgacaaatgcagatgctataatgtaaggatggctgatctcattattgttgtcatactattactgaaaatcagtgtgaatgaaatctctaaactttgcaatcaacactgctcacctgggtctccgtagaagctgcagcgagctggggctgaggcagacaagcctgtggacatgagaacagatgcatgtgctcctcagacagacagacagtagggtgttgtggaaggggtcatctttagaggccacatactgtagtccatctccctcacagagcaggaaggtgaagcttgccaagcctgagggaatcctccagcccagacatcctatgagggcattgccaggacttgggggtagtgccctcgctccaggcatgtcttttccccatcccttgagcaggaagaagcacagcagacagcagggtgcatgcagagtacctggcagaatcgcctcggtagtgagaacaagcctgcgtgatgctgcaggtgcccctgactgtgactgagcctggcttcacacacctgggtttcctcatggctgttttcagcaatttggttactgtggtcccaggatgcatagcctctcaagattccacagaacagcctggtccagcatgaaggctacacggtgcctggtgccatctctcaacgtgtttgttaaaagggaagctttgtggcctcttcatctaatatagagggccttcaaattatagacttccaagtccatagctatagagattttcattttaaaatatatgtattggctgggcataatggcttacgcccgtaatcacagcactttaggaggccaaggcgggaggatcacttgaggccaggagttcaagaccagcctgggcaacagagtgagaccctgtttctcctaaaataaaaattaaaaaattagctaaggatggtggcatgcacctgtagttccagctacttgggaggctgaagtgggaggatcatttgagccaaggagtttgaggctgcagtgagctgtgatttcacactgcactccagcatgggtgacagagcaagactctatctctaaaaacaaaacaaaataaataaaatacagtaaaaaatagtgtgttgtgttgtggggtctgatgcggatgtctacagctcttcattcctaatgcatctgctgtttttccagctccccctgaggccacgggccacacaggccacaggggctctgcctgcccagctgggtccacaggaattctgccaagaagggctttcttttgcccttgtgggagctggtgggtcacttcctggtttttttctcatgattattgtttgtgaagtttgaatagaactgactcctggcttgttttttaattattaaagatttaagaacttttgaaaagattaaaaaagaattttgctcatattcctgccagccttgcataataattgttttcatttctatagacttttttctggtcttttctcatgctgacacagattttacattgttgtaatcattgtgtggggacaatttaggttctttcttctcagttttgtttgtaaacatctctttcatatcacattatttattattattattatttgagacagggtctcactctgtcacccaggctgcagtgcagtggtacaatcatagctcactgcagcctcaacctcccaggctcaagccatccttctgcctcagctccctgagtagctgggaccacaggtgtgtaccatcatgctcggctaatttttacattttttgtagagatggagtctcgctatgttgcccagactggtcttgaactcttggcctcaagggaccctcctgcctcagcttccacagtcctgggattatagacatgagccactgtgcccacattatttatttttgacagccaaatagtaatctgtcaggttaacatactgtaatatattatagagaagagacattcctctctgactggtatttaattttacccaaattttcactatcgtgaattttgtttaactcttcttggttttatgcaatttgtaaaaaatcactgttcataatttgtcttccatgcagttcatgccacagcatttgagagtgggtgctgccctcctccaccgtccctcttctatcagaattccgccacaagaaatgtcctggcattaacattttggaagctgctttagtgagggccactcttggggctggacaaatggctacttgagggtggtatctgccatgaggttggtcaggtacaggggcttggctggcctggcctggtgtggactattccaaggtcacgtcatcaacaacaaggtgggttagctatggtgcacatactccgctaccctaagcagctggaaacctggacaaaatgtctgaatcaactgttttcaggtgttgagaaacaggccatgcagagctgtgaccccagagtctacagaaatgagatggcaaggcgccgcagctgccctgggtttctgccttggtggggtcgggggtgcttcatgcacatcaagcagtgcgagtggcttggctgcattgaggagcggagatggggggctctgaacagctgtggtttgtgggctgagtcctggagggatgggaacactgcagagagggggctccagtaatcctcagggttgccccgagcattgggagatcctaagctgtgtgtgtgcggtgtgcaacgtcgtggagacaggaaagaacgagtgaccaggagcagaaaggcagctgagtccaagagttcacctgttctgggagatgctcgggtggcagccagactcagtggatggctctcactgaactcccgggatgccctagagacccctgaagagccccaccttagtagtggagcaaataagctctagagtaagggtgtcttagaccctcccctgcagagcttaaaacaaggcttcaaagtgaggttggaggcgggccccaatctggaggcttggctcatgcaagggaccaaattgaggcctagctaaacagggagggggcagaagcagctttccctaagatacacccaccagtgtgccatgtcagtttaccattgccatggcaacacccagaattgacctctcctttccatggcaatgaccggacaacccaggagttcctactgcttccctagaaatttctgcataaaccactcgttaatctgcatgtaattaaaagtaggtataagtatgcctgcaaagctgccctgagctgctactctctgcctatggggtccccctgctctgcaggagcagtcacggagctgcaacactgctgcttcagtaaaagctgtttctcctaccaccagcttgctcttgaattctttcctgggtgaggccaagaactcttgagggctaagccccactttagggctcatctgccctgcctcaaaaaaatcaaactagtctgccagtgactttgctgcttaaccaggcttggaagaaaagaaaactatagatcaaggtccttcatgaacacaaatgtgaaaatcttcaacaaaatattaccaaatatgactcagccatgtacaaaaaggattatacaccataatcaagtagagtgtatcccaggagtaaatggttagttcaacattcgaaagtcaatcaacacaattcttcctatcagccaactcaagaaggaagcatttatgatcggctcaatagatccagaaacggcatttaacaacatccaacacccatgtgtgaccaaaacacaggaagccgggaattaaagggaatttccttaatgtgataaaggcatctacaaatgccctacaactagcagcatgcctaagggtgaaagaccgaatacttttcccctaagggccagagcaaggccaggttgtctgaccccatcatttctattcaccattgtactggaggttgtagcaagggcaaaaggtgagaaaaaggaaaggcatacagattggagaggaataaacaaaaccatctttattcccagatgataggattttcagtgtagaaaatccgatggaatctacagaaaagctaccgaaactcacaaggaaatatatctactagcaaaccactgaaaattgaaataaacatgtccatttatgacagcaccaaaacacaaatttggtcatgaatcctataaaatatatgcaagagctacatgctgaaaacaataaaacttggccggtgcagtggcttatgcctgtgatcccagcactgtgagaggctgaggcaggaggattacttgaacccaggagttcaagaccagcctgggcagcatagcaggagcccatctttataccaacaaggaagaaagaggccaggcacagtggctcacacctgtaatcccagcactttgggaggccgaggcgggcggatcacttgaggtcaggagttcaagaccaacctggccaatatggtgaaaccccatctctacaaaaatacaaaaattagcagggcatgatggccggtgcctgtaatcccagctactcagaaggctgagacaagagcatcgcttgaatccaggaggtggaggttgcaatgagctgagatcgcaccattgcactccagcctgggtgacagagcgagactctgtctcaaaaaaaaaaaaaaagaagaaagaaaaagatatataaaaagctataaaatgctgataaaaaaatcaaagaattcctaaataaatggagaggtatattgtgttcttgtgttggaatagtcaatattccaaggtttacaagatgtcagttctcccacactgatctagaaattaaactaagtcccagtgaaaatctctgcaggttttttggtagaaatcgacaagcggactctaaaattcacagagaaaggcaggaagctaccatagacactactctagagaagaatatggttggaggacacacactatctgatttgaagacttactacaaagctacggtcatacagacatggtggtgttggagaaggcatagacagatagatcaatggacagacaggcaggccacagaaatcgccccacatggctgtggtagattgccttttgacagtgtgaggccagtttagtggaggatggattgtttcgggatgaagttcttggttcagagggtctgagactcaaggaggagttctggagcccagagacaccgttttgggaggtgtagacttagagttggaatggaggacgtaggaagatgtgagcttccccagggagatgggaagatggaggagaaagctggggtcctgactctggaataggagagagacaggattaagagagggacctaaaggcggggaagctcacgtctgcacaatggggaacgtatctggggaaggagctggcacatgctgtcaggtgcttctttgagcacaagatggcccaggccggaaaagggatttcagggaggtaaagaaatgcagaagaatgggagagcagggtggagacacaatggtgctgcacatcagcctggtgtcaccctctgctgcacatggagggatgggggtcatgccaacaaacagccatacagttttccttcttagctgcttgttttttttgagacatggtctggctttgttgcccaggccggagtgcagtggcacaatcttggctcactgcagtctcaatctcccgagctcaagcagtcctcccacctcagcctcccaggtatttgggatcataggcatgcaccaccatgcctggctaatttttaaaattttttgtagagacagggtctcactatcttgcccaggctggtgttgaactactgggcctaagtgatcctcctgtctcagcctcccaaatcatgctgagattacaggcatgagctaccaggcccggcctctcaactcttttttttttttttttttgagacagagtctcgctctgttgcccaggctagagtgcagtggcacaatctcggcgcactgcaagctccacctcccgggttcacgccatcctcctgcctcagcctcctgagtagctgggactacaggcgcccgtcaccatgcctggctaattttttttgtatttttagtagagacggggtatcactgtcttagccaggatggtctcgatttcctgacctcgtaatccgcccacctcagcctcccaaactgctgggattacaggcttgagctaccgcgcccggcctcaactctttaaagtaagatctatcatccccattttacggacaggggaactgaggctgggttcctgccgccagcgagtgggacccctggcctttgagccccggcccttcccaccaccctctgctgctggggctcagccctcgggcacgtggttgtgttaatggagagccatggccatgacttggagggcccggagagcgtgcacatcatgcctgcttcccatgatgccctgcgaggtgggcagaggccgggggtgctcaggccgagcccctgctacagcagatctgaggcaccagcagggactggctaggtcctcccaggcaggccaatgtgcccgggtcttgggcctctctctctcactcctcactgcctctcagctgcccaggcagcgtcccctgcagagcagccctggagcctggccccaggctgtgttgctgcctcttgcccccatggggctgcctctgcagggagcctgagtcgtttcctccctgggcaggtttcaaaatggctaagtccagtggagaaaagaatggctcaaagggaccacaggcttgaatttgaaaaaataaaaatgctcgatgccaaagcgtagacgcacatttatttgaacgacttacactttgacctgaaacagttttttccaaattgttttccacagcggtaatctcttcaaaatgaacacatgtgaggtcttcgaatgtatgttaaaggccagtatttgtttttttttttttttttttttttgctttggaagaaccgacctcatcgtttgcatgagaacctgatattcttggtcctctgtaccttttgtaacttcctctgaatgagaggaaatatggtttccagttatgtttaatttactttaaacaaatcaaagcacagatttctacttcctgcctgtgtaatacttgactgcaggcagcttcaaagggcagaatcactgttcttgtgactgtgcctctgtcgtgttctgttataaacagttcaaagctctgcattgtacaggagcgcgcggaacagcatgtagagatctttttctctgtagtggcggcagagctgtgtgtgcccttttgctttgccttgtgctggtggtggattaagtttaggttttcatagaatatatatttatgtagagactcagagtttatttttcctgttttctccagcactgcttaactcattctctgaaatgtttatcacaaatggcaggtggggctcagaggatgtctctatctttgttccttggcttaaactggcaggttgttgtaaagggcagtgggagggaaagaaaactaaggggaaaccaaattacttatttagggcttgattttctggcaggtgaattgggcttaggaaaccccacctagattagcagctgttcctgaccggcccctcgccaaagctgcacccctgggtggtggtgggggcttcaaattagggtgtcccaagggctggattgttccagcaaaggtgttcctggattcccaaagcaagttcacttgttttaggaacagttccctgaggctctgcaggggctgctgggctgccttgtctccccaggtccatgacgccaggccaccatccatgcatcctgttgtgtgctgggacggggtgccagatgctggcatccaggaacagagagtggattgcatgaacatggctaccatgcagttggttctctgctgctggggtgcaggcacctgaaagacacggaggagctaacccagctgagaagggtgtgtgccagtcaggacctggggtgcaggacacaaacatcacaccactgggttgcacaagacttggaggaggggcccaggaggatgacatcaaggtctggagggggttgctcaacaacacacctggatgtgcagtgcaggcatggcacctgcctctgcagcagggcccaaagactcgatggggctgccatgtggcctgatgtgagttggagtgaggctgtgacccccgggtgaaagctgcagcctgcatgcatcgatcacaagcgagggctggctgtgtcctcatcccaggaagggcggggtgagggcctcaccacagtgtgggcagggcccactcacgccctgggaagtgaatcaggaggtggcagcaggcactggggctctctaatctcttgcccgtctttgtccagttattgtgagagctccaattccctgttcttatttttctgaaagtgctgataagatgggtacagaataaatcaaatgcaaagttacgtttcctggcttaggaagcaaaaacctaagtataaccttggaagtgctcctgggtactcctttctttccccaaggtgatttttccctcttaaacacattacagtaaaatacatacaacattcactactttaatcatgttttgtttgtttgtttgtttgtttgtttgagacagggtctcgctttgttgcccaggctggagtgcagtggagcaagcacagctcgccttctgggctcaagtgatcctcccaagtagctgagactacaggtgtgagccacagtacctgactgattttgaaaaaaaattgtttgtagagatagggtctggctatgttgcccaggctagtccaaacttctgacctcaaactatcctccaggctgggactcccaaagtgctggaattacacacgtgagccactgtgcctggcccactttaattttttttttttttgagatggagactctgtcacccaggctggtgtgcagtggcacaatctcgactcactgcaatctccacctcccgggttcaagtgattctcctacctcagcttccctagtagctgggactataggcatgcgccccatgcttggctgattttttttgtattttttagtaccaacaccatgttggccaggctgttcttgaacttctgacttcaagtgatccacacatctcggtctcctaaagttctggaattacaggtgtgagccaccgcacctggccccactttaaccatttttaagtgcattaaggacattcacagtgttgagcagccagcaccatcaccatctccagaacgtcgtcatcttccgaggctgaaactctgttcccattgaacaccacctccccactccccatggctgtctcaggagctggcctgagcactgctgccctcaaggtcactctagaagtggagcttcagttcggcccccacttcctgtggctctatccctgcaggtgtgcccgggatccagaggtggccccatgaggccttgtccgagcaggtctggctggacccttgctcctcttggagctgggtagggctgggtgggctgcgtagggatgttcagggcagtggtcacctgttgcccagctctgggtggagccctgtctgaagacagctgttcttttctaaagaaagaagatctgtcagacgttagtcatctgcaccactgtcacagctgacgttgattgagctcctgtgtcctgggcactgtcccaaaagccccctgcatgcagttcttgccatttagtaccttttgttttgtgtttactgaatggatacagccggaagctagctaaatttaactcacgccctcgacttgggtggaggtgaggaaggggctttctgaggcagggaattgggtgagggctttattttataggcatactttggagatagtgtgagttcagttccagaccacactgcagtaaagtgaatatcataatgaagtgggtcatatgaattttttggtttcccagcacatataaaagttatgtttacactaaactgtagtctattaaatataggatagcatcacatctaaaaaaaacaatttttatatgccttcatttaaaaatacttggccgagcgtggtggctcatgcctgtaatcccagcattttgggaggttgaggcgggaggatcatgacctcaggaattcaagaccagcctggtcaatatggtgaaaccccgtctctactaaaaatacaaaaaaaaaaaattagctgggcatggtgtcgcgcgcctgtaatcccagctactcaggaggctaaggcagaagaatctcttgaacccaggagacggaggtggtagtgagccgagatcacgccattgcactccagactggatgacagagcgagactccgtctaaaaaaaaaaaaaaaagaaagaaaaagaaaaaaaaactttactgctaaaaatactaatgatcatccaagtcttcagtgagtcagaatctttttgctggtggagggccttgcctcggtgctgatggctgctgactgatcagggtggtggttgctgaagggtagaggggctgtgacaatgtattcaaatcagacaacagtgaagtttaccacattgattgactctgcctttcacaggagatggcccccggcactggaggctgcttgataccattttacccacagtagaaggtctttcaaaattagaaatcctctcaagcctgctgtgttttttcggttatgaaatattctgaacgctttgttgtcattgcaaccatgttcacagcatctgccccaggaggacgttccgtctcaaggaaccactttctttgttcatccctaagaagcaactcctcatgtgttcaagttggatcctgagattgcagcaattcagccccttcttcgggctccacttcttttttttttttgagacggagtctcgctctgtcgcccaggctggagtgcagtggtgcaatcttggctcactgcaagctccgcctcccgggttcacgccatcctcctccctcagcctcctgagtagctgggactacaggcgcccgccatcacgcccagctaattttttgtatttttagtagagatggggtttcaccgtgttagccaggatggtctcgaactcctgacctcgtgatccacccacctcggactcccaaagtgctgggattaccagtgtgagccactgcacctggtctaggctccacttctaaatctggttctcctgctgtttcccccacatctgcagtgactttctccactgaagtcctgaaccctcaaagtcatccatgagggttggaatctacttcttccaaactcctattaatgttgatattttgacctcttcccatgaagcaaaaatgttctcttttttttgagacagggtctcactcgttgcccagtctggagtgcagtgatgtgatcgcgaggacatcaacaaccttctgggctcaggtgagccctgcctcagcctcccaattagctggaactataggcatgcaccaccaaacctggctagtttttttttttgtttgttttgttttttttttttataaacagagtctccatatgttgccctggctggtctcaaactcctggactcaagtgattcttctgcctcagcctcccaaattgttggaattaacaggtgtaagtcaccacaacttgctgcttttcatggcatctagactggtgaatcttttccaaaagattttcaatgtacttcgcccgaatccatcagaggaatcaccatctatggcaactatagccttatgaaatgtatttcttgaataataagacttgaaattgaaattactcttcagtccatgggctgcggaatggatgttgtgttagcaggcatgcacacagctttcatctccttgtccatctccatcacagctcctggatgactaggtgcagtaatattttgaaaggattctttttttttttctgagcagcatttctcaacagtgggcttaaaatattcagtaagccctgctgtaaacaaatgtgctgtcatctaggttttcttgttccatttctagagcgcaggcagagaaaatttggcatgattcttaaggccctaggatttctggaatggcgaataaacattggcttcaacataaagtcaccagctgcattagcccctaacagagccagcctttcctttgaaactttgaagccagtcattgacttctcctctctagctaggaaagtcctagatggcatcctcttctgatagaaggctgtttcacctacattgacgatctgttgtttagtgtggccaccttcatcagtgatcttagccagatcttctggataacttgcggcagcttctacatcagcacttgctccttcaccttgcacttttatgttatgtagatggcttccttccttaccctcatgcacaaatctctactagcttctaagttttcttctgcagcttcctcacctctctcagccttcatagaattgaagagaagtaggatcttgctctgaattaggctttgacttaaggaaatgcatggctggtttgatcttctatccagaccactaccacattctccatatcagcaataaggctgtttcactttcttatcatttgtgtcttcactggaggagcacttttaatctccttcaggaactttacctttgcattcacaatttgattatttggtgcaagaggtctagctttcagcctgtctcaacttttgacagccttcctcactaagcttaatcatttctaacttttgacttaaagtgagaaatgtgcaacccttcctttcacttgaacacttagaggccattgtagggttattaattggcctaatttcaatattgttgtgtctcagggaatagggaggcctaaggagagagagagagatggggcatggacagtcagtggagcagtcagaacacacatattatcagaagttcactgtcttatacgggcatggttccgggcccaaaacaatgacaatagtaacatcaaagatcacaggctgggtgcagtggctcacacctgtaatctcaacactttgggaggctgaagcacgtagattgcttgagcccaggagtttgagaccagcctgggaaacatggtgaaacccagtttctacaaaaaatacaaaagttatccaggcatggtggcacacgtgtgcctgtggtcccagctactcgggaggctgaggtgggaggatcgcctgagcctgggagattgaggctgcagtgaaccatgactgcagtactgcactccagcctgggtgacagagtgagaccctgtctcaaaaaaaaaaaaaaaaatcattactcatgaggcaggagaatagggtctggaagcagggaacctaaatcctcaccttttctgcactggcagatgggaaattggctgtcttcaacaaatctgactgattgccggtggagtctttgtttgcaacttggtaacttcactctggccttggaatggttgctgtccacaatcaatcagactgattgtgggcagagtctttgtttgcatagaagtataactctgtaacttcatcctagcctctgattgctttttgcaaccaatcagatgtttgcacaggagtgtgacctttgtaacattacttcagcctctggttggctgctttctgcaaccaatcagaatgattgtgggctatcacttcatttacatgagatgagcatgaagtggccaatgggaaacttcttgggggtatttgaacccaagaagattctgtatctgggccctgagccactgcttgggcccgctcccacactgtggcgtgttctttcattttcaataaacacctgctttcattcttttgttgcttcattctttctttgctttgctgggtgttttgtccaattctttgttcaaaacaccaagaacctggacaacttgcagtcacgaccctctaccggcgacagtcaccgatcaccatgatggatacctaataaggaaaaagtatgacatattatgagaattaccaatgtgacacagagagccagaggtcacatactgttggaaaaatggcaccaagagacttgctagacacaggcttgccacaagccttcaatttgtagaaaacacaatatctataaaatgcaataaagcaaactacaataaaatacaggtgtgcctgtattctattttgccccaacctccacaacaaccatgaggtgcaaagatatttcacccccattttgtagaccagaaaacaagcagagagaggctaactgtaagggtgtgtttttagatcccaatgccaggaagggtcagagtgcaggttctgccacatttgacatcatgcggtccagggggccactgcacctgatgcccgtgtcatcagggctgggatttggtctccaatgcacctgtgtgatcaaggcccaggatgtgtgccggggggtggctttccttcctgggggaatgtgactggcccataccatttctggtttaactttctagtgaatcgattttcatgtctttagagtttaaactgtgcaggcagcctcagggagagccaagagttccgtggacagtcttgaagcttgatgggctcttctgagtgacagcgtgagcgccaggcacgagtccagactgtgatatgggctttgaccctctgacctcattgcctctctgtttatccgctttgcttcctctgcagctgatgtcattgtggttcacatttcgcagtaggatgatccctggggagtgggtagtgagggacacttgttggggagggcctgtctggacctagggacagagctgggatcatcagctgtgacctgttggccagatcccagcaccgctctaccccatggctcaggagcttactatgtttgttacattgctaaatggtcagaaagaaggaagaagaaagaaggagaagaggaggaggattattattcacgattggcctaaggggctcacacctgtaatctcagcactttggaaggctgaggcggtggactgcttgaggccaactcaatccccgtctctacaaaaaattaaaaaattagctgggagtggtggcatgagcctgtactcctagctactcagaaggatcgcttgagcccaggagttggaggctgcagtgagttatgatcgtaaaaaataaaaagatttcatgacatgtgaaaacgatctgaaattctaattcactgtccataaatgagctttactggaacacagtggtgcccattccttttgctttgtgtgggctgttttgctcccacggcaaggttgagtagctgggacagaggccatgtggcctggagagcctaacatatttaccaactggcccttcccacaagacgcttgccaagcccaggccctgcgttccctcccttcctgcgatgacaaagtcaggttggtagtcacatttcatggggttggcacaaaccgttggtgcttaatcggagtggaagaggctgtgctgggggccaactgcacaactgcacgggttccagagagaaggcagcggcccacatgccatcaactgtcccacacctgtggctgccagggcctgcctccgagggacgcccccctccgcccgccgtgtgttcattaagagggccggggtctgtggtggccccacaggcagcgggcctctgtcctgtgctcaggtggtgctctttgaagggtggcagggccgggggctcctcttgtgctgccagagctggtcccagagacccacctgcccagggccagcccgtgggatggcagccccgtgcgtgacagtggccttcgcatagtaccatctgctcccagtggggcggttctagacttgctctgggaagcagcctttccagataacaggagacaccccagccagtcggtggggaagcaggcctggggtcggccacggggactctggagggtctcttcaggccacggctggtgtttcctgaggaagtggggccgacacagaagggccagggccgcgtggttgagaagtaaggatgaggatgatgggggctgctaagatccctggccccatcactgtgcagcttttctactcacttgtggtaacaaacgcccaacatgacatttatcatcataaccatttttaagcacccagttcgataacctaagtatatcctaagtatatccttagtataacctaagtatatccgcgttgttgtgcatccagtctccaaaatccttttcatcctgcaaaactgaaacactgtacccactaaaccacaactctcctttctcccttcttttcagcccctccccagcttaccattctgctttctgtctgtgaatttggctattctagagaactcatgtcagtggactcactccgcatttgtctttctgtgactgacttattttactttgcataatatccgcaaggtccatccacgtggcggtgtgtgtccgagttccctgcctctccaggctgagtgatgctgccttctgcggatgtgtcatcttttctttatccattcatctcctcatgggcactcaggttccctctatctcttcagcatgggtgggcatttgccccaatcctgctttcgcttcttttggatctacacctggaaatggtgtgctggatcagaggctcttcttacttttaacttttgaggagcagccacactgatttccatagcagttgcaccatctcacattcccaccatcggcacacgagggtcccaccgtctgcacatgagggtcccaccgtcttcattcacatcctcaccagcatgtgtgtgtgtgtgtttttttaatagcagtcatcctagtgggtgtgatccgttttgttttaagtaaggcataattttcatacaacaaaatgcacagatcttgtttcccataacaggagttttggctgatgaactttcatgaaatctacatcccacccagggataggacatttccggtgctctgggaagctccctctcacctttccctgtcatccctctccacccggcaccgggttgctgtcacaccggaagagcagtgcctgcccctgcccttggtgccgatgcacccacagtaaagacagaaaggtttgcgtgggcccaagcctgcctccccattaggcagccctgctcagggctgctcctcgcacccggggaggaggtgcctgtgcctccaggagcagggagagggctgggtttgcaggtgccctgcatccagctccagcctctccccagcccgctgtgtttgcttttggagggctgagcacaggatgtgcccgtcctctgcctgatgacagtggagtgatgtcaggccaggtgcttcccggagggaggcagggcgtgcagcctgctgcctggcaggggagggggtgggcaaggttcccaaagagagagctgagctacgggccgactatgcatcagcgatgtttacaacagcttcccgccctcaccagtttcgaagtttgcgtttccattctgagagcctcattttcagccccacttgctgctaaagggcagtttatcttcagaatcaacattcggatagaatcgcgcaccctctaacctgggagcagaatgtgctcggctttgacaactatacagtttttatgagcagcaggttcctgaaaagcttgtgttcccaaggccaggctggtgccacgggaaggcctgtcccaggctgagctccgtctctcctcccgtggatttactcagtaacgttgcaggagtctgagccccgacagtgtcgtgggttcattcaaccttcagcaaatcattattcctgtcagacgcttgggatacagagttgagcaggctgggaaccagggggcagactcaggggatgacagcatcacacataaatactcatatccacctaagtgtgcattcaggctgggtggtcagggggtcccttagaggaagccacaccagaagggtggatgggatttagccaatgagaagagctgaggtggtgagtctcaggggagctcggatgcagcctctgtggggaggtgtgtgaagggccatgccctaaacagcgtccagggcagtggggtggccagcccctgactgagggggttaatgggggtggtgataagccccagaaccagaattgcttttcaggcctcagtggctcagattccagaggctttggtgtctttggcagaaagagactgaagtttctatttcagttctctcagtgaaaaccagcatttctcacccaggctttcatgctttggctgagttctaggctccttttctcccaagacatggagcagattccaggctggtggccgtctctgtgtggtgcctgagctgcgtggcatcgatggctgtgagctttgtccccactggctcacgagctcacagggccacactgccttctccacaccgtaccccacagcatcgcggtgccagtgcctcctggcctccagaggtggctattggctgcctcatgccttcctcagagatctggtttttaaagtaaagtgagggtcagtaaatggagggagacagaagcaaagaaaaatgggttggacacagaaaacaaactggctgtcagagctctgatctgaatctcaggcatcctttcctttcttttaaaaatatgtgattgtggtcaaacatacagaacataaaaggtctacccatttttaagtgcgtagttcagtggtgttaaatccattctcactgtgctgcagccactccctagaactcttcatcttggcctggtgcggtggctcacgcctgtaatcctaacactttgggaagctgaggcgggcggatcacccgaggtcgggagttcgaaaccagcctgaccaacatgatgaaaccctgtctctactaaaaatacaaaaattagctaggcgtggtggcacatgtctgtaatcccaggtactcaggaggctaagacagaagaaccacttgaacccaggaggtgaagtttgcagtgagctgagattgtgtcattgtactctggcctgggcaacagagtgaaactctgtcccaaaaaaagaaaaaaagaaaagaactcttcatcttgcgtgaatattaagcattttttgaaaaacaaaaggaggccaggcattgtggctcatacctatagtcccagcacctgtattatcaaggcccagggtgtgtgcctgggtgtggcttccttcctgggaaggatcacttcagtccagaagttcgggaccagcctgagcaacatgacaaaaccccgtctctacagagaaatgcaaaaattagccaggcatagtggcacatgcttgtagtcccagccactctggaggctgaggcaggagaattgcttaagccagggaggtggaggttgcagtgagctgagattgcaccactgcactccagcctgggcaaaaaagtgagaccctgtctcaaaaaataaataaaaaataaaaaaggaaaggaaagaaaataaacagagcaaggttctcttcaaaatttagctgcagccaggtgtcgtggctcatgcctgtaattccagcactttgagaggccgaggtaggaggatcacttgagcccaggagtttgagaccagcctgggcaacatagtgagaccttgtgtctactaaaaaaagaaaaaatttaaaaaaccaggcatggtggcatgtgcctgcagtcttagctgctcagggagctgagacgggaggatcccttgaggccagttcgaggctgcagtgagctgcgattgttgcactgcactccagcctgggtgacagagcaagaactttctcaaaaaaaaaaaaaaaaaaaaaaaggccgggtgcggtggttcccagcactttgggaggccgaggagggtggatcacttgaggtcaggagttggaggtcccccctggccaacatggtgaaaccccgtctctattaaaaaatacaaaaattagccagttgtggtggcatatgcctgtaatcccagctactcaagggctgaggcaggagaaccgcttgaacctgggaggctgaggttgcagtcagccgagactgctccactgtactccagcctgggcaacagagactctatctcaaaaaaaaaaaaggctcagctgccaggagccagcatttttcctcttcccatcattccctttctgcagccaactcctgcccctcctcatgtgcattgtgggggctgtcacagccctgtggcttctgtggggcgggggcacagcggtgactgctgcccagggtagagcttgtgcagaggctggctccccatgacctgcctgctcctgagtaagtcactgactcccctgcagctcttagcaagccaagggacagggctgcttgctctgcagattggtgaggtgagggacaaccccccagcctagcggctctagtgctgtgggaaggtgcagtctgcggcagaagggcccagggacttggcctgttaagggccacgccaggctgtttccttcatgtctcacctgcagcaccaccacacctgccgctggtggagcccctcccccctcacacccccacttctgctccttagcaggtcttagttctcattttgcatcacagtgggccatgtggttttccacaaaacaagagggagaaaggcaataatacagtggctttcgatttgtttcgatttgtagtagtaaagtctttctttaaataaaatcttccctggtaattgtgtcatggaagaaataagcaaagcatctctagttgaggcagccagggtgcctccccgtgctggggcgcccccactcccaaagcccgtatgcccagaggcccctccactgacccaggaatttgtaaaccctcgccttggtgttcagcaggaagctcacacaggggcagcaacaagccccaccgccaccccaatccccccactacgcctacattgaggctgccctcgaggtgagttcatgcatacagaagtccaaatttagaccacacgttgggggtgatactgcctgaggtatgaagataggatttgtctgataggcagatgtaaaggctggaaattacctgcatgctaaaaagcaaaacagagattccaggttcccatggtggagggaagcacagaatctagtaagacaaacctcccagaaactcaccgcagcaaccaagttgaagagaggaacaaccacaggcctcgaacttcaggagcccatggtcagggagaaacagaagattcgggtgcagcagggcatggctcccaacagaggcgtgaggatgatgtgaggctggggtcttaggggctccagctcccctgctaatttggagagatgggggctagaggcagccctaggaaaggatgggaaggagctgcagccccccagcactacgagtctcggtcctgggtggctggcgagccctggggcactgtgctgagggcaccgtgggcctacactcgtggccaagcggcggcccctgggtggcctacactcgtggccaagcggcggcccctgggtgctcctctctgctgccatcaccgccttctgcctggctttgtgtcctctcccatcccctgctgggctccatcctgcacaggcccttcccatgacccactccccttcaacccatgtctgctgctgaccccccagcctagcctggggtcccatccttcctgctggcccttctgcctcccgttgcctcctcagcccaccctggtttcccaggcctgcgaccggcttcggactcagcgaggctcacattcaggagtaaagctgaggacctgcactcagagctgggcattttaaaaatcatctttatgaagttgatcagaccaaaaaaaaaaaaaaaaaagacaaagaacttgcttgcatcacaaacatcctagtgtccaccatccctcttcagaaatgagatctgacaatgcactccacatcccagaggcccccgaggtgagagtggcagtcctgaatttggtgttaacattctttgcgtgggtttgtacttctaatgcctaggcttattcctccaagtgatacagatcacactctgcagtagcacaggagatatagagacctattacctttatgcatggatagatgtagctatctctccatctgtctccctgcccatgtatgtgtgcatttctctatccattcatatatgtatgtatgtatctattccggtacatatacacctgtctatccatctagccatgtatatatgtatgtgcctagccatccatccatgtacatatgtacctatctatccacctatccattcatgtatgtacctattcatccccctgtctattcatatgtgtgtgtacctatctatctacctatccatccatgtatgtatgtacctatctatccacctatccatttatgtatgtatgtacctatctatccacctatctattcatatgtgtatgtacctatccatccacctgtctattcgtgtgtgtatgtacctatccatccacctgtctattcgtgtatgtacctatccatccacctgtctattcgtgtgtgtatgtacctatccatccacctgtctattcgtgtatgtacctatccatccacctgtctattcgtgtaagattgtacctatccatccacctgtctattcgtgtatgtatgtacctatccatccacctgtctattcgtgtatgtatgtacctatccatccacctgtctattcgtgtatgtatgtatctatccatccacctgtctattcgtgtatgtatgtacctatctatccatccacctgtctattcgtgtatgcacgtacctatccatctgtcgttctctttcttctgcagctcctttcctcacctgcagtgtgtgagcctgccacgctaactgtgacatgtgtcactccagttcattcatgaatagttgcagggttgctggggcacacagagtaccaggggaatgccagtcctggctgggccacagtgtccatcctactgatggagtgtcagcggggtgggggtgggactccagttttctgcaagtctagcacggctactgaacagtctcatgcaggcgcaaggggttccagggcaggtactgagacacgggcttgccaggtcccacggcatggctgtccttggcctcctgacaccgccacagctctggccaaggctgctctgcatcaccccccaccacaggcgtgggagccgtctttctggtttctgtggtccgttctgtttccagtttgtgaattaccagttcctgttttcccccttttcaatgggttcttggccttttcttaattaagttattagattctatgaatattctggattctaatgcttagttggctctatcctctgcaaagcttttctcccagtctgtggcttaaagtcttttcactcctttattttgtcttttaatatatagaacgtttacagtggaatgtagactaatccagcaatctgctctgtgctttcagtgttttaatcaagaagttatatttcataccaaagtcataaagccttctgcattttcttctgaaagttgtaaggttttatcttgaggtctttggagtaaggtgtgacatagagattcagttctgttttctttttccacatggacatgaatcgagtcccttctccctcctacaggctgtaatgccacgtggccatctgttacgtggccacagtttcttgagtctggtcctagactcttctccgtcctgggactgctcatctgtcctgagccggcacagcctttgggtatttcagctttgcgatccatctttatgccccacgttgcccttcagaacacatctgactgttctcggctcttggctttcccatcacatgttttagaatcagcctgtaatcccaacactttgagaggccaagactggaggatcacttgaagacgagttcaagaccaccctgggcaacaaactgagacacggtctacaaaaaaagtttttttaattgttaaatgtggggccgggcgcagtggctcacgcctgtaatcccagcagtttgggaggccgaggtgggtagatcacctgaggtcaggagttcaagaccagcctggccaacacggtgaaaccccgtctctactaaacatacaaaaatgagtcgggcatgatggcgggcgcctgtagtcccagctacttgggagtctgaggcaggagaatcgcttgaacccgggaggcagaggttgcagtgagccaagattgcgccactgcactccagcctgggtgacagagtgagactccatctcaaaataaataaataaataaaataaatagttaaatgtgctgctgtggtaaagcacacttaaaaaaactgcattttacagtcatttgtgttagtgagcctgaatgctactgaattctgaatattgctcttggctcccacacccttcagagctttctctctgacactcactgggtcatggtctgccacgtgactccacctgcctctctctttccggctcccacagccttcagctttctgacattttacatggtccaggggcatccttgccatgttgaaaatagaggtgatggcaggcatgatacagcagaaatgttaatacaagaagagagaacttattagctatgcatgactctgtgctccaacacttgaacatttcattaaaatagacaatttcctaggaaaaattaaatgttcaaaacctggatctaaaaaaaaagtaacctttctattgcctctttgggtgttttttataattattttcagcatattggccccttcttaaggggaaatcatgtagagtagaaaaaaaaaaagcgcaccgggtcactgtgatgcctccccagttaccacccgagtggctccagcagacactctggagaccagagcccggccaccagagcaccacaggggaccgccacctgtcagggctttaaaaatactgcgttcctttctctgtttccttctactctactttcactctttttgaaagtgaggttggcctttttacccaaaaactctcaaagtcctcccacacactgtcgttggccactgtcatttagcaggagggagtgtgtccagcctgggaagtgagcgactgcaactctgtgtttgcctaaacacagtttcttgttgccgatgcctgctctcttctcttatttactctgtgtaccgagggaggtgggcaggcggtgtgagtaacctctctgctcccgtcgaagctgcagccccgtccttgtgtgtgttcacagacaacattggcagtaccatcatgatgactggtgccacgtcctgaacaatcggcccacggctgtcgggatgcacctgggcttgggaactggtgtcttggatgtgggacacttcccagatcacaacgagagcttccatggagagggagtccttcccagactgtcagatggccacctcagagacagtagtctttgggatgaatacttttgtcaattttgtctgcattcctgaaggaataggacatcattttgaagaacttgggagtattattttacctaaagctaggaaaacaggaaggaactgtgttgttattttagatactgttcagatacgatatgagcattgaaatgaatagggtcatcagtcgctgtggtttgattttattgtggtaaaaacacatattatacaatttaccatcttgattttttttttgagacagagtctcactctgtcactcaggctggagtgcagtggcacgatcccagctcactgcaacctctgcctcctgggttcaagtgattctcctgcctcagccttccaagcagatgagattacagacatgcgccactatgcccagctaatttcattttttcttattttttgtagagacagtgtctcactatgttgcccagcgtggtctcgaactcctgacctcaagggatccttccacctcagcctcccaaagtgctggcaaagtgctgggattacagacatgagccaccactcccaggctttcacttatttttagattggattatttgattttgttgttgttgagttttaaaagtttttgttgttgttgtgtgttgttgttttttttttcttgagacagagttttgctctgtcacccatgaaggaaataatgtatacagtggtctatttccaagacaaagtgcattgaattggcttaggtcagcaaactacagaagaaacaggatataccaggcccctgcttggatagccaatgactgcttgtcggccttccccttccctctcttcttgccacgccccgcacccccaccctccccacccttagttgccttcacctgaaccaaagaaattcagtctaagacgaaagcttactagtcttcaaaatagctcgctttgtctgttcttttcagcctgcccagctacttaggtcacaagtcaaaaacttggagaacccctgagctaactaggattgcaatgcattgtgggctgcaacaaaatgcagcaagataactgtaaaaaaaaaaaaaaaaaaacacctacaggccctacctaacaatcagaacaatcagtaggcgatgtccgggaaggttgtagccccatagtactcactttatgaggaactgggggagggacctgcacactaggggatacattgcctattgaaactgtgctggctgtgcctgcctatcaggcaagatcgtcattaaaagtctcactttggctgttctctgggtctctgagtccattctttgggtttggatgagtgagtttgtttctcacatccaggctggagtactgtggcgcgatctcaactcactgcaatctctgcctcccgggttcaagcgtttctccagcttcaggctccctggtagctgggattacaggcgcgcaccaccacgctcagctaatttttgtatttttggtagaaatgggttttcaccatgttggccaggctgttctcgaactcctgacctcaggtgatccaccctcttcggccttccaaagtgctgggattacaggcgtgagccaccgtgcccagccaagagttctttctatgttgtggctgttgatcctcgtcagatgtatgatttgccaatattttttctcattctgtcagttgccattactctgttgactgagtcctctgatgagcagaagtgttaaggtttgatgtagtccctgcggtctggcttttgttaaaaacgtgttggcagggggagggagggggtcagaaccctgcaggaggttctattacttctggtgatgcattgctgagctggggcgttctgtgatcaaatttcactggcttttcttgatttctttccagcctgaaactcaggtgtggagtttatgaaagttcttcatgcaaaagtgagtgttgtccctgagattgctaaagccgatgccctcacctgaaggaaagggagcatagcgtaggaacgctggttcctggatgtctttctttggggcctatgtcatggggggcagagtcaggttctaatgttgattctaaaagagaagaccccatttgagagagtaagcattgctggtttgctaaaagtaagaaaagtttctactcgttagagagactgtctcctgcggttgcctggccgccctttgcacagcccgcgaagggcacgtgggaatcctgctccattccaggtcccgggccagtagctccaggccgcgccagggtcggtgcagagcggcatttcccgcccccacacaccttgacaggccaggtaacaagagaggcctttctagaaagtccctggaaaaggctctttcctcccaaaccggcagattatgctttgtatgtctgttgtggcaagaaccttttcttgttttctttctcaaagtgacaaattgatggcagggcagataaatcgtattttctttccttctttctttctttctttctttctttctctctctctttctttttttttcttggtgacagggcagataaatcatattttctttctttctctttcttttttatttttctttttgagatggagtctcgctctgtcacccaggctggagtgcagtggcacgatcctggctcactgcatcctccgcctcctgggttcaagcgattctcctgcctcagcctcctgagtagctgggattacaggcatgcaccaccacgcccagctaatttttgtatttttagtagagatggggtttcaccatgttgggcaggatggtcttgaactcctgacctcaggtgatccacccacctcagcctcccaaagtgctgggattacaggcatgagccaccatgcccagcctttttttcttttcttttcttaatagacagggtctcactttcagtcactcaggctggggtgcagagtttcaatcctagctcactgcagctttgacctcctaggctcagctgatcctcctgcctcagcctcccaaagtgctgggatgacaggtgtgagccattgttcccagctaaatagtgctttttcttctctctaacattgaaatatagaaagtatgaaaaagccactcatggtcaagcggcatgtccctgcagagctgtcagccacactgcctcccagaatccaggttgggggtttccgatgctgtctgttccatgtgacctcacagcctcctgaaccaactgatggccccaaatgtttatccccattccagatggcacctggtggtacctgaaagtgacctctgggctgcgaggtgcgtggtaatgtccctgtggcccatctctagatcgtgaagagggtgatgtgaatcatagcacactccaggacatcacagggccccagcacaattgtgtatgctgtgactccgtcacccaactacttcgagtcttcaaagacattgaattgccattgttctaatacttatttgcctttggttcccactccttcctccccgtggtgggaagaaagttggggaatgtgcacccagaagatgtcggggctggatcaagccccttttcagtcactgtcattcatagttgagatgtgaactctgcaaaggcagtgagtacagaacattcttgtttccagtgcaaatccactgtgaccaggaagctgtgcctaggtctctgactccagccacccatacctcctctccctgtacccagagccctggatgaaagcatgagtctgggatgctgggaagagggcagacaatgacagctcccaggcgctgtggaccaggcaggctctgtgttgggctttcctggcagacgatgctgtagttagttaatcctctcgaggacatgtgagatgagggtatcattaccttagagatggaggatctgagcctccagcagataagcagctgccccgctgcagagaactgaaaatgaagctaagcttgttggcttttccccaccagctgcctcccacttcctccacctgctctgtctctgcagaaaacatcaagaatgcaaatccagccccttggccagctcatttgcacacacactcacctcaggggtctctgggggtgtcttggatgcagacctccatccctcacaccctcacacctgtccgtccaagggtcaggccatgctggagtgcctgggctggcctgatggagatgctgcaccagctgagtcatggcgggaaaacagccgggaatcacccaatatctattccttccttcctttccattttcttttacaacagcaaaatgatgccaagatttttctgtgcttcccctgttataggctgatttatggcctccctcccaagttcctatgttgaactcctaaccacccagtcccaaccccatatggctgtatttggatagatctttttctttctttcttttttgagacggagtcttgctctgttgaccaggctggagtgcagtggtgcaatcttagctcactgcaacctctgccacctgggttcaagagattcttgtgcctcagcctcctaagtagctgggactacaggtgcgcaccaccacgcctggctaattttttgtatttttagtagagacgggatttcaccaggctggtcttgaactcctgacctcaagtgatctacctgcctcggcctcccaaagtgttgggattacaggcctgagccactgcacctggctgagagagggtctttaaacaggtaattcattcaaaatgaggtcatgagggtgggccctactcttgtatgactggtgtcctataagaaaaggagactagggcctagcaaggtggctcccaacagtttgggaggccaaagcaggaggattgctcaagcccagatgttcgagaccagcctgagcaacatggtgagacccccatctctacaaaaaattttaaaaattagccaggcatggtgaggtgcacccgtagtcccagctacttgggagcctgggaggctgaggcaagaggatcgcttgagcactaggaatgtggggcttcggtgagccatgattgtgccactgcactccaatctgggcaacacagcaagatcctgtctctaaaactaaataaagaaagaaaaaggagaggagattaggacacaggtatgcccagagggatgaccctctgagggcatggcgagaagacggccatcgacaagcccgggagaaggtccccggaagacataaccctgcccacgccttgatcccagacttccggcccgcagaatataagacaataaaggtctgcggtgaggccaccagccagtggcactttgtgatggcagccccgggaggccaaaacagctgcctgttccccacgtccctctcccagcagaagcgcatgggctgctcttgagccccagctgcagtccatcactgtcagtgctaatgcgaagctcccctaagactgacttgacaatattggcgagtgggcttgacccaccagcctgcatccggtgccggtgaatgggcacttacgttccttattgaaacgctacttgtggccctctgcttcccggagctcctggcaacagcccaactttatgttccaaataggaaaaggctgcttgatttaaagactcggacttcattaggcgttaccttgatttatggaaaaataatactgaatggttgcataacaatggcccactgctcacctacgtgtggcctggggttaataaaaccggcacatttgtctctcccacgatgacgtcaacgtgtaccagcccttctcttccacatgggaaacgtgttatgttgttccaattgtacattcacttggtgaagggttgtgttaagtgattccaaaaattgactgtgtatattttctctagggaagttattgtatattattttagctgggaacatctctcgcacacaattactaatcagaagtgaaaatcaggatttgtccccggcccacctggcggatctgatgcagcgccagggcagcccgtgaagacgggcgctcttcctccgtgactctgggccaggcagaaggagccttggagaggctgcaggaggaagcccggcttgaggccattcctgttttgtcttgctggaattcaaagatatttgttaatcctttccccccacttgagttgagaaggcctggaatgaggtttcacaagctgtgccctgtagagctcctggggaaactggctcgaaagaatgacttctcgagagggaaactaatatttgcttattttccccccactaacttcccaagggaaggctaatctttagaaacacagaaactttggaggccaataaaattgagagcaagagaagcgagattgtttcattgttgccaccatgaaggagagtttgtttttactggatttctttttcccttcaggaaggctctggtaagagtcctgatagattattctcgcacccctggttctggctttccccccattgtttcaattgcccttttaatcaccacgatctcagtcaaggtcaaggctgctgtttcatgtacccgtgccccgcctgccctcctctgccgcggattcccatggggatgtgtgtggctgcatgaccacccttccgtgtcaccaatcacaccgagcagccctgaagccagcgtggggtgtcggcagggtggtggcactcggcatttcccagcctcttcttggatgcctggggtcctctctgcagggtttggtgaggccctgctggggtgagagcccttggcagccccaactgtgtctgatcacaggcgaagcatttatgaggcagctgggtcccataacagaaacagggaaaccagaggcagaagtgacattacgaagtggcttacggcgctgctaagtcagggttggggtagcaaagcgtcatatagggaactgaaatgcttttcagcgcacaatagcagtgaactggatgggaatcttcgggccgagagaagtccaggcagaggcgttaaaaagtttaggcaaggaaaaggagtgaagggctggacctggtggggtggggtcccattcccaggagagtcggccctgccccagcagcttccagctggagccttcaaggacctggagggggcaggaccaacccctccaccctccctgcccttcaccctcaagttcacctgcagggctgtcttcttgcttactaaggcctgggagagtttaattccaaagcagaggatgatgactggagaaacggatgcctggttgagtcacttctgggggctcagcattggaatccctctgtaacctcccagaagcagaagtggtggcgtccaaggctgcccaggcccctccagtgatgaggagcccagaccctacaacacgcctttgccccctgcacacccttcctgctgacagccccatcccatgctcctccccatctgacccgtgtgtgtgtgtgtgtgtgtgtgtgtgtgtgtgtgtgtgtgtgtgcgccccccacccccgcagacctcccgagacagctctggcagccccacctgccaggggtcaagtgcaattcctctggaagtagcatctttcacatggaaacgttcctttattttcagtagttatggtcgtcagcgagccctcttaaaggagtcaggtgtcctgcttttgttaaaatgacgttgtctcctaactcttagagaagaggaaaaatgtctctgcccagctggcatgctggggcacagaccactgaagccaaggctttggactcgggggttctggaggctggaggaagggagaaggggatgcagcgcagcgtgttgtgtgtgcatagtgctccagggactccagaggagaaaggagtccctggggaagagacatgggtctgcctcttatcctaagtgctttctggtgctccagggagaagtgtttcttgtctgagatgtggcagacatttagaatcattgctcagaactgtctcatcttaaaccttttaaccagaaagtacagaaccattgctccaggggaaatacaagcttgtgagagcttctgtttgcaacatttcattcactaatccatacataaccttgttgtgtgtctgtttctgttgaaagacactttaatatatattattgcttctttaatgtattcaccaccagcaacaccataactcttgcctgaacgcagctcatctaacacacatattttccgcatacagttcattgcagccttttttttttttgagatggagtctcgctttgttgccaagctggagtgtagtggcgggttcaagcggttctcctgcctcagcctcccgagcagctgggatgacaggtgcctgccaccacgcccggctaatttttgtatttttaggagagacagggtttcaccatgtcggccaggatggtctcaaactcttaacctcatgatccacccgcctcagcctcccaaagtgctgggattacaggcgtaagccaccacactcggccttttttttttttttttaagagatggggatcttgttctgtcactcaggttggagggcagtggcatgatcacaggtcactgcagccttgacctcctgggctcaagtgattgcccacctcagcctcccaagtagctgggaccacaggcacacgccaccacatccggctcatcacagcctgtttgtgcttaggaacactagacagccctcaaggtctttacctataaagtagagatgtcagagatgtcagaggcacttgaaccagagcaactccatcttgaataggggctaggtaaaataaggctgagacttactgggctgcattctcagacagtctttttttttttttttttttttttttttgagacggagtctcactcggtttcccaggctggggtgtaatggcgtgatcttggctcactgcaactaccaccacccaggttcaagcaattctcctaccttagcctcctgagtagctgggactacaggtgtgcatgaccacgcctggctaagttttgtatttttagtagagacggggtttcgccatgttggccaggctggtctcgaactcctggcctcaggtaatccacccaccgtggcctccgaaagtactgggattacaggtgtgagccaccactcctggcccctccggttaggcattctaagtcacaggatgagataggaggttgctgcaagatacaggtcataaagaccttgcagattaaaacaggttgcagtaaagaagcaggctaaaaagccatcaaaaccaagatggtgatgagaatgacctctggtcattctcactgctacactctcaaactgtcaacaatttgacaatttacaaatgccatggcaatgtcaggaagttactctgtatggtctaaaaaagggaggcatgaataacccaccccttgtttagcatataatcaagaagaaaccataaaaataagcaaccgaggccgggcatggtggctcacgtctgtaatcccaccactttgggaggccgaggcgggcggatcacaaggtcaggagatcaagaccatcctggccaacatggtgaaacccaactctactaaaatgcagaaaaaattagttgggtatggtggtgcgcacctgtagtcccagctactccggaggctgaggtaggggaattgcttgaacccgggaggtggaggttgcagtgagctgagatcgtgccactgcactccagcctggcaacagagcgagactccgtctcaaattaaaaaaaaacaaaaaacaaaaaaaaaagcaaccagcatccctcagggctgctctgaccatggagcagccattctttattccttcactttcttaataaacttgctttcactttactctatggactcgcccctaattctttcttcctcgagatccaagaaccctctcttgggatctgaattgggaccactttccgggaacagagacagcagggcaatggccagaggccacatgagacagtcagtagtgtatggaggcggcagcaggtgcccagaggcatccccggcccacccccagagcctggcctgacatccaggcctcgcaggcttcaggccaggaccctaccagcaaccccccacccccgagcaccccaggtgtgtatgggtgggtggggcctcccgtcagcccacccaggggcctgtcacacccctgctgcacacagcctctgcactctggactgcatgctggagcccgtgggcatcagagccacgggctgggcttggcaggatgcacctcccagcaacggtgtgctcacttctcctgtcctcccctggctctgatgacactgtgaggcagcaaaccagggtcctgaagggacctctaaagatacagtgtgtgcagggaccctgcccagggtgagagcagctggagctcttgccgtgatcatctcaggctgcccaggtgaaggtgtttccccaacagccctggccacagaggaggccaggcctcttccctgcccaccagtctcatggccctccagccttccctcccgccacctgggccagggccaagagtcttggagggaggttcttattgctaccaggtgacccctgctcctggctggcatggagcaaagtcacccttgctatcaatttaacacagatgaaagatcatgcttgttcccattcccaccacctggacatcctcctctcctggaccctacagcctgcgtggggggtgcatttgcaggaatggaccttgcctccctggagtacctcttggcttacagccccatcctccctggggtctgctatcctactgacctgagcgtgcacactgctgatctcctgacccactgtttaggaaaatcactcctttccaagcctcctgtttccttgcaaatgctctagagcaggggtccccaacccctggggtcacaggaatgggccacacagtaggaggtaaggcgcaggcaagcaaatgaagcttcatctgtaacagctgctcactgcttgaattaccccctgaactctgcctcccatcagatcagcagcggcattatattcccataggagcacaaaccctattgtgaactgtgcatgtgggggatccaggctgtgtgctcacgagaatcgaatgcctgctgatctgtcactgtctcccatcgcccccagatgggaccatctagttgcaggaaaacaagcccagggctcccactgatgctacattatggtgaattgtatagttatttcattatatattacaatgtaataacgatgtcataatgagaatataataataacagaagtaaagtgcacaataaaaatgtaatgcacttgaatcatcacaaaaccaccactccaccctcggtctgtggaaaaattgtgttccacaaaaccagtccctggtgccaaaaggctggggaccgctgctctaaggcatagcagtctttaaccttttggggcaccatggagacttgcatagcctgatgagctctgtggaccccttagaactgctgatgtgtgtcgcttacattcagagatggagaaaatgctaaaccttagtgaaaataaagatgctttttctcccatccaagctcctgagtgccctgaatgccacccatggggaccttggggaagccctaggacagggatgtaggtacagattgacagtccagagctgccatcagggagaagcatttgcaaagcacaggctctgcaaatggggtctacttcctccatcccccaagcctgtcttctgcttcactttgccaagactctgccttgccccagtgttggagcaggatgccagatggcaagatgggcttatgggctgggtcttctgtttggtcgcggcagagcccatggcagctgtaggaactttgacggggaaggggcaggggcgggagcaaacctgtagcgtgaaagtatgtgaacgctctgtcatggagggcaccccaggccgtgtccaggccagcttcaccctgtctctgggagaaggaagcctggtcagagctgaggaggctccagggcaccaggccttgtccctcttgcgcctgggcgtgatgctccccaatggcgtgcgccagtcctgggaccattgctgccggccgtgtgtcttcttccagggtgcagaatcccttgtcaagctgggtggtttgatgccagcccctgggcctcgaagctcccttcctgatggagtgctgccatttggaaggggtaactttcgtggtcatttttttaaatcatggtaaaatatacataactacataacataaaatttaccattcttccttttcttttcttttcttttcagacggagtctcgctctttcgcccaggcgggactgcagtggcgttctctcggctcactgcaagctccgcctcccgtgttcacgccattctcctgcgtcagcctcccgagcaggggactataggcgcccgccaccgcgcctggctaattttttgtatttttagtagagacggggtttcattgtgttagccaaaatggtcttgatctcctgacctattgatccgcccgcctcggcctcccaaagtgctgggattacaggcgtgagccaccgcacccggccaaaatttaccattctttctaaccattttaaagtgtacagttctgtggtattaagtacattaacactgttgtacaaccagcaccactgcccatttccagaaggtcttcatcttcctaaactgtaattctgtgcccattaaactccccatgtcttcttctcccagcccctggcaaccacgattctactttctgtctctgggaatttgacgactcttataattggagtcatgcaacttttgtgtctggttggttttactcagcagaatgtcgtttcatccatattgtggcctgtgtcagaagttccttcctgtcaaaggcggaatgatactccatggcaggtttacaccacattttgtttttccactcatccgtggagagacactgggtgggtccctccttttggctgttgagaatgatgctgctgtgaatgaagtggttagaagggggctttcagacgtgtgaaaggtgtctttgggaattttaatttcagctcccacaaatgagtaaaatttgtctttctgtgcctggcttatttcacttaacataatgatctccaattccatccatgctgttgcaaatgataggatctcactcttttttcatggcttcgtagtactccacggtgtatttgtaccacattggcttcacccattcgtctgttgatgttcgacaccttattattatcgactgtagtcaccctgctgtgtaatagatctcttttcttttttattgatatttcagaattgtgcatattttggggcacatatgatattttgatacatgtatataatctataatgttctaatcagggtcgttgggttattcatctcctcaaacatttgttttttctttgtgttgggaacattccaattctagttattttgaaatatacagtccgggcgtggtggctcatgcctgtaatcccagcactttgggagactgagacaggtggatcacctgagatcaggagttcgagaccagcttagccaacatggtgaaaccccgtctctactaaaaaatacaaaaaattagctgggcgcagtggcaggcacctgtaatcccagctactcaggaggctaaggcaggagaatctcttgaacctgggagacggaggttgcagtgagctgagattgtgccactgcactccagcctgggcaacagagtgagactccgtctcaaaacaaaacaaaacaaccccagaaatacacaattcattatcgttaactataactttcctactctactttcaaatactagaacttattccttctacctatattttttaatccctggtgatctcttttcttatgggagcagtgtgcgccctgatggtgtaaggtggaaacccgccccttgttggaaccaggattgaatatcaccgcacaggagctgaaggttcccacccggcaacgtccccccttggctgtgaagcagagagcccagggctgctcgtttccagtagtcctcctggcagagcaccgctgaggagggtggtgaggggaggagaagatgcattctgcagggagaagcatcatagtgggggccggggactctcctgcgtctcctaattgcccgactgtcatgtgaccgatcagtgcactccgagcattacacagagcagtcatccaaagagaggcagcgcctcacagcccttggctggagaggagaatggaggctggaggctccagaaatttgggatgggaggagaaaaggaaacagaggtgccccttcccctgtcttattgcagggaatcagtaaaacgactactggagttcactggcttctctgaatctttgtagaatttctcctgcacctctgatcccatccagctgcagacacagtgcctgttcagcagggtgtgtgtgcagaccacggactcacagacggggaccctggggaccccaggttctctcccctcactgaggacaagagaggggcccccaccccatgttaatgatgcggggcctgcagggaccttaagttgcattagcatggcatggaacaagagagaaaattcagaacctccagcttgtgatatgcaacaaccaaaaatgtggctgagtgtggccgccttgcaaaggcctgggccctctttaatgggtgcttgctgccctctagtggagagatgaggacggggggtgggcgagcttgctcaaggacactcactggggaagggcggtttgcagacaggtgtcgtgttttggtatatatgtgtgtatgtgtgttatgtgttaggtgctgcgagcatatgaaatgaattacaacgttgttatgggctgtactgtgttcccccaaattcacttgttgaagtcctaagccctgctcccttagaatgtggctgtatttggagacagggtctgtaaagacctgaatgaattaaaatgaggtcattagtgtgggccctgatcccgtatgacgggtcttcttcttcttcttctttttttctataacatctaaagtgagatttatttgtgttaagctttcagaacatttcagaacatttgctgcgactcaggtaaaaataggtaagtattcacagaatatgttaagtctagagttcagaaagttatttcaactaaaataggtcaatcctcacatctgaaatcacttagacattactgatgtatttggaagtgtttctgtatagatattttaggctgacggtgctcagtgctttagggggtcaggtaaacccagttctcgtttgttcagcggtgcctcatttccactacataaagcttgttctccagttccaccaccaatgcctactttacgtgatgttgcactgtgttggtgccatgtaaggtgattatattatgaaaggcctctagaccaccttgttcaaatgtaacagctggtttcagtaattccaggagcaagggaactgtctccaacaattctcaggttgataaatttgattttccaagtattctccacaaaagggcagcaggtgagcccaaaactttgttcaaaaatgcccaagcaagtgttccctcgatgtcccagcagttcccagcagttccaaccatcaccagcccatgaagagaagaagtacatttctacattgggctgagaaaaagaaattcttcttttactagtgacggcaaacggagactcatgatttctgtcccatggtagtccatcccttttttttttttttttttgacggagtctcgctctgttgcccaggctggagtgcagtggcatgatctcggctcactgcaagctccacctcccgggttcacgccattctcctgccttagccttcccagtaggggactataggtgcccaccaccacgcccggctaattgtttgtatttttagtagagacggtgtttcattgcgttagccaagatggtgttgatctcctgacctcgtgatccgcccgcctcggcctcccaaagtgctgggattacaggcgtgagtcaccgcgcctgacctcttttttttttttttttgagacagagtcttgcttggttgtccaggctggagtgcagtggcgtgatctcggggcactgcagcctctgcctcccaggttcaagtgattccctgactcagccttccgagtagttgggaccacaggcatgtgccaccacacctggctaatttttgtatttttagcagagatggggtttcaccatgttggccaggctggtctcaaactcctgacctcaagtgatccacccacctcagcctcccaaagtgctggtgtgagccaccacacccagccagtctatcacgttttgttctgacttgttgtaatagaatctaagctgagtctatcacgttttgttctgacttgttgtaatagaatctaagctggacatcatgctgtggttcccattcatcttgaggtggtcccaggaaagaattgtgagaattaagaagtccaaagacccggtgacagaattctcccaggcaatgaaaatcaaccttttcagctttttaatcttttgcctgctgtcgaaagagctggatgtcctctgtctttgtaactggctctggtgtttccttcaattttggctgtgattgcttttatacgctaaataagactgtgttttttagtaactggaggtataacaaccaccccctggtgttgccaagtacttaaatgtgaccagaaaggtggacgtttttacgcctcagaagttctgcccttggactgtccactaacattacatgaaaggtgctccaaatcctcaaatcagcaagtgctgcccatgacatggataatcccggaagctgcgccattgtcactgccaccacctcctggcgggcccagctgcctaagcctgtgtagtggttccgaaacgggaaaggttcctttgtccgccttgcagggtgtgggatgggggtgtggctcgtttcttctgtgtcctgcttctcccaccgctagagggggcatacagatgggcaggttgtggggctcaggccccacagcagggtctagagatgaatgtttacagctgaagccccagttggcgtatgctactgtttgttcttttagttttgctgtctataggcggcttgtgttaaccagctcaattagaccctctacttgtcgcgtggacagagggctttctgtatcccgggttcttgccttggtgtaccggaagagtcggatcacacatgagcttggataatgggtgcaaggttttattgagtggaagtagctctcagcagatgggggaaccagaagacagatggttttcccctggagtggggcagctgggtggcccagacactcttccgactcccggccaaactccacgtcattccgcgatcagtggcatgcctgtgcctgtgggcgcattcctctcgccagccggccacttgtggattcctccgccagtgtgctcctctccacgtccagccgctcctgtctctgccttgctagggtctgggtttttataggcgcccgatggggcgtggcagcaagagcggtcttggaaaatgtaaggcaggaaatgcctgtcctcacttaggtccgtgggggtggagccttagtaagaaacggtctttgctttgggaggccaaagtgggaggatcacttgagcccaggagtttgagactagcctggacaacacaataagatcctgtttctaccaaaaaaattaaccaggtgtggtgttgtgtacctgtagtcacagctactgagaaggctgaggtagcagggtcagaaaacgccctcctatacccgcacttcccttggcacttcccttacccccttccgtatcatttaaagggaccatgcttctcccttctcagcatttccgtatcagtttcagagcagtggatctgccatggtggcagggattccccaggattctgcctaagcggggtctgagactaactgggttctaggccccgaaccccctccactcccaggctccagtgacctggggtcagcatgaggcttgggaaggagtggctgtgttccatggcacaggtctgcccttacattggtggtctttgggctgcaccaggcaattggtgacggtgctgcacagggccatgaatctcctcattgtccagtagcccaagtaggttacgacagccctccgtctctggagagctgagtcctgacatctcgacccccgggacagagggagaggacgatggcaataatgttgcccctgtggcccaccaggcccgcaccttggcaacacacaccagaagtcatggcaagtgttcttataagaagaagagattaggcctataatcccagtgctttgggaggccaaaatgggaggatcgcttgagcccaggagtttgagactagcctgaacagcagagtgagatcccatttctaccaaaaaaaagttagccaggtgtggtcttgtatatctgtagtcacagctactcagaaggctgaggtagcagggtcacttgagcccaggaattcaagaccagcctgggcaatatagcaagaccctgtctctacaaaaaattcaaaaattagcctgggactatgcctgtagtcccagctacttgggaggcagaggtgggaggatcatttgagccctgcagtgagctacgatcatgcgactgtgctgcagcctggatgacagagcaaaaccctgtctcaaagaaggagaagaagagattaggacccagacaggcacagaggaaaaggaaagaccccgtgagaacgcagggagagaacggccattgacaagccagggagagaggcctgagaaggaccaacccttccagcctccaggactgcaaggagtaggtgtctgttgtttaaggcgcccagcctgtggtacttcatcatggcagccccagcagactaacacacacggattctgtccttcaggagccagtatttgtagataaatcatgactgaatggcagtggtgagcaaaacttaatggcccttgccagcttccaaacgcccagcgctttctgcgtgcaccctcaggcagtggcatcgggcacacaaccattcctagctcaggaaaccaaggggaagaggttccgctgcaggcccgggagcccagccgatcccaaagactaaagacctaagccccgggcttcccagaggaggggcacagccttttgaaagcaagaggaacttctgacaaggtgagcagggtgaggaagttattgattttgattttgatttcccctgaattctctataaaaatagagggggcaaccagaacccaggtagtgaaaccaaagcccatgttggaatttacaacctagtgaggggaggccgcggcctcggggcgaatccatgaggggttggcatgtgtggtggggggagtgctgggggagactgggggacatggcagcgggatggggaggggaagataacaccaagcagaggagaacgaggacgcaaggagaaggagacggcggactgcagaacgagcagaggagcgcaacagatgctggcaggccgcagagaaggggcaccctcctttaagtttaaggacgcaaatttcaaggtcaaatcctatgcaaaggattataagtgtattacaagaaaaaagaaaataggacgaataatgtaaaatggatgaaaactatgccctaatcatcatgtccaaacaaactttaaacaagaaactgatacaagatacgtgacaacatacatacatttctctgaacttaaaacttttaaaaaattgaaaatgaatggcaagaaattaggaaagggttgtaatgaatatttaaatatcatttcagagatgaatattaaacaagaaagacaggagcaaatagacaagggcctaagagaaatagaagttgaaaagaaagaaaatctttgagcataaagaaaagagaaacacgtaaaatctcactacagaccagcgctaacagaagaacatttcaacttgatgacagggaacactagttttgaatcttgattaagcaaaaagtttctcctgtgcacacaagaggaattccaaggataacaagtgttgatgaggtagtgggaaattagaacccttgtgcactgttcatgggaatgcaaaatggtacagtatggggattcctcaaaaaattaaaaatagggccaggcaaggtggctcacacctgtaatcctaccactttgggaggctgaggcgggaggatcacttgaggccaggagttcaagaccagcctgggtaatatagtgagaccctgtctctacaaaagaaaaaaaaaaaattagccagacaaggtgatatgcacctgtggtcctggctactcaggaggctgaggcaacaggatcacttgagccaaggggttcaattttgcagtgagccatgattgtaccactgcactccagcctgggtgacagcaagaccctgtttcaaaaaaataaataaactagaatgaccacgtgatccagcagttttatttgtcagtatgccggaaaggtttgaaaagcaaggtctccaggaggtacctgcacacccatgttcacagcagcatcattcacaacagccaacctaacctgggttgcttggggaggagcaacctaagtgtcagtcaacagaagaacagatgaacgaagtgtggtttatacatacactggaaaatttagcctcaaaaaggaaaggaattctgatacatgccctaatattgatgaaccttgaggtcattatgctcagtgaaataagccaatcacacaaaagacaaataccgtatgattccatttatatgaggtgccatgtgtggtcaaacccatagagacagaaagcagaacggtggttgccaggggctggggaggtggggatggagcattggcatctaatgggacagtctcggttttacacaatgacaaagctctggaggtgggtgtggtgagagccgaatgtgaatgcacttattgcccctgaactgcatgcttagaaatggtcagagtggtgaatgttatgcgtattctaccacaatttaaataacttaattaaaaacaattccattcttctcattagtagacctatcttatgaaaaactgtactcttattatatttgaatttcatcaataaaaattgtgtggaaatgtgtttgtctcttgtgatgtaagtacctacatggtatctccagttttggctcttctcctgcaaggtctgaaacatattctctctggccccgcacagaaaacagttccggacccttcctctagaacagggttcggcatgcggcagatgcccaggaaagagtgaaggaccaagcttcctcccttcttcaccggatccctctggcagcttcgggtccagtgaaagagaacccaggccagtcccttctccgtgagcctcgccccacaaacaccggcctcccttgcctcatctctcgcatcttaaatctctttcacctacgaaccgactcaagcatcagccttagaaggatgccctgggccccgttcctctgtccatgcacatccaggctctaccccgggagttcaaggccaccttcagttcctatatcctgtccctgctctctgtgacctctgaccccacagccccaggtctctaagcgtcctcccacctgagccgctgctcaggccagccccgagcagccctctgtgggtcctgattcccaaagagcatgatcccaggtctttctgggtccctcccaccttgccctacttcatgcttccgtgcctagccacacccctgcacaacctgtgatctggcctcaggaaatctgtttctcatgtctgctgtataggcttggctgcccatggcagcaggaagaacctcgcctcccttgctcacacagcaaaggcgtttaggcctcatattggggaagcccagggtgggaggcccctgactctttggacccatgacgacatcaagagtatcttcgtatctgtgctctgccatcctcagctggctttcctcagctgccatttcagtcttcacaccagatgtgatggtgtcccaggaagaagaggccatctcttcccatggctctcttcgtcaatagagagtacattctagaagccccgtggtaggcttccctatggcttgcacaggactgaatcacagaactgtgtcctcagcagtcactggcaggggacaggggtcacccgaactgggtggaggcccgaacctgacacccctgagctgtgctaagcagagggctcctgaacagaattgagattgaggccacagggccaggctgactccctcctgccccacgtgctctccggtgagaccctgcttggtctgcaaagccgagctcgatgccctccctacctcttctctcctaggcctcatccacggccttgtcttgggccagacagccatgtgccatgtctgtcctcccatgcagcatctgcaccgtgggggtggggggggagattctctgccacgttcagcacctcaaaggcagggggtgcatttcactcagctctgcatcctgtgcaccctcagccatgccggcagagcatgtgtggggaagggcccgagggaccccagggaaggaagagcactgtgtctgcatccagaagaaagttctgaaaaaaatgggaacctctgtgactacaatgaacttgtaacaaaagcaatgactttgctcttccaggaggcacaaaaggagccccaggcagtgcgcaggacccccaggcagtggtcaggagccctgggcagtgaggaggagccccaggcagtggtcaggagcccagggcagtgaggaggagccccaggcagtggtcagggggcctgggaagcagccaagagccctgggcagtggacaggaagcccaggcagtggccaggggccccaggcagtgagtaggagccatgggcagtggccaggagctgcagcgtgccagtgttcgctctggcactcagtcagggacatctggaccagcatcctgcatgggctgggtctcaggctccttgctccatgaattagcagaatctcaggcacctgctcttgaatatgggaaggtgacatagcacttctagtaggtcttttcctaacctcttccctttgcagttattctttttcaacctaagcatgccaggtgatgaccttgtgattctcctaacatacaaatggcaggcatggaatagttcctacccagggtgctgtgctggccaaggcttttccagcttggagcagacctcatgctcagccaggagactgcccacggccttggtgagttccagagtctcctctccctgcaggggtgtcttcaggagcccacaacccagcaagtccctcttcagtgaaatgtgcgggaggaggcactgcaaggccccaggcctccaggaagccggaaggtgctgatggggtgcaaggcagggcagggctgggggagggggggcgcaaggttcacagaggcagtgagtggagttctgttaacagggaaatgaattaaaatatgtggtgcgtggactttgggtctcgaggcccagaaagctgaggcaaggtggcctgagtcaaatggacagggattgtctgcccaggagctggttcagccgacatcagagatcatctgtctgcacaatggcctgctagtaaagattttcaagttgttcacacgtgttacccttgagggtttagaaacattccctgggcactcccagggtgctcagacagatgctgtggactggtggccagtgagcactaatcatgacttttatttttctttttgagacaagggtctcactttgtcacacaggctggagtgcagtggcacgatcacagctcactgcagcctcaaactcccgggctcaagtaattctcctgacttagcctccagagtagctgggactacaggtgcataccaccacgcccaactaattttctatttttagtagagatgaggtctcactttgttgcccaggctggtctcgaactcctgacctcaagtaatcctcccatctcggccttgaaaagtgcttgaattataggcatgagccactgcacctggcataatcatgctgtttatatgttatgatgttttgatatcttgggaggccaggctggctgggaagagactgtccctcccagagacagctaaatcctacagatgataaacaacttgcctgggagcctgtttattcacatgcagaccaacccatcccaagtccatactcccaaccaccccctctatctaactcttacaaccaagccattatttcctgggccctgaatcccacagggccaggcagcaggcactagggatggccctataccctggccagccagccttattcagaccagctggtcctgagctgttcacctgccccaccttgaaaggctctggtctcagctttccctgtctcctctctgcttcctgacccaacctgggtcacccactgtggccttgtgggtggggtgagtgtgcccctcctctccagaaatacgaataatgaagtctttcagtggcgctggccactctctgtgggtgctgacacctctgtaagttaaactcccataggcacgatggagacgccttgtgactcagctcctcagtgccaacacgggctgccccgtcggccacagcgcggccaaagagcccagagagcgttagtatctgtagccaggcccctgttgccaccccagctctcccgtaacctcacatgcatggcgctgctctacttcacctcagaaaaaggacacacatttacgttccattttttacttcaaataattgtttagattgtggtaaaatacatataacacaacattggccatttgaaccaattgggtggcactaagcacatccacagattgtgccaccatctccaccatccgtctccaggacttttcaaccgtctccaccatctggctccaggactcttcagcttcccaccacaaactatccccatgaagcactcattccccatccccattctcctccccttgcccctggcgcctaccattctatttctgtctccgtggatttgactcctctagggtacctcatgtaagtggaaccatgcagtatttgtatttgtctttctgtgactggtttatttcactgagcataatgacctcagagttcatccctgttgtaacatgtgtcacaattccttctttcttttttttttttttttttttttttttggcaaggtctcactctgtcactcaagctggagtgcaatggtaggatcatggctcactgcagcttcaaactcctgggctcaagagctcctcctgcctcagtcttcccagtagctgggactataggcatgcaccaccatgcgtggctagcattttatttttgttgagagagggtctcgctaggttgcaattctcccatcttagcctccaaagtgctgggataacaggtgtgagccactgcacccgacccagaatttcctccttttgacggctgagtgatgttccattgtccgcacacacacattttgtttatcctttcatccattgatggacacttgtgttgcctccacctactcgtagcaccctggctgttatgagtagtgagtgcactatctcttgtgtgcagttgtctcatggagaccttgctttcctgcctgtggcgttagtgcaggtggcaggcaggtcggtgggcaagcaggtgtgccctgtggatgacgagaagctttttctgcttaaagccctgcatggatcaaaagttggaaaatatatttgatttttacaatttgttcaaaattaatcaagcaaacactgattttcatgtattttctgagatctctgctataaaacagaaaaccaccaccctctttccagggaagcatcttcttcctggctccctccttcccttcgggccatggcggcatcctcggatcctccctagcccattcatatcacacggcttttcctcctctgcatctcgataccactggctcctttgggaggttcctctgagccacccatgcgcggggtgggttgtcatgaaaagtcaccagttccacctccagccagaagtcccacaaaagcgaagggcactgaagacaaaaccacccttcccttctctaaaggaggaggggcggtgcttcagagggtgtcccccaaacccgttctttagagcagggtccccaacccctgggctgcggagtggtacaggtctgtggcctgttaggaacgggcctcagagcaggaggtgtgcggtgggcgagtttaccgccgagctccgccccctgtcggatcagctgggcattccatgctcatgggaggcaaactctatcgtgaactgcgcatgtgagggatccaggtggtgcgctccttccgggaatctaatgtctgatgatcagaggtggaacaatttcaccccgaaactatcccccacccaaccccatcggtggaaaaattgtcttccacgaaaccggtccctggtgccaagaaggttggggactgctactttagagcatgtcctcggagtggaggtacctgctctccacgcagtacagcatctggctgtgtggtggctgcagtccagtgggtctgagaggggtggagggggaaggtggagaaggagaggagggaggaggggagggagggaaaggtgagaggggaagacgaagggaaggagaagaggtgggggagggggcaggggggcagcattggccaggtaagggcgtgtccactgtgaggcaccgtgggattcctgggcgaggactgtgagacactggtgagcgtgtgtgcagggctctttcgggcttcctctgtttttaatgacatcagagtgcgtgccatgcatggggctgtcctggtgttggcactgaccgcttggagcccagctgctgccccctttctcaggccacagatgcgcccaagagcagggtttgtccaggcccgcctgggcccgctccacgccatcctgcagtgcccacgcagcagcggtgccaggtcttccttcagcacccatgcgtggttacctgtggccgatgtggcaggcgtgtagggtgtgactgcagaactgcatggaccaagcaccgtctgcctcctaagggagcaatgggaccgaggaagtgggccccatgttggccttgaccagctgtgcccacctccttttgggaacagatgtgccaagaacaaccaggctaaggaaacgtggctcgcacaccgggagccctggggaaagactacaacgatccttttaataatactttttactgactgtagtcatagtgtaataatttcagaaaattcagaaaccatagaaaagtatacagaagaaaattaaaattacctggtgcccccaccaagccacagtgatcattgttcaagcattaacaaattttcctggattttggtaaacagatataagtgcatattttaagtggaaatattctatatttagttttgatccttgttttcatccctttaaaaggatttttcatattattcaatcatctcctaaaatacagttaccagtaactgccttcattccattagatgctgaaatggatttaactgttctctggtggttagtcatatattcttgtttctttcttctttcctggtatacataatattgggaacatcttggaacaagatggctgtactcaattattgaaattcctaaacgataaatgactggaggagaatcctggatcaaggaggggctcctggaagtgctctgggccctgctggaggcacaggccttggccacaggccaccacacataccctttggaaagagactttgccattgtgatcggccaaaaatgaaacctcactttattttattgtgagacagtgtctcattatgtcacccaggctggactgcaggctcactgcagcctcgacctcctgggctcaagagatcctcccacctcagcctccctagtagctgggaccacaggtgggcgccaccatgccaggctaattttgtattttttgtagagatggcatttagccatgttggccaggctggtctcaaactcctaggctcaagggattcgctcatcttggcctcccaaagtgctgggattacaggtgtgagccaccacgcccagcctttttcacttaattttgaagcttggagataagttttatataggcccatatacggctgcctgaaacctcactttaaaactaggtatatttgtttgctgcctgctgaggctgagtgctcattgcctgttgcttggctatttgtaattgtcttttgtgaattgctttttcttatcatttgcccatttttgtactggaatgtttacctcttcctggctgatgtgcaaaagctcttcaattcccttgtcatatgccttccagcatgttatcatggcctttgcacgtctatgggtttccatggccagacctctggcttcttatcttcacggcatcacctttgctcctatgcttagacgatgcttgcacatttgagggaaagggagcattttcctgtttttcccctgtatttggtttattacatttggctcttaaatccggtggttcccagttaggggtatgcatcagatttcccaggagggcttttctaaccataagtgcctgcctcagtccatccagatcttcccatcagcccccagggtggggcgggtgatggcgggtgggggtacagccttgttttggaaaaagtgccatagatggtgcagatgcaagcctctgattatgggcttcttccttctgccacatgtgtgatgtaagataaggatgctatttttattggcttatattttaagaatagctgattgcacaagtatatttattgtgcaaacgtgccttctttccccactcagtgacattatatctaaaccaaattctcaattataacacgggaacgtttccctttagcctgcgaagatccagtgtctcggttatggtgtttctggttccccggccacttggaagacacctggagctctgtgatcttggtggggacctcaatgtcagccgggacctcaatgtcagcagaccctgtgtccccagtgtggctgggctttgctagacctgtggagcaatagctagtcaggcttgtggccccaatccagccagcatcacacactgtccagcctccctctgacatcagcataggtctaatgtcagcataggccctctgccgcagggctgtgcccaaggacactctcctgctctgggtcctaagggagggaggatctcaggagaggcctctcctcatccctggcagatctctcaaaatggcctgcagccgggattccagacacctgagctggtgtgagcccactccccaccgctggctctcaggctggagtggggccaggatgtcactgagctcctcagagtttgcagaccatttgcccctcagctggacccctggcccaccagggacttgagcaaagctgttccatcaacgcaggggaggtgagaccacatctaatcaggggtctgatgtacacacagcaccatcaccatctcagaaaggttcatcacccaagcacaaagaagctggacttggacatctgacagcaaagcatgacccattttatgtgaggcaacgagtctgaaagcaggtaaccgggacacccaaaagctgaaagcacagaggggttggcgaggagtgcctggacctctccctccccaggggtgtcttcctgtcagagttatgcatgctcttgccagagagggcaagcttgacagccaactgccgcttgatcagcctgcccctcctgcctcacctcctgtgcctcagcacgtggccatgtccccatgcccccccaaatctcgcaccctctccaccgcacagagctctgtcttaggtccccaagggccacatgggcagcctgagtccttcccttacttcgcaggtttttccacagcactggtgttgattgctccctcccttagggagctctctcctgactctaagctctcctctcgagctcctgcctctcgctccctggctgggcacctccctttcctctctgagatgatgccctccagggctctttctctgcagctttcctcactcaaagtgttttcattctttcccagggccttgcctctctttttatatgggggccccagaacttgtttggagccacagacctgttgtccccgctgctctaggggcctctgcaattgggcacacatagatctttcccagtttactcccaccccagtgagcggtcccacagcctcctgctgccttcacaggcatctgggggcacacacattcatgtggtctgacggcatctcaccttgcacttcttcctgctcgcctgttggaggtgccacagaggcccctccatgccacgacctgtggctgagtaggtttccacacttacttttttttttttttacagttttattcaggtattatttacttaactccaaatacacccattgtattgagtttcagtaaatttatagagtcgtgccactatcccctcagtccagttttagaacatttctatcacccaaaaaacattttcttgtgcctgtttgcaatccccactctctgccccacccctggctcaaagcagaccccgatctgctttctacctgtagatctgccccttcaggatcttgaacatttacttttcgccagttcactgcaagaggttgagtctcagcaagagtaaggaatggctccggagaggtgacaccagctaaatggtggactaaggacctttggaaattctctcctccagaaacttgacgacaatgctggcaaaaaatcatcataatcagctgtttcaaaactctggaaattaaccaaaggcccacagaaatttagggaatgcttattcaagaaaaacagctgactttcaataagaacaatggacttcgtggtgttttgtgggtttttttttgagacaggttattgctctgtcccccaggctggagtacagcggtgccataatagctcgccgtaacctggaactcctgggatcaagggatcctcccaccttaacctcccaaaatgctgggactgcaggtgtgaaccaccacgacttgctaatttttaaatttattatagagatggggtctcactatgttgcccagactggtctagatctcctgacctccagcaatcctcctgcttcagcctcccaaaatgttgggattacaggtatgagccacggtgcctgttctgtgtgatgttttagcctgcactgttctcatcattctcccctcagctccacaatggtcttggagactaacagcccaccactatggtgaaaatgaacatatggcagctgctgaaaggtgtagagagggttggagccccatttccacagaattgtcattatttgaccgctctggtggttccataaagaccccacccacaagactttctttatttgatcggacttgggggatgcccagtataaagagctgtttccctaggagcatttgttgaaaacaaccagaggtgattgttgtatatcatggttgcctgaggtggtgtataacagttggagcaaataacaagctaacccagatatttaaaaggaaaagctgggaaacaagatgtctataggggctttgacaagctctgacacattcttgggcatctagaaggccatgtgcagggatgagtgtatactcaggagaacctcacctctcacctctggctaaccttgaagctctgcagaagtgggaagtaaaaagtaaggtggagttgccaactgcttggctgagggtcaaaagtgtgcccctacccatacacagagcccctcggcaaaggctaagagacatactggttccaggtatctaaaaatatttgtgtccagtcatttagctgcccattaagctaactgaatagagacttcagtagccacacacaaaaacaaatacaaattttacataattagcccaggaaagtcactgaacaaacaaacagcaacaaaccctggggaggagggggtgcaggaatctgatttccagagttgccatgttatattattttaaaatatcagtttttaacaacaaaaattatgagacactgtccatgagaaagcccagattgttggattcaccgtacaaacaccttaaatgaactgcttttaaatatgttcaagaactaaaaggaactatgtctaaagaactaacaaaaaatatgagaatgatgtcttaccaaatagagaatattaataaagagaataatttttttttttttgagatggagtctcactctgttgcccaggctggagtgcagtggtgtgatcttggctcacttctgcttcccgggttttcaagcgattctcctgcctcagcctcctgagtagctgggattacaggcatgtgccaccatgtccagctaatttttgtatttttagtagaggtggggtttcaccatgttggccagactggtctcaaactcctggcctcaagtgatctgcccacctcagtctcccaaagtgctggggttataggtgtgagccaccatgcccagccataaattatttaaaaaacaaaaagacattctggagtgaaatgtatgataactaaaataaaaaattcaccagagaggctcaacagcagatttatggccaggcgtggtggctcatgcctgtaatccaaacactttgggaggccaaggtggatggatcacctgaggtcaggagtttgagaccagcttggctaacatggtgaaaccctgtttctactaaaaatacaaaaaaattagccaggcatggtggtgcatgcctgtaatcccagctacatgggaggctgaagcaggagaatcacttgaacccgagagttcaagagggcagtgagccgtgatcacgccattgcactccagcttgggcaacaaaagcaaaactctgtctcaaacaaacaatcaaaacagcagatttatgtgggtagaaaaaagaatcattacacttaaagaggtcagttggggttatctaaggaatagaaagaaaataattgagtctgaaaaacagaaagaacaggatgaagaaaaatgaacagagttccagagacctgtggtacaacaaccaagcataccaataaatgcataataggagtgccagaaggaaaggagaggagaaagggataaaacaatatctgaagaaataatggctgaaatttttgataaaaaacatatatgtatagttcaagaagctcaagaaactccaagtggagtaaactgaaagacatctacacctagatgcatcataatcaaactgtcaaaaaccaaagacaaagcgagcatctcagagcagcaggacagaagccacttgtcacacacaatagagcctcaataagattgacagctgatttctcaccagaaactatggaggccagaaggaagtgacatattcaaagtgctaaaggaaaacaacaaaacaaaacaaagcaaagcaaaacaaaacaaaacactgttaaccatcaatctatatcagccaaaactatcctgcaaaaatgaaggagaaattaggacattcccagataaacaaaaacagagtttctcattagcagagcagccctacaacaaatggtatcggccgggtgtctttcaccctgaaataaaaggacattaggtaatatttcaactccaaataaagaaataaagaactccaagaaggataaccacataggtaaatatcaaaaacagtataaatgtatttttatttgtaactatttttttctatctaatttaaatgacaactgcataagcaatcattataagtttaggttgatgggcacacactgtagaaagatgtaatttgtgctactgtggcatgagtggaggacacagctatacacgcacacacacattcatatatatataagaaatttctatttctcagtcatttgaagataattaaatggtacacatttaacacaaaagaagaagtggagaaatgaacaaaacagacataaggcatgtacaaaacacataacaaaatggcagataatcctattcaagagtaattacattaagtgtaaatgtttaaagagcccaattaaaaggcagaaattggcagaatgaatataaaaacaagatccagttatatgttctcccaagaaatataccttagatttaaagacacaagtatgttgaaagtaaaagaatggaaaatgatataccatgcaaacagtacccaaaaaggagctggagtggctatactaatattagacaaaataggttttagcacaaaaaatgttactagaaacaaagtgggaagttttgtaataataaagggtatattcatcaagaagatataacaatgataaacatatatgcacttagcaacaaagtcccaggatacatgaagcaaaaaatgacagattaaagagagaaataaagaattcaacaataatagtcatagagttcaagaggtcattctcagaagttcaacaagaaaatagaagagttggccaggtgtggtggctcacacctgtaatcccagcactttgggaggctgaggcgggtggatcacgaggtcaggagattgagaccatcctggctaacacggtgaagccccatctctactaaaaatacgaaagaaaatcagccaggcgtggtggcaggcgcctgtagtcccagctactcaggaggctgaggcaggagaatggcgtgaacccaggaggcggagcttgcagtgagctgagactgtgccactgcacttcagcctgggcaacagagtgagactccatctcaaaaaaaaaccaacaaaaaacaaacaacaacaacaacaacaaaagaaaatagaagagttgaacaatattataagccaactataactaacagacatctgtagaacactccacccactagcagaatatacattcttttcaattgcacatgaaacatcttcaggatagaccatatattaggccataaaatgagtctcaataaatttaaaaggactgaaatcatacaaattgtcttctcaaatcacaatggaataaaattagaaatcaatagcggaaggaaatttgggaaattcacaaatatgtggaaattcaacaacacagtaaccaatgggtaaaacaagaaatcgtaagggaaattaggaaatactttgagattaaagaagaataagacacagcctaccaaaacttatgggatgcactaaaatagtgcttagagagaaatttaaagctataagcacctatattagtaaacaaggaaaattcaatttaataatataaactttcaccttcagaaactagaaaaggaagagcaaaccaaaaataatgcaagtggaaggaagtaaaaaatacagattacagtggaaataaattttaaaagagaaaagaaaataataatcaataaaaccaaaagttgacttttcaaaaaagatcaacaaagttgacagccttttgctatactgactaagaaaaaaagtcagactcaaattactaaaattaggaatgaaaaagaaaacatcaccaccaacattacagaaaaatgattataagggaatactatgaacaaatgtatgctgtggcaggtggcataatgttcccctaagatgtctatgtcctaatccctggaacctatgaagatgttaccttaaatggcagatgggattttgaagatatgattaagttaaggatcttgatatgggagtcttaacttggattatctggatgagctcaagataaccacaaggattcttacagacgaaagagggaagcaagagggttagagtcaaagatttgaagatgctatgctgctggctttcaagatagagaaaagggtcacaagccaaggaatataggtgacttttagaagccagaaaaggcaaagggacagagtctatcctggagcctccaaaaggaatgcagccttgctaacaccttgaatttagctccttgaaatccattttggatatctgacctcaagaactacatgatattaaatttgtttggttctaagccactaagtgtgtggaaatttatcagtgcaatagaaaactaatacacatgccaacaagttagataaactaaataaaacagacaaatttctagaaagttagaaacttctgaaactgactcaagaagaaatagaagatctgaatagaactacaagtaaagagattgaattagtaaaaaacaaaacaaaacaaacaaaacttcccataagcaaagcctagggtgagatggtgtcactagtgaattctaccaaatgcttaaacagtatttaacaccaatactttacagactcttccaaacagtaaaaaagaagagaacatttcccaactcattccatgaatacccacaaaacaatgccagacaaaagcacacacaaaagaaagctataagccaatatcttttaagaatttaaatacaaaaatcttcaacaaaatactagcaaacaaaacccagcaacatatacaaaggattctgtactatgagtcagtagcatttatgtcaggagtgcaaagttggtccaacaatcaatcaatcaagtcaatcacattaataaaaagatgggcaaaaaaacacatgagcatattaataaatgcagaaagcatctaacaaaaatccatcaatctttcatgataaacactcaacaaactaggactgtaagggaatttctcaacctgataaaaggcatccataaaaacccccacagctaacatcataatggtggaagactgaaagctttccccctatgatcaagaacaagacaaagatgttcactcttactacctctattcggcattgtaatagaggttctaaacagggcaattagataagaaaaaccacccagattataaagaagcaaaactatttctatttgaaaatgatgtgattttgtataaagaaaatgctaagaaatccaaaacaaaagaaaacaattactaataaactagttcagcaaggttgcaggatacaagatcaatatacagaaatccattgtatttctatacagtagcaataagcaatgtaaaaataaaagtaagaagataattcgattataatagcatgaaaaaaataaaatacttgggataaatttaacccaaaaagtgagagacttgtacaaaacattgttgaaagaaattaaggaagacccaagtaaatgggaagacatcctgtgtttgtggattagaagatgtacagttggccaggcatggtggctcctgactgcaatcccagcattctgggaggccaaggtgggcggatcacttcaggtgatcctgaagtggtcaggtcaggagttcaagacctgcctgaccaacgtggcaaaaccccatctcgactaaaaatacaaaaattagccaggcatgttggtgggcgcctgtagtcccagctgcatggcagactaaggcagaaaatcgcttgaaatcaagaggcagaggttgcagtgagctgaaattgtaccactgcactccagcctaggcaacagagtgagaccgtgtctcaaaaaaaagaagaagaagaacatgtacagtagacctttgaatgatggtggcaattcggggcacaggtgaaaatccgcatataatttttgactccccagaaacttaactatgactagcctactgtttcctgaaagccttaccaataacataaaccatcaattaacacatattttgtatgttatgtgtattgtatactgtatgttacagtaaagtaagctagagaaaagaaaatgttattaagaaaatcacaaggaagataacatatgcttcctattcattaagtgaaagtggatcatcataaagatcttcatccttgctgccttcacatccaaggaggagaaggaagggtggggttagccttgctgcctcaggggtggcagaggcagaagaaaatgtgttcatatgtggacctgtgtcattcaaacctgggttgttcaaggatcaactgtaataatgcaatactccccaaattgatctacaaactcagtgccacctgacttctttgcagaaatgggcaagctgatcttaaattcatatggaaatgtaaggggtccagaataacaaaaacaatcttgaaaaacaaaataagagcaatgttgaggactcacacttgctgatcccaaaacttgctacaaagctatagtgagggagacgatgtgacactggcataaaaatagacatataggccgggcgtggtggctcacacctgtaaccctagcacttagggaggccaagatgggtggatcacctgaggtcaggagtttgagaccagcctggccaatatggtgaaacctggtctctactaaaaataaaaaaattagccagacttggtggtgtgcgcctatagtctcagctacttgggaggctgaatcacttgaacccgtgaggcagaggttgcagtgagcaaaactctgtccaaaaaaaaaaaaaagaaagaaagaaaccccatctctactaaaaatacaaaaattagccaggtgtagtggctcatgcctgtaatcccagctactcaggaggctgaggctggagaattgcttgaacccggaaggcgaagattgctgtgagccgagatcgcgccactgcactccagcctgggcaacagagtgagactctctcaaaaaaaaaaaaaaaaaaaaagacatatagatgaatggaatggaatttagagtctagaaatagaccctcatatttatggctaactgagttttgataaggatgccaaaaagacttaatgggggaaagagtattcttttcaacaattgtgctgagacaactggatatatccacatgcaaaagaatgaagttaggctccacctcataccatatacaaaaattagctcagaattgatcaaagactaagtataagaactaaaactataaaagtcttaaaagaaaatagaggtatgaatcttcacgaccttggatttggcaatggtttctaagatacgacatcaaaagcataagcaaccaaaaaaatagataaatgataaattattaaataaattatttaaaaataaaagtattcattaaatcaataaatgtaaatacttttatgcttcaaaggactctataaagaagtgaaaaagacaacacaaagaatgggagaaaatctttgcaaatcatacatatgtaagtccctgatggaacttgtaactagaatataaaaataacttttgcaactcaataataaaaagacaacacaatttaaaaatgtacaaaggagctgagtgtggtggctcaggtctgtaatcccagcactttgcgaggctgaggtgggaggatcacttgagcccaggagttcaggaccagcctgggtggcattgtgaaatcctatctctactaaaaatatatacacacacacacacaaaatagctgggtgtgatggcacacacctgtagtcccagctactcaggaggctgaggtgagagaatcacccgagcctgggaagtaggggctgcagttagccgtgatgacatccacactccagcctgggtgatgggagtgagatcctgttttaaaaaaaaaatgcacaaaggacttgaataggcatttctccaaagatatgcaaatggccaataagcacatgaaaagatgctcaatgtcatcagccatccgggaaatgcaaatcaaagccacaatgagataccccctaggatgatggctataatcaaaaagatattacaataataagtactggcaaggatatgaaaaaactggaaccctcatgcactgctgatgagaatataaaatgatgcagctgctgtggaaaacagtttggcagttcctcgaaaagttcaacattgagttatcacaagacccagcaattccactcctgggcatatacttaaaagaattaaaaatgcgtgtgggacacagtggttaacacctgtgatctcagtgctttgagaggcaggaggttgacttgagcccacgagttggaggctgcagtgagctacgatcgtgccactgcactccaacacaggtggcagagcaatatcctgtttccacatatatgtttataaacatatatacataatagtcaaaagatggccatcaactgatgagtggattaaaaaaacgtaaaagatccatacagtggaatattatttagtcataaaaaggaaaggcccaggcgctacctaaaatataccaagccccaggtttacatagggccccaggtcacactaggctctaggtagacactggactctaagtagactttaggccccaggttcacagccacacctcaggaggataccacaccccaggtagctgtaagactcaatccagacaccagtcccccggtggagaatctacgccccagctggacatcaggttccaggtaaacaccaaggcccagttgggtttactggatccattggtggacatcaggcaccaggttggcacagagcccccacatagatatctacaccacaggtggacatgaggccccaggtacatacccagtccgcaggtgactatcgggccctaggtgaacactaggtcttagatgaacttcgggacccaagtggatacccaggcccctggggaacatcaggctccaggtggacaccaggacccatgtgggcaaccaggtccagaggtacatcaggttccacataaacacccaacctccaagtggatactgagcccccaggtgtacacaccagtccctcgacaactgaaaggtcacatactctcaggccaaatgcaatagagtcatctctcccaaaaatatgtatttgggaaagcgaaaactacacttctcaatcattctcaagtcaagggactcttaatagaaggccaaatacacactgaaagaaccaaccatgaaattcccacatccaacaggagtgcaatgctgctcaactagtcccagagcaagacccaccacaggctttgcatggaggacacacagattagaagggaagaatggaaatgtgggacctgagattgcaatacaagaaaagagaaaaaggcaaccgtgcataccaagaaacccaagaaagaaagggtgacgtggagaaataactaacccaggcccagttttccaagaaacattagaacccgcactgcgaatgaagtggcaggccgaatcgagccctgtctagattttcaggtgtgggtctctcctagatgacttaaaagcctacaaattgctgaggtcaccctgactatgtccgacccaccttgcagaaattcaccactgggaaaagacacccaaaccaatgcagttccggagcttaccttggagaagcttcctgcagtccctgggtgccactggctggctctgcggctttcttggagggcccgcggcctcagcccggctccctccctcagctctggtgcgtggccgcagatgacccgagcggcctgggcttgggcttctggtgccctcgaggagccgccctgtgtgctcacacaggctcctggcggcgggcagcacagcactctcacttttggtcaccggtcctttcccgagggcagtctggcggggcacggctccagggccccgagtccagcacctccctgaaatcttcacgccacaggcaaagcagtagggcaacttacccaggctctgcctgagccaagatggcgccttcctcacagcctgtgcaggagggcgaggtcccagatgatgaggcgcgggacaagggcaactcgccacccattcttcccagaaagagggcaggtgcatgggggcacaccccctacaggtggacataaggccccagtggacaccgaggccacgggaaaacatcaggccacaaatagacactggacatcagacaccaggttgacaccaggacctgggtggacaccaggtctcaaggggcctccagtccctgcacagacatcaggccccaaatggacaaatcaggtcacagtttggcacataggcaggccccaggtggacaccaggccacaggtacataacaggccccaggccaaaaccaggtcccagaaggacatcagacatcttagtgtatgtcaggtcccaggttgacatataggccccagtggaacaccaggccccacttgccagtttccaagtggatatccagaccccaggtaaatatcagcgtcaaggtgaacaggaggccccaggtggacaacaggcctcagctagatgcctaggcccctggtgaactccagccccctgatgaacattaggccccaggtggacaccctggccccacgggaacatctagttccaggtggacatcagacccaaggtaaatacccatccccaggtaaacgccagaccccaggcagattacaggtcccagaaaaacacccaggtcccatgaagaaatcagaccctaggtgaactctggtctgcagggggacatgaggctgggtatccacctgggacctggtgttcatggggtgggggccgatgtccaccttgggcctgttgttcatctgtggcctggtattcacctgggccctgagagtcaacctggtgcctgatagccacctggggcctacatagccacctgggggcctggtggtcacttgaagcctggtgtcctcctggggcctgttaccaacatgcggtgtaggtatccaccaggggcctgatgtccacctgaggtctggggttcacctggagccttggtgtcaccctggggactaatgtccacctggagcgtggtatccatctaaagcctgtggtctgcctggggcattattatgtcccttgaagactaagtatccaactagggcctgattttcacatgaggcctgggtatctgcccgaagccttggtatcctccttgggcctgaagtccatctgtgacattctgtccagctagggcctgggtgtgaacctggtgcctgatgtacgcctcaagtccagcgtgcacccacctgggacgtgatggccacctgaggccatatatccacatggagccagggtgtccacttggggcctaatgttcaccaggaacataagtatccacctggggcctcatgtcttcctggggcctgggtgtcaatgtggggcgtgggcatccacctgggggctgatgtccacttggagcctggtgtctacctggaaccaatttttcaactgggaacctgatgtccacctggtgcctgatgtccatttggaaactggagtccacctgggaactggcatacacctaagacatagtgttgagccggtgtttgatgtccaatgttcaccaggctccaggtggacaccgggcctcaggttgacacccagactccaggtggacaccaggccccagatgaatgccaggtccccggtgaacatccaggccccaagtggaaaccaaaacctcagatgtctaggcattagaccccatgtggacatccaggccccaggaagtcatcaggccccagtggacactcaggccccaggtggacatggagtcccaggttgacacccaggcctccagtgaacagcaggccaaggagaattccaggcccagcaggccccaggtggacagcaggatccaggtggacacaaggcccccagatggatacataagaccctggtgaacatcaggctccacatggacacccaggccctagaagaacaccaggcctcgcgaggatacgaaaattcaaataaacactaggccccaggctgaaatcagttccaaggaggacactagacctcaagtgacaacctggccccaggtggctatgtgggccccagctggacggcaggtaccagaattgacatccagggcccaggtaaacaccaggccccagaaggataacaggcacaaggtagacataggccccaggtgcacaccagatcccacgtggatatctaggacccaggtgaacaacaggcccaaggtgagaatccggtctccaggagggcaccaaggcccaggcagacaccaggtcctaagaggacaccaggatacaaatggacaccaggcctcgggtggacaccaggctccaagtggacatcagcccccaggtgggtatctggccccaggtgaacacccagtctcaaggtagacaccaggccttaggtagacagtagccactgggtgaacactgtgccccaggtggacaccaggtctcaagtagacacccagtccccaggtgggcaccagagaccaggcagcctgatgagtccccaggtgggcaccagagaccgggcagcctgatgaggctccaggtggacaccagagaccaggaagcctgatgaggctccaggtggacaccaggctgcaggtggtaccaggctcccagctgatacccaggccccaggggaacacccaggccccaggtagacagcaggaagccagtgcaccctaggcacccaggtagatactaggcccctggtgaacatcgggcctcagctggacacccaggccccagggaaacacccaggccccatatgtcaggttgttaggtcccatatggacaatcaggccccaagaagtcatcaggccctggtagacactgagaccccaggtgactatccagtcccaggctgacacacaggcctcaggtggacaccgggccctaggagaactccaggccccagctgaagatcaatgccccgggtggacacccaggccctagctaacgaccagtccccaggattccatcaggccccaggtggatactaaactctcggtggacatcagcaaatgcccaggtcccaggtcaaaaccaggcccctgatggaccccctgaccccaggtaaacatgaggtttcaggtggacacgtgactctaactggatatcaggccccgggtggacacccaaccccatacggatacctaaacccccgatgaacatcaagtctcgggtgcacctctaggtcccaagtaaacacctaggcctcagaagtccagacatcgggccccatgtggaaatccgggtcccaggaactcctcaggcaccaggaaacactcaggcctcggttggatatctggccccaagttgacacccaggcctcaggtggacaccaggcgctaagaaaacgtcaggccccagctgagatcaacccctgggtggtcagtactggcgcatgctaaaacatgtatgagccttaaaaacatcatgctaagtgaaagaagccaggcacaaaaagccacatagtttgtcattccatttacatgaatgtctagaataggcagatccacaagagacagaaagtgggttagtggttgccagaagctggagacaggggagaacggcgagtgactgctaatgggtacggaacattattgggaggtgatgaaaatattctggaattacatagtttatgatgtggcataacatttaaaatatgctaacaacgactgaattgtacgctttaaaaaggtgagtctttttctttttttgagatggattctcactctgtcgcccaggctagagggcagtggcccgatctcggctcactgcaacctctgcctcctgggttcaagcaattcgctgcctcagcctctcgagcagctgggattataggcgcccgcagccacacctggctaagttttgtgtttttagtagagacagggtttcaccatgttgcccaggctggtctcaatctcttgacctcatgatccacccgcctcggcctcccaaaatgctgggattaccagcgtgagccaccgtgcatggccaaaaaggtaaatctcatagcatgtaaattacatgtcattaaacacacacacacacacacacacacacacatgaggtgggtgtggtggctcaggcctgtaatcccagtactttcggaggccaaggcgagaggatagcttgagcccaggagtttgtgacaagcctgatcaacagagcaagaccctatctctacaaaataaaaattaaaaaaaaaattagctgggtatggtggcatgcacctgtagtcctggctgcttggtaaggctgaggcaggaggatcgcttgaacccaaaatctgaggctgtagtgagctattattacaccactacactccagcttaggtgacagaggaagactccatctcttaaaaaacaaaaaaacaaaaaaaaaaaactaataaaataaaaacatgaaatccaaaccaaaaagagatgagaggggaggtaggcagagagagacagagggagagagagaccaggagagagccagggagagaggaagggagagaggcttggactgagtgtctgagtctccatacagacagtcagatcactggtatgttgtgggggtgcagttggggaaatgaggaaactccaggcatcagggggccccatttgagatgtaccatccagagtgtgagaattctaatgagtaggcaggggccataaggaccattttcttcctccctcccttccttccttccttccttccttccttccttccttccttccttccttccttcttccctccctcccgccctcccttctttccttcctttttcgtttttgaaatagggtctcactctgtcacccaagctggagtgcagtgacacaatcatagctcactgctgcctcgaactccttggctaaagcaatcctcccaccttagcctcctgaggagctaggactacaggcatgcaccaccacacccaattaatttaaaaaaatttaatagagatggggtcttgccgtgttccaggctggtcttgagctcctggactcaagtgatcctcccacctcagcctcccaaagagccaggattgtaggcatgagccaccgtgtccagcctctttataaataaaagatcagtgacacagaaaatggtttggttaaaatactttatatttcttcctaaactcttcttccaaagtaaaataaatatattttcagttataagtaaatttgctggaatgtttttccacctgctggggcaaaggtcctccccttccacccctgcctgctgcccccggtcctgtcgaggggcagatttcctccctcacagggcagacaagccacatcggggcagtgtctgccgctgcttccgaactccctgctcacggactgggagcggggcctctggcccctgagtgagctggggcaacagacttcagaatgtcgcagcccgagggagagtcacctggagagccactggggagacgctgatgtgggctgatgctggatgatggaaaacactgtgtttcgtgttttttattttgtcaggtgtgatgacagtataatgggatgatatgttaaaattcttttttttttttttgagacgaagtctagctcttgtcccccaggctggagtgcaatggcacgatctcggctcactgcaacctctgcctcccaggttcaagggattctcctgcctcggcctccggagtagctgggattacaggcgcctgccaccatgcccggctaatttttgtatttttagtagagacggggcttcaccatgttggccaggctggtcttgaactcctgacctcaggtgatcatcctgcctcggcctcccaaagcactgggattacaggcgtgagccaccgcacctggcctaaaattcttatcttttcatgtatctcaaaatatttagggatcaaatgtgtctgggccatgctggaaatactttagacaaagaaaacaggagagacaaagcagataaaacaaaatgttgataattttaaatctagctgatgggtatatgggggttccatttaatattttctctcctactcatatacgtgtgtttgtgtgtatgtgtgtgtatgcctttcaaaattctcattgaaaagtggctgatcggaagtgcaccctcaaagatgttttccccttttctccactaactcacttttttttttttttttttttttttttttgagaccaaatcttgctctgtcacccaggctggagtgcaatggtgtgatcttggctcactgcaacctctgcctcccgggttcgagctattttcctgcttcagcttcccgagtagctgggactacaggcatgcagcaccatgcccggctattttttttttttttttttttttgtatttttagcagagacagaattttgccatgttggccaggctggtctcaaactcctgacctcaagtgatccgcccgcctcggcctcccaaagtgctgggattacaggtgtgagccatcaatgcctggcccactaactcacttctaaatgatcttgttctctttgaacagaaataaaggatattatgatcttaccactttataaattagaatgatgaaattgagaaaaactagagatgactaagatgaagacagacatgaaatcgtgccaaaaagtgcccatgctgtatccagcagctgctgcagccacagaaatgctcgagttgtcagcgagggtactcactgcttgatcatctagcattgccagatactgtaaaccgccgcacacctatcagcagggcactggctacatcacacagattgctgtgccatggtttaaggtcacattgcagcagagcaggaagcatgtggctgggagtggcacggggccagctttcaggatgtatggtctggactgagctgcagtccttggggcctggacagctgctctggccctgagccctcctcccctccctgtggtctctccctttccatctctctctgctacatagcctcccttccctctctctgctctattctccttcccccatcccctttcccctcacccccaggtcaattttcttagatatctccaggcccaagtttggaggttcccaattagggtgcaggctggccctcaggtgcgtgggggtccaccttgtccagccatggctggccccagtgctacgtcacaatgtagggactgagagtggatgcggtggaggtgggcatttaccacactgtaagggatcagtcagtacagaccaggagcaggccgaatagtcagtacccgtgcagttccggaaaacccactcgttttgtgaagagcgtctgccagctcctgcatctgctagggccctgctgtgcctcctcccctctcctgccccctgggactccgcctccctcccctgctttcttttctcctggcgcttgtccccatcccacgctccaccgcgggatatagcaatgacttatttgtgtattgaggtcagtagatctcctctctatgaagacaggtccctcagggacagggctgtctgtgctggtggccgcagcagcccagcccctacagcctgccccacatggtagacaggcagctatttgctgagtaaatgaaggggtcaggggatcgctaataattttcattttatgttttatgctttccttttggtttcaactgttctgtaaagaagacattttatactagaaaataatattgctttaaaatgtaaatgtgcatggagcaacaggaactctctcattcattactggtgggaatagaaagtggtccagctattttggaagacggtttggcagttttttacaaaacaaaacatacttttactatacaatccagcaatcacactccttggcattggcccagatgaatggaaaacttaagtccacacaaaaacctgcgcatggatgtttatagcagctttatttataattttgtcaaaacttgatagcaaccaagatgttcttcagtgggtgggtggataaataaactgtggcacatccagacaacagaatattattcagtgctaaagagaaatgagctatcaagccatgaaaagccttggaggaagcttaaatgcatattactaattggaagactccagtctgaaaaggctacgtactgtacaatgccaactctatgacagtctggaaacagcaaaaccatggagacagtaaaaagatcagtgaccccccgccaggttcaatggctcactcctgtaatcccaacactttgagaggccgaggcaggtggattgcttgagcccaggagttcaagaccagcctggacaacatggtaaaaccctatcttctctactaaaaacacaaaaattagcctggcgtggtggggggtgcctgtaatcccagctactctgcaggctgaggcacgacaattgcttgaacccaggaggtggaggttgcagtgagccgagatcatgccactgcgctctagcctgggcgacagagcgagactctgtctagaaaaaaaaaaaatcagtggctctcataaaaacatcagtggctcccaggggttgtagaagggaggtgaacatgtggagcaggaagggctttccgggcagtgaaaccgctctgtatgattctataatggcggacacgtcattatgcatttgtccgaattctcacgaagtgcagcatccggaatgaaccctagtgtgcactgtggactctgggggataggctgtgtttacctaggttcttggacttaacaagtgcacccctctgtggggtgctgacgggggaggctgtgcctgttggagcggaacatatggcacatctctgtaacttctgctcagttttgctatgaacctaaaacacctctaaaagctaaagtctattaaaacattttaaaaagtagatttcaggctcagtgaggtgggagagggcggtgggggtgttcccaggcacagagggagcaggcacaccctgccctcgcaccctgggagaagctgggctggctgaacttggggaggcctggccctgggacctgcaggtagcctctggaatgcggacgtgcaggctgaccctgatggtcctgtgaatgccaaccaacctgccactcctgggctccctggcacagtcaccacaagtgtcaccccaggtcactcgcagatgcacccttatctccagaccagctggagacctggcctgaagctgagggttggcggcaggagaatggcccaggcaaaagttctcctcctaaagttgctttggaaggagggccggggagggccctcccggaccctggaagcatgaagacctccccactggagtgaagacagggagagagccaggcgtggcaggcacagccagggtgcgcacagaggatggctgcccggggcttagcatctgctcacctcatgaggttggcactgctgcctagacaacccatgtaataccccaggcctcaccattttggattgagagatgagctcagcgtcccctcacagggctctggagggtttagcaaaaggctgcggtgaaagtcacccggtccacggctgtctctgccacctgggactctctgcttcctttgcctgtgactctgcagccacttggcccggcccccagtgctgggcacccctctagatgagcgatttgccttcctctccgggtacagatgatgaaggggcctctcccggtgtcctgggtatttctggcaaccaaatggcccctgcccaggcaagagtcccgctaggaatcagcacagcctgcttgggctgagttcgtgggtggagggcatgagcttccgagaagcccctgcaggcgccaagctggggggccaccaagcccgttttccgccgtggctgcctgggtgcagcggcaatgcctgtggcgtgggctgctggcctggcctgtggggcagctgcaagtttcccttttaatggaaatctctctcttgcagccatacattgtgtttgactcgagtgtgtttttcttggctttaagaaacaggattagttgcactctttgtaatttttggtattaaaggtatttttaacaaatgcagtctgtatcgtgggaacatcctgaagttcctggaatgtctgtagtctaaagtcaagcctgttcccacccctggccttcctctttaaaggcttgatgttgttcgatgggatgtctatttttgttcatttaggtttcaaattgaagcgtgactagcactgggaaattggcattcccctgcagtcagctcttcttcctccagccccagatgtgggacggtagagcagaggggcaaaaggatcggacggcactgtgtgctctaggcagggacagctgaggggccaatgccctgcccctcccagccagaggaggatgcccccatctgttcactgcaccctccagtgggaaacgagcaaaacaagaggcaatgcatttgcagtcactacagtaggaagaggtattcgctttccaccagtaagtgacaaatcactcataagggagtgctgggaagggaagagcatgatccctttaaatgataccaagtggggaaaggaagtgctgggtagaggaggtcgtggtccctggctagggctccacccccacggacctaggtgaggacaggcatttttgtttgcctgcccaaatgttgcatttcccaagaccaccctggcctgccatgcccctgtcctgtgcctgtaaaatcccctgacattctaacaggcagacacacaacaggctggatgtggagagaagcggatcggcggaagaagacacaagcggctggacgtcaaggggagcacgctggcggaagagcacagcgacagaagagcacactgacagacgtcggcaggccacccaccctggcagaatgacacagggtttggctagggcagtcagaagagagcctgggccgctgagcgcccgactccaggggaaaaccatctcttgtctggctcccccatctactgagagctacttccactcaataaaaccttgcacccattctccaagtccaggcgtgatctgattcttctggtacaccaaggcaagaacccagatacagaaagccctttggccttacaacaaggtagacggtctaattgagctggttaacacaagctgccgatagagcaccctgtaacacatgcccactggggcttcaaaaactgtaaacattcacccctagacactgctgtggggtcggagccccacagcctgcctgtctgtatgctcccctcgaggtctgagcagtggggcactgaagaagcgagctacacccccatcgcacgccctgcgaggggatcaaagaaactcttcccatttcatcaccaccaacagcagcttgagatgacacccatttgcagcctcacagttccacgaggcaggaacttgaatgtggcttagctggatgctctgcttctgggtgtctcccgaggctgcagtcaaggtgtctgccagggcggtggtctcatccaaggctttgctgggtggggctgcccatccaagctcactcatgtgctctttggcaggacccagtttctctggctgctggaccaaggccccagctctcggctgtctctcggctggaggccgacttttgttccttgctgcataagccttccatagtggcagcttcctgcaccaaagccagcaagggtaagattctagtcttttgtagtctaatcacagtgtgacatcctcaatgtcgctgcgttctgttagaaggaagttactcaaggggtgaatacaagaccatgccttccatgaggcaggatcgtggggccacctcagacactgtctgccacagaagcgtgtagaaacgatccaccccttgctcatatgtgcattcaccagaaggtgctttggcccctggtccagagcgggagcaccagggtgaggctctgaccccctgcaatcctttcaactctcccatccctccatctcctcctctttagaacgggggtgatggaatccactgtgcagttttgtaatgtttttaaattagaggttgtattgggccattcttgcattgttacaaagaaatacctgaaactggataatttataaagaaaaaagctttacttggctcacggttctgcaggctgtacgggaagcatagcagcatctgcctttgaggaggcctcaagaaaacttccagtctttgtggaaggtgaacgggccgcaggcacagcgcatggtgaaagcaggagctgcggtcgcgggggcgggggatgccacacacttgaaaatgaccagatccataagaacccgctcactattgccaggacagcaccaagagcatagtgctaaactattcatgagaaaaccacccccatgagccaatcacctcccaccagacctcacctccaacactagggattacatttcaacatgagatctggggagagccacacatccaaactatatcagatgggatgagaaataatgaagagctggccttggcattttgctcatagtgggaacccagaaatccttgaatgaatgaatgagtttcctgttgacacaatataagtgctatgatacaaatgtatgtgtccctcccaaagttcacatgctgaaacataaccccaagttgatgctattaagaggttgggcctatggaagttgatggccatgggggcagagtgtccttataaaagacgctccagagagcttgttcagcccttctgccatgtgaggatgcagccaataaggctgcttggaggcagagagcaagcaagactcaccagatacaaaacctgccagtgtcttgatcttggacttttcagccaccagaaccataagcaaaaaacttctgttgtttataaactatccagtctcaggtattttgttttattagcagctggacagcccaaggcagggacaaagccccatttggagactttggcagcaagaaatacatgagaattccttcagaatatgtggattcctggggaagtgaaacccagctcagcccctagggagtgcggaaggtcaggcctctagcttggacttggccctttgttctagagaattagacactcaacaaagctccgcggtgctcacagctgaggctggagaagggacaacccagatgaggaaggaacaacatatttttttttctggcttctactttattttattttgagacacagtctcactctgtcacccacgctggagtgcagtggtgtgatcttagctcactatagcctctctctgcctcccaggctcaagcaatcctcctgcttcagcctcccaagtagctgggactacaggccagtgccactacatctggctaatttttaaacattctttatggagatggggtttcaccatgatgcccgggctggtctcaaactcctgaactcaagtgatccacctgcctcagcctcccaaagtgctgtgattaacaggtgtgagccactgcacctggcctctgtcttctattttaaaaaagaaacttttatgtggttataaaagtgatgctggctagcaggaagaccctaatggagaggctagaaaggaatgcaatcccactgcccagagaggccggcctggctgtgccagaatcatagagtgggggtacactttcacctggcacagccaagcccactcagacctgcccagtcagagctggggcagagctgggcaggaggaggttggagacaccccctgagtgattctgacaacctcctggttgcaaagtgccctctatgcagcatctcccgtgggtgaggtcaggctcttggagcagttttctttgtctgcttttccccatgcagcattatatcatccacattttccagtgatgttctctccctgtgactctcacacctgtaatcccagcactttgaaaggctgaggcaagcagatcacttgaggtcacgagtttgagaccagtctgggcaacatggcgaaaccccatctccataaaaaatatttaaaaattagccaggtgtggtagcaccgggctgtagtcccagctacttgggaggctgaagcaggaagattgcttgagcccgggagacagaggctatagtgagctaagatcacaccactgtactccagtctgggtgacagagtgagaccgtgtctcaacgtaaaattctccaggtgttctcccagcccacagccctcgtcaggttggcatatgacattgtaggccttttcttctgtgtttccataattacatatttacgtggcaatatagttttggattgtttttttctctttatataaatggtatcataccacaagtggcatcctgtgtcttaccagtttcccactgtgatatgtcttggtattttttccatggttggacatgtcactgacacatattcttttcattgcttcttggttttgaggttccaaggttccgagattccatagttccagggttagatggttccatgattcactggttccaaggcccaaggttacatggttcaaaggttccaaggtactatggttccatgcttccaagatgcaatggatccaaggttccaaggattaatagttccatgtttccaaagttccttggctcaaaggttcaatgttatcattgttccaaggttccatgtttccaagattcagtggttccaaggttctatgattccatggttccaaagatcagtgatttcaccgttccaaagctacatggtttcctggctccaaggtacaatggttccaaggatccaaagtaccgtggcttcatagttccaaggttccagggttcactggtcccaaggcccaaaattacatagttcaaaggttccaaagtactgtggtttcatgcttctacggtgcaatggttccaaggttccaaggttcaatggttccatccttccaagattccaagattccattatcaaggttcagtgttaccattgttccaaagttccatggtttaatgggtccaagattcaatggtttcaatattacagagttctaaaattcagtggatctgtggttccaactttacaaggttgtaagattcagtggtgaatggttccaaggttccaagtttacagggtttcaagtttacagggttctaaggttctgtggctctgtgattacaaagttacatggtttccttgttccaagattacatggttccaaggttccaaggtttcttgattccatggctccaaggttccatgtttccatacttccatatttcagttgctccaaggttccatggtaccaaggtttcatgtttcccggtttcgaggttcagtggttctgtggtttcaagactccacggttgcaaggtttcatggtcccatggtccaaggttccaaggctccaagtttccaaggtgccatggtttcagagttcatggtatcaaggtttagtggttccttgcttcccagtttccctggtttgttgcttccaagttatcaacatttcatttttcatttgcctccacctatttgtagacactcagattgcatccggagattttgctcttatcaacaacgccaccactatcagccttgctttttttttccttgtgcacatttaggagtgttcctgaagggcaaaaatcaggagcagaattgctggatcccaagaagtaatatgtgaaatttaatcaatagagccatattgccctctaatgcatctgtatcagttgcagtcttccagcagtgtatctgagtaccatttgctcgtcatccttgctatgacacaatattatcaaactttggtaatctttttttttttttttttttggagacagaatctcactgtgttgacaggctgggatgcaatggtgggatcttggctcactgcaacctccgcctccaggttcaagcaattctcctgcctcagcctcctgagtagctgggattacagtcacgtcccacaaggcccgggtactttttgtatttttaattgagatagggttttgtcatgttggtcaggctggtcttgaattcctggcctcaagtgatctgcccaccttggcctcccgaacttctgggattacaggcatgagccactgtggccggccaatctttgataatctgacggatgacaagaatatctcattgtaatttttgtttcacttgagtttgaactcttttacaatatgtttattgaccacttgtgtttcattgttacctgtgaattgtctgtttttattatgtaggtggtcttcttgttgctatgtaaagattcttttttttctttcttttcttttttttttttttgggacagagtctcgctctgtctcccaggctggagtgcaggggcaggatctcagctcactgcagcctctgcctctcgggttccagcgattctcctgcctcagcctcctgagtagctgggattacagttgcctgccaccacgcctgactaatttttgtacttttagtagagatagggtttcaccatgttggccaggctggtctcaaactcctgacctcaagtaatccgtctgcctcagcctcccaaagtgctgggattacaggcataagccaccatgcccagccataaagattctttatgtgttctattaccaattctttgcctttgttatacatgttgcaaacattttctcccagtccatcatttctcttgtagctctgtttttggtgagttttatgtattgcctgatgtatcagtattttctctctgggttcagaaacttatgtattgtattctctacttcaccaacaaagtttcctgtttttttcttttcttttattttttttggatggagtctcactccgtcacccagactggaatgcagtggcacaatctcggctcactgcaacctccacctcccaagttcaagagattcttctgcctcagcctcccgagtagctgggattacaggtatgagccaccacacctagctaatttttgtatttttagtagagacgaggtttcaccgtattggccaggctggtctcgaactcctgacctcaagtgatctgcccatatcagcctcccaaagtactgggattacaggcatcagccaccatgcctggcctattttcttcttttgtatctcatcagtattgatgtccaccagccaaagaccatctgtagtcaacaaagttaagtttattgctttgttgcaagtgagcctgcacatctaaaggagtgggtctggggacagagttagtcataggatgtcctgtcagcgtttggacagagtttgttaactgagggtcttactggaacaacgatgagtggtcttgtctttatgagttcgttttgttttgttttagagacagggtctcactctgttgcccaggctggagtgtagtgatgtgatcatagctcactgcagcctcgaaatcctgggctcaagcaatcctccctcttcatcatccctagtagctgggacttcagctcctgtagaggcggggtctcactatgttgaccaggctggcctcaaactcctggcctcaaggggtcctctcacttcggcctctcaaagttctgggattacaggcatgagccaccgtgcctggcctggtcatgtgtgttcatgggccaatttgtccatggcttattttaggacacatggatgtgaatgaactggtgttaaataatgacgcccactgtggcttgatctggcacagttgatgtgttttgtgagtcagggtatatttcgcaagctgtggtttctgttttaatcctcagtttccccaaacagactggatgcagcaggacccgtttacacctgagctgtggctttcccagtcattttcctggccagccttggctgaaggaccagctgttctcttctgagcgtgccatcatcgatttttgtgccaagtcaaatggtagcctttctgacgcctgcaacatccagcccccttgttctttctgttggatcatctgacaggacatcagctttgtggcagcattccaaaacgtggatatgcacttggctactgcaacacagataaatactaagacaagagtttttattcacaagtgaaacatatctcctatgttctgtgttctattaggagctttctcggatgaccaagtggtttcttccctttgatctggatgagatttgttcaactttgccagagtttgaagaattagttctgtatctggtgattgtcaagagttagggtcttggaagcaccaacaatgggggtgtccactggcaatggagtccctgaatccgcagagagggaaaacagccaggaaaataaaaaccagggacatgcctcatgcagagaagccccagcagtgggcagaagcgttctagtccgctgatctctgctcgtggacccctcggtcctgggaaccctgacccgcacgaggtccatggtggtggcattggcactgcccctaattgaattccctgtagtaccagtagccaccagagcctgggacagtccttgactgaggttctttagatgtttcatccacacggctcagttcccgagctttgtggatagcaggagccttggggagaatgtaaataaatgttctgtaaatgtcagttcggcccgtcaggtctagagtgtagtctaactttgatgctgctttgctcattttctgtctggatgatctgtccattaataagagtggtatgttgaagtcccctacaaaactctaataggtagtaagaataagtgttttttttctggatttaggaaagacaaagtcaaagaattgtcagagaacttaatatatgaataaggctagaaatggcaaattatacatacagataaatatatatagagaaaaatatataaatatatataacaaaaaatttttatatatgtatacatatattttccaagacagggtctcactccccttgcccaggctggagtgcagtggtgcagtctcagctcactgcagcctcaacttgctgagctcaagtaatcctcccacctcggcctcccaagtagctgggactacgggcgcgtgccatcgtgcccagctaattttttgtatttgtagtagaggcagggtttcaccaatttgcccaggctggtctcgaacccctggactcaagtgatctgcctgcctcggcctccaaaagtgctggaattacaggtatgaagacttcattttctttgcagtgattttaggataagttaagggtggagccagaataaacccagctgtattaaaccctgaaattccaatcctttcctctaatagctttaacacaatgtttttacttttagaaatgagatctcactctatcacccaggctggagtgcagtggcatgatatagctcactgcagccttgaactcctgggcttaagcaatcctcctgcctcagcctcctgactagctgagtaggcacacgccacgacgtcttagttttaatcttgtgctgtgtaagtagagctctttaatcagactgcaatgtatttttctgtgggatatatgatccaaacctttgtttcttccaaatagatagccagctgttgcaattttagactggtgtgaccatttttctgttcataagaacactttagagaatatcaagcatgtgtatctttctgttcacttacgctcattttctggagttaaatttcctgaactggaattactgggtcaaaggtatgagccttttgaggttcctggtgcatgttaccaattgttttccataaaggttgcacccacaggcagaagcatccatccttggatattctaattgtaaaagatatgcttttctagtgtggataagcaaagtagcttaacattgcttcaatttactcatctttttttatttttattttttatttttgagatgaagtcttgctctgtcacccaggctggagtgcagtggcactatcttggcttgctgcaaccttcacatcccaggctcaagtgattctcctgcctcagcctcctgagtagctgggattacaggtgcccaccaccacacccagctaatttttgtagtttttagtagagacggtttcaccatgttggctaggctggtctcaaactcctgacctcaagtgatctgcccacctcagccccccaaagtgctgggaatacaggcctaagccaccatgcccagcccaatgtacacatctttaaaaattagtgagaggccacttcatacccattgggggtgctactatattttaaaataaaaacagaaaacaagcagggcatggtggctcacgcctgtaatcccagcactttgggaggctgaggtgggcagaccacctgaggtcaggagttcgagaccagcctagccaacatggtgaaagcctatctttactaaaaatacaaaaattagtcaggcgtggtggcgggcacctgtaatcccagctactcgggaggctgaggcaggagaatcgcttgaacccaggaggtggagattgctgtgagccgagatcacaccactgcgttccagcctgggcagcagagcgaaactgtctcaaaaaacaaaacaaaacaaaacaaaaaaacagaaaacataagtgttggtgaggatgtggagaaattggaacccttgtgcattgctggtagaaatgcaaataatggagccactatgggttcctcaaaaaattaactatagaattcgcatttgatccagcaacccatttctgggtatagacacaaaagaattgaaagctaggactcgaacagatactcgtgcacctattattacaacagccatgagatggaagcgatgttattcataacccaaatgtccattgacagatgaatggttaaacaaaatgtaatataaacttacagtggaatactattcagcctttaaaaaggaaggaaatcctgatagatgccacaacatgaacggacctccaggacatgatggtcagtgaaataagccagtcgcggaaggacagtttctgcatggttccacttacgtgaggttcctacagtagtagaaatcatagagatagaaagtcgaatagtggctgccaggagctgggaagaggggacggtggggagcagttgttttatggggacagaatttcagtttgggaagatgaaaagtcctagagacggatggtggtgatggttgcacaacaacgcgaatgtgcttaagcccatcaaatctcacgcttaaaaatggttaagacgggccgggcacagtggctcacacctgtaatcccagcactttgggaggctgagacaggcagatcacaacatcaggagattgagaccaccctggctaacatggtgaaaccctgtctctactaaaaaataaaaatcacaaaaaattagctgggcatggtgacgggcacctgtagtcccagctacttgggaggctgaggcaggagaatgacttgaatccaggaggcggagttgcagtgatccgagatgcaccactgcactccagcctgggtgacagagcgagactccgtctcaaaaaaaaaaaaaattgttaagatggacagtctttgtgtgtgtgtgtgtgtgtgtgtgtttgtgtgtaggccgggcacggtggctcgtgcctgtaatcctagcactttaggaggccgaggcaggtggactgcctgagctcaggagtttgaaaccagcctggccaatatggagaaaccccaactctactaaaagtacaaaaaattagccaggtgtggtggtatgtgcctataatcccagctactcggaaagctgagacacgataatcacttgaacctgggaggtggaggttgcagtgagcagaaattgtgccactgaactccagcctgggagacagagtgagactctgtctcaaaaaaaaaaaagactcaccctgatcacagctcagtgcagcctcaacctgctggagcaatcctctcacctcagcctcccgagcaactgggactacagctgtgggccaccatgactggctaatttttaattattattattattttttgagatgagatctccctatgttgctcaggctggtcttggactcctggactcaagtggtcctcctgccttggccttccaaagtgcagagattataggcatgagccactgtactcggcctgtcatgtatattttatcacaataaaaaaatctgtgagaggaccatttcttccaatgttgattggccaatcctatttttgtgtgtgtgagttttttcttcattttctgagcccacttatgtccgagctctgagtcccaggaggccagtggaggagggaagaagaggactcggcctgagggtgacatgagacttgaagaggctcctggtggcataggggaggggacagcccaggggaggcagttccgtaggcctggcagtatgaaccccaggctgaggcaggtgctaaagaagaggccatctcctcgaggccctgaccctggaaggcatttgctgaacacccagtgcctggtgacatttggggtcctgagcccagccagcctccgaggatcagccctgcctgttatgcgcggaatgtttgcatccctccaacattcgttgttgaaattctaacccctaggggggtggtactagaaagtggggcccttgggaggtgaagaggtcgtgagggtggagtcctcatgaatgggagtagtcccctcatcagaggggcccggagagctctctgccctctgccacgtgaggattaaacatgaagtaaaaaatctgcagctggaagcggctcccaccagaacccaacaaagctgcgtcttggtctcagatttccagcctgcagagctgtgaagaatacagttctgtgtttaagccactcagtttacagtattttttaatagcagtccaatctaacaaagccaccacccctggctgggccccagctagacagaaagcctgtcagggcactctagggtttaactccccaagctcagagagcgtgttggggccagctggtgtcccacacctgggccacttatctgcaggacagggtgatgggggctcccccgtgtgtcgtgacctctgggggaggttttctagaaagtgcatacacttgctctgtacgcatctccaccctgatccagggtgctcccatctctgccccaagcacctgctccagaggacgcatggtcccaccgtccagggtcaagaaccccggaccaggccctggcccggttctggtcaggctcggccaccagggggcggtgtgggctgcaggaggctgctgtccctggagcttcccagttccagaccaggaccccaccccactgggtgggcgtctccaaggccctggtggattctgtaagctcggacccgttaatagaagtggttctctattgtcccagtcgcctaaaatgctggggacctctcaggtgtctgctgatggaaaggcagccagagccagccaaggcaattcccaagcccaccgctcagccttgcagaactgactgcacaagggtcacccaggggaaatggtttctaaaaatacagggacttccacttccaggaaaattgagtagaagtacttttccctgttcctcccactatgtacggctaaaagcctggacaccacacagaaagcaaacataagcggattctgaaaggtgaagagaagagcagagatccgtcagggacctcaggacccaaggatgacggggcgggcagctccatgtggtttcttttggcctcatatatctcactcctggagctgaagaagccagcaacctggaaacgccaacagacacagacaaaattactccaatgaaagctgctgtgtctagccaaaggaccaggaggcagcagcctcgcaaggtcaaaacgtttaggcgataacctgtctactccagccatcaccaccgaaacaccctcggccactccagcaaaggctgagcgggagcctaggctccccactttgggaagccgtggcaaggaaccccaacatctccccctgtggtgtcagagaggccaaggagggagccgagaccgccgcacccacccctgacccataccccattgtggaacagcctgagcttccaccccatctgccagtaatgccgccctctccccctccctgctgggggtgggggttggtgtcagaggaggcaaagcgaggagcctggctcttcactactactcagtggtaacgaggccaccccaatgggctgtcagcagaaaccacatggggagccagaccctgcccagagtaaagagaaaaagagctcccttgggtataaacggagattgagtggggaacctggacttttttccaccctgcagtaacaaggggccagagcagcgtcaaaaaaacaacaacagcacaacaccacaatgtttacaaaagcagcaatagaagactttggggccaggcatggtggctcatgtctgtaatcctagcactttgggaggccaaggcggctggattacttgaggccaggagtttgaggccagcctggccaatatggtgaaaccctgtctctactaaaactctaaaaattagctgggcgtggtggcgcacgcctgtaatcccagctactcaggaggctgaggcaggagaattgcttgaacctgggaggcggaggttgcagtgagccgaggttgtgccactgcactccagcctgggtgacagagcaagactctgtctcaagaaaaaaaaaaaaaatagagaagactgatgggtgtgtttattaccttgattgtggtgatggtttcatgggtctgtatagacatatgtcaaaactcatcaaactgcctattttaaatatgtagtttcttgggtatcaattatacctcgataaagctgtttgaaaaacagaaaatttaaatcagatccagagtctcataacacaaaaaatgtccaggtttcaatagaaaaccgctcattaccaggaagatggttctcagtatgatgcaacggactgaaactgttgaatgcaactaagtgaaaagggacaatcagtagatgccaacagtaggtggcaaagacgttagaattagctcacaaagattgtaaagcagccatcataaagatgcttcagcaaacaactaagaacgtgcttgaaacaaatgaaaaaatagcctcagcaaagaaagagagagaatatcttaggaaagaaattgaagatataaagaaattggaatggaaattttagaagtgaaaaatacaataactgaagtataaactcagtggatgggctcaagaacaggatgaaggggacagaggaaagaaccagtgaactggaagacagaacaatagaaagtacccagtctgaacaacagagaaaatagactgaaaaagaaaaaaaagaacagtctcaggtatatgtgggactgcaacaaaagacctaatatttgtgtcattggtggttaagaaagagaggagaaagcgtgcaaggctgataaagtactcaacaacggctaaaactccccatatttggcaagagacacaaacctacagattcagaatgaatcccaaacaaggaaaacccaaagcaatccatgccaaggcgcatcacagtgaaatttctaaaaactaaggacaaagcaaaaatcttgaaaatagccagagaaagcaataccaataccagtaccaatactctatagggaaaaaccatttgcattactgcagatttcccttcgggactgatggaggccggaatgaagtggcacgatatttttcaagtgctgaaggaaaggaaccatcagcccagaatcttatatgcagtgaaaatatccttcaggaatgaaagggaaatcaagacattctcaaatgaaggaaaactaagagaatttgttgccaaagacttacccaaaaacaccagctgaaggaagttatttaaatgggaaggaaataattaaataaggaaggaaggaaaaaaacctaataagtaaaaatgtgagtaaatacaataggcttttcttctcctcttcaattttgtaagttatgtctgatggctgaagcaaaatttattgcactgcctaatgtgattctaagtgtatgtataggaaagatttaagacaattacattataaatggggcaggataatgggatacaaagagaggtaagtttcctacccttcactcagactgaaaaaatgacaccatcagtagattgtgataagttgtatataatgtggaacatccactaaaaggctgtacaaggagctacattcaaaaacacgatggagggccaggcacagtggctcacacctataatctcagcactttgggaggctgaggcagaaggattgcttgaggacaggggttcgagaccagcctgggcaacatagcgagacccttactccacaaaacattaaaaaattagccgggcatggaggcacatggctgtgtcctagctacccagaaggctgaggtgggaggattatttaagcccaggagtttaaggttacagtgagtcatgtcactccagcctggggaacaaagtaagactctgtctccaaaaaaaaaaaaaaaaaaatgcaaacaaaaaacaaaaacaacccacactattgatcaatcaaaatggaattctaaaaaatgtttaactgataagaagtcaggacaaaggaaacagaaacaaaaaacagggagcaaacagaaaacagatcagaataaaatggtacaattgctgggtgcagtggctcaagcctgtaatcccagcactttgggaggctgaggtgggaggatcatgaggtcagaagatcaagaccatcctggctaacacggtgaaatcctgtctctactaaaaatacaaaaaattagccgggcgtggtggcgggcacctgcagtcccagctacatgggaggctgaggcaggaaaacggcgtgaactcgggaggtggagcttgcagtaagccgagatcgcaccactgcactccagcctgggcgacagagcaagactccgtctcaaaaataaataaataaataaataaataaaatggcacaattatatcctaacatatcaataattacattaaatgtaaatgtcttaactcaccaattaaaagagattggtaagatggattttaaaacatgtatcaactatatactatctacaagaaattcacttcaagatgtttcacacagatattaatcaaaggaaagcaggagtggctatattagtatcaaatgaggcagacttcagggcaaagaaacttaccagggataagactgacatgcaataataaaagggtcaatgcaacaagaatgcatagtaatcctaaacatttatctaacaaacaacagaactgcaaaatatatacaacaaaaagggatagaactgaaaggagaaatagacaaatccactattgtggttggatacgtcaacactcctctctcaacaattgatagatcaactagacagaaaatcagcaagaaaatagaagcacgcaatgatatcgtcaaccaacaggatctaattgacatttattgaacactttattccaacagcagattatcctttctttccaagtgcccacgaaacatataccaatatagaccatattctggggcacaaaacaaaccttaacaattttctaaaaattgaaatcacatggtgtgggttctccaaacacaatgaattcaaactacaaatcaacagaaagataacagaaaaacctccaaatacttgaaaactaaaccactcatttataagtaatccatgggaaaaaggagtttcaagagatattttaaaaaatacattgagctgaatgaaaatggagtacaaatgtcaaaacacagaaaaagcattgtggatggggaaaatttatagcattaaacacatatattagaaaagaggaaaagtctcaaatcgataagctcaaaaacctcaagaaactaggaaaagaagagcaaaataaacccaaggcaagcagaaggatgaaaataataaaagataagggcaaaaattaataaaatccttataaaaataatagagaaaatcaatgaaagaaagagctgattgtctttttttgtggggggagggggacggagtcttgctctgttgcccaggctggagtgcagtggcgcaatctcggctcaccgcaaactccacctcccaggttcaagcgagtctcctgcctcagcctcccgagtagctgggactacaggcacgcaccaccacgcccagctaacttttgtatttcagtagagacgaggtttcaccatatcggccaggctggtcttgaactcctgacctcgtaatcctcctgcctcagcctcccaaagtgctgggattacaggtatgagccactacacccagccaaaagctgattctttgaaaggtcaataaaactgacaaaactctatcaatactgaccaaagaaaaaaaaagacatagattaccaatatcaggaatgataactctactctatacatataaatttgacaacttggatgaaatgaaccaatttcttgaaaaatacaaactaccacaacttacccaatatgaaaaagataatttgaatagggaatttaattaataattttagaactcctaaaaaaagaaatctccggactcctatcgtttaaatagataattctatcaaatctttaaagaaaaatttatcaccactgttccagaaaataggtgaggaaagaagactttccaatttgttttatgcagctggaattacagtgataccaaaaccagacaaagatagtagaaaaaaagaaaatctcagaaaaatatccctcatgaatatagaccaagaaaatatttaataaaatattagcaaatagaattcagcactacatacaaataattgtacaccattaccaagtggagtttactcctggaatggatgactggttaaacattcaaaaagcaaacaatgtaatccactgaattcacaggctaacaaagaaaaatcatatcaattgatgcacaaaaagcatttgacaaaaatcggctgggcatggtggctcacgcctgtaattccagcactttgggaggctgaggagggtggatcacgaggtcaggagatcgagaccatcctggctaacatggtgaaaccccatctctactaaaaatacaaaaaattagccaggcgtggtggcgggtgcctgcagtcccagctacttgggaggctgaggcagaagaatggtgtgaacccgggaggcggagcttgcagtgagccgagatcatgccactgcactccagcctgggcgacagagcaagactccgtctcaaaaaaaaaaaaagcatttgacaaaattcaacactcattcataacagaaattctaaaactaggaataaagggggaactttgtcaactttgtaaagggcacctataaaatacctatagctaatgtgatactctttttttttttgagatggagtctcactctgtcacccaggctggatggagtgcagtggcgtgatctcagctcactgcaagctccacctcctgggttcacgccattctcttgcctcagcctcccaagtagctgggactacaggtgcccaccaccacacctggctaatgttttgtatttttagtagagacatggtttcaccatgttagccaggatggtctcgatctcctgaccttgtgatccatccgcctcggcctcccaaagtgctgggattacaggcttgagccaccgcgcctggccagctaatgtgatacttgatggtgaaaactaagttctttccttccaggatccaaagagaagatgcctgctctcaccactcttactcagcacagagctgggagttctagccagtacaataaggcaagaaaaggaaataaaaggcacacagacaggaaaggaagaaacaaaactgccctcatttacagataacatgattgtctctgcatagaaaattccaaggaatctaccctcaaaaaagccctcctagaactaataagtgagtttaacaaggtcgcaagacataagataaacgatcaaaagtcaattctatttctacatgctagcaacaaacacatgggcactgacattaaaaatacaataccatttaaaatccctcaaaaaatgaaacacttaggtataaatctaacatatatagaacataggtatgtgctgtgcactggtagcctcagctactcaggaggctgagaggggaggatcacttgagcacaggtgttcaaggctgcagtgagctatgatctatgccactggactccagcctgggtgacaaagtgagacctcatctctaaaaagatttaaaaaattaaattaagtttaaaaatgcagaatttgaacactgaaaactatacaatactgataggaaaaaaaagaattgaagtttttattgatccctgcaacaactggcataaatcttcaaagaattatgctaagtggaaaaagccaggcctgaaggatgatatactatatgattccatgtccacttacataacactgttgaaatcaacattctagaaatggaagacacatcagccattgctggaggttaggaaagggcttcggtgggagggaggtgcgtgtgaccgtaaaagggcagcaggagggagtctctggtgacagaaatatcccgtatcttgaccgtaccagtgtcagcatccaggctatgatgtcctaccgttgcaagatggtaccattgggtacaagggacctctctgtgttatttcttacagctgcctgtgaatctacaatgatctccacagaaaaaattcaattaaaaaatattttaaagcacataacaggcagtcatgtgtaatttgggtcacgtagaacaagtctggatcatgaagtctgtgaggctggtgtacacttaactgagagtgtgtctagctttaaaccggtatctgcatttaaaaaaaaaaaaaaaggcagagtcgggggccactctcagagagcactattaggtgctcaccggcagaacccagacattgcattttcaaagcttttaagcttttcagctgcactctgaggaaccggctattgatctgtgtccttggtgcacagcccttgcacttctttctgcccccacgccctgcggcccctctcggctctgaacaggggccctgctctctgggactccacatccctgcaaaatttgtctccccttccctgggttcctcccccggggctgagctgaggacaagggcctggcctcctccttggagaaccccacagcaccctgcatttcggcgtggtccatgggctcttctcaggggctcctcacgttgtgcaaaggggtaagggagcagggccagctgcagatctccctcccgctgtgacaaggacatcctagtcgaagagcccgtttatcttcgctcttaaggccaggctctctcaggtcattgttgccaaagaaatgaattgcagcacagctccgcaggtccctgcacaactggggcaagggctggcactgggccagcgggaacctgttggggaggctgcaaggtgcttctctgcatccaaggctgccacaccctgtgcacactgtggagctgggtggatggggtgtgctcaggaggggctctcggccctcggctgggagtcagaggcgtggtgggtggggcggggaggggtgtcacagctgcagggcagccttgatgtctgcacttggctttttaatttgtagtcacagccaacaagtgtggaaaccgcctcaggaccggcttgagtggagcggctgcgggagttacttcatgactgtggtctcacgctgtgtttcgccacccatccctgcctggcctggcttccttccttcctcctgggtacgttggcccttggctctctcctcattaactggcccctcggaccccggctggccagctgtctgcagcctcctgggtgacaccttcacccctgcctcctcgggggtctgctgccgccacatcaatctccctaacaccctgggcatgccacccctctggagacctccctagtctctctcgcagggcccccaacctgctcagcccaggcccactgccctctccctgcccggacacgtgctcccgtggcccggccgtgcctgcccacacacctgccctctctgaggttcacatgtggcatccaggggcccttccccaacagctctgcctggtgcagcctccccctcagcctcctcttccccccgagcagggtttgcagaggcccagaggctgccgggatgagtagatgttgggatcctgcttactgggcgtgtcttatcccccagagcaatggccttggaggtcagggacccagcatggccatgctggcttggggtttaggagctgtctcaccagagccccgcctcagcccacagccccgggcctgtttccttgaaggctccccagagccccatgcctggttttctggccagagcccttggcagtgacccctgctctccgcctgcagctctgggcgtcctctcagccccaagccctgataggtgccccctgtctctgtgcctgcagccttcaggagtggcccacacattggcttttatctctgggctctctgtcacctcctctccctcctgccaccctctgctcacaggctgcgggtgtggggcatccaggagctggccggtggaaagaggagcaggtgcccttacgcagtggggagcagacacacttgtgctgcttttcccttggggcttggggtggccactggggcaggacatgaggacagaccagccctcgtccccccagtgcagggggcagatctcactgccaggtgaaaccctgctgaccatccatgtggacccctcagcttggctggatgcaggaggtggttgcacagttgcaggtggggcatggagggagtggagcagccccttaccccaacacaggccccattcctgcttaaccggatgttccgaggagaagcacagcccaacaggtgtgcacaggaagctcccatcagtgctgtcctgggaaaggcccatcctgaatgaagtgtgttgctcagatccgaagagcgctgcatcttcacaggtcagggtggaaacctcctggtgcacggcccgggaggggcacccgtggcagggccagcccctgtgaggctgcacagatgagctcgagcagagagtctggggccggccacatcccacgtccgaccctgagctggggccctgggggagcccctgtggctttcgtaccagccacgcctgtatgtagagagctgagtgtctgctgtggaagaccacgagtcacatggcagacatgggcactcggcccaggcgatgctgacccatccatcagctcctacaggaccacaagctcccgttgtggtggccagagactcccaatggccacagacccactcagggctctctctggggtcttccggagaaaaggaaagctcaatgagctccttaaacctttcacttcaagttgttgcttttaaacattttgcttcgtggcctttcttgctccttctgtaaaaatctacattgtgctaccatttttttttttttttggcaaggtgtcactctgccacccaggctagagtgcagtgctgtgatcatgactcactgtagcctcaaactcctgggctcaaaggatcctccagcctcagcctcccaagtagctgggactacaggtatatcccacagcatccagctaattttttgaaaatttttttggtagagatgaggtcttaccatgttggccaggctggtctcaaactcctgggctcaagcgatcctcctgtctcggcctcccaaagtgctgggattacaggcgtgagccactatgcccactcaacatagtgattttctaactccttcatttcttctccatttagtagttggctttccaccgtaaggaaaactgcccagtctcccctctggctaccagtgaaggcttgtggggttttctttgattcggtgagttatattcagtggctgtggggcttgtttggatgctggctgaccggccccgtgtccctgtcatggtggagcacgcccttgcttcctggcaccaccgctgcacccggctcagcctgcactttaactgctgcagcgctggaggcagccacttccctgaggagccctgcttccttttgtttgtttgtttttgtttctttgctttgagacggagcctcattctgttgcccaggctggagcgccctggcaggatcatggctctttggctcagcctcccaagtagctgggactacaggtccccaacatcatacttgattacatttttaaaattgtttatagagatggggtctcattatgttgcccaggctggtctcaaactcctgggcttaagtgatcctcctgccctggcctcccaaagtgctgggattataggcgtgagccaccacgcccgaccaaggccagctttcttagaacagagtatttcttccacactggggtccaggcatgagttgtgctcactttaccatggtatcatttagatcctagaaaaaaattatttgtgagattattataatatgtataaataaatatacaattaataatactattaaacatcattgaattgtgattatattattaatatagttgtattattaatatgtgattgtactattaattttaattatcgtgtaattagttataatgcatccataataactcataccatgaattcacagtcactcctagtcctgcccggccctgcaggctcctccttgtgtccgtcattccgtatctgtacctccttctacaagagagccctaacttctaacagcatcactatgtctatcatctatttagccctccaaacacacaagacacttccagaatcttcttattctccagaggaaaatgtttcatcaaaacaccagaggcagccagcattttgacaagaaaacacaacaaacttcatttctttggaaatttgatctaggaaaatgtgtctctctcattttgctaatggatgtctgtttatcagtcagagaccatgaaacgactccttattttgaatatcagattttcttcttattctcaaacctcaaaacagcttggtaataatttatttggaaattatccgaaaggtaaaaataaaaacagaagcaagtaatatgccttgttactgctccttaattaggtaagagcctcatttcttgggctgctgggatgtaaattctgcataaaatggctggctttctttttaaggctttgcagcagtgttaacattcggctgccaactaagtcgattttaatcgcctttacaggaaccttcactttttctgtttgttccattccactctttcctcagtggataatcccgcatgttaagattcctgtgcagccgagggaggcggcttttggccgggagcttgtgctctgggtgtgagcgtggctgttgggaacgccttctgctcagaattccgtggtctcagcagatcgttcagtctagccactgggacggggccgaccgcacactgctggacctctgagcggaagatgtgtgaggttaggagggaaggaataaacaaagtcgccttcttccctgctgacctgccttggtatgtcaccattactcagctccttacagaacaggagcttcaagctttcaccggacaggctggcttcttcccgggagcccccgcccaaggtggggcctggtggggtggggccaccatcgctgctggaagctttagctcttttccctcagcttggcctcctttggcaactaattttttaactttttctaataggtaacagagtcccaagattccaagttccaggagcatgaaaggactcacttgtggagattcctgcctggggctcccacccacctaaggaatgccatccttgtcaccggctcacggggcagctctttggtatccttccagggtggtgtgtacaagtacaggcacatggatgcatggatgcatgagcatttttttcttttgccgacatattaatacacccggcagcactctaggcccattggcctgcaacttttcatttgattgatttttaattatttacttttttaaaaaattgtagttaaatatacatgacatatatttaccatttgagtcttttttttttttttgagatggagtcttgctctatctcccaggctggagtgcagtggtgtgatctcggctcactgcaacctccacagcctgatcctgggttcaagggattctcctgcctcagcctcccgagtagttgggattacaggcgcctgccaccatgcctggataatttttttttcttttgagacggagtcttgctctgtcacccaggctggagtgcagtggtgcaatctcagctcactgcaagctccgcctcccaggttcacgccattctcctgcctcagcctcccgaatagctgcgactacaggtgcccgccaccacaccggctaattttttgtatttttagtagagacagggtttcaccgtgttagccaggatggtctcgatctcctgacctcgtgatcagcctgcctcggcctcccaaagtgctgggattaaaggcatgagccactgtgcccggcctaatttttgtatttctgtagagacaggatttcaccatgttggctaggctggtctcaaactcttgacctcaggtgatctgccctcctcgccctcccaaagtgttgggattacaggtgtgagccacagcacccagaccatttttaagtgcacagttcagtggtattacatacattcacagtgttgtataatcgtcaccaccatccatcttcagaactttatgcatcttgcaaaactaaaacctgcccccattaaacagcagcccccctcatcccctgcccccaacccctggcaacccctattctactgtccgtgcctatgaacctcactactctatgcacctcacatacgtggaaccacatggtatctgccctttcgtcgctggcgtctcttagcataacgtcctcaaggttcatcggtgttggggcacgtgtcgggattttatggtgtgtgaatgacgtctcagtttaaaatgttctagagttacccagtggtgatggatacacaactctgaatatgccaacaacttctgactggtacactttgagtgggtgattgtatggtctttgaattgtgtcaataaagctgtcatttaaaataaaataccaatccgtgctggcacagagaaggactgggagactccgggcagtgcgcaggcccctgtgtctaggagagtgaggggcctgctgacctcgtcccgggcaggcgtcccaagagtctaagttccaggccttaggtctccttacgtgggtcttgtgcgcatggctcaggtggagtggcgacctgaacagtcggcactgctacgtgaggacgagtgtggccccagatggaaggcctgagcggaggcagcagggatgagggtggcatgggtgttgttatgcactgatttatgttctcccttccaaaactccacaccaaagccctcacccccaggacctccgaatgtgtatttggaggtagggtccttaaggaggtagttaagttaaaataaattcatgagggggtaggtcctgatcccatatgactggtgtccttctaagaagaaattgggacacagacatgtacagagggacaactccgggaggactcagggagaaggtgccacccgcaaggcaaggagagaggcctcaatcggaaccagccctgcccacaccttgatcttggactcccagcctccgagacaagacaataaatgcctgtggttaagccaccggtctgcagtgcctcaggacacagacacaggtggtgatgaagccaggcgagaacattttgaatgcatctagggatagaatcggcaggacttgctgatggatccaatgcaggacaagtaggtgaccctgaggattttatttgagcaaatggtgcagtcaccagtcagacgggggacccccgggcaagcacagtgcagtttctttgcaggtgcatccatgaagggtgtgatgcctaccagacattcaggagctgcagccaggtgggcagcccacaggggagtctgggcttctgggaggaagatgcagagccgtcctggacagggcagcagcagcaccagccttcactggagccggggcctgcagcctccattggtggcacacccaggtgaggtcttcacactgcctacactaaagcaaatgaacaacaaaaatcatgagagacccttggatcagttttgcacgggagaagtcatttctttcttttctttttttttttttcaagatggggtctcactctgacacccaggctggagtgccgtggcgcgatctcagctcactgcaacttctgcctcccaggctcaagtgatgctcccacctcagcctcctgaagctggaaccacaggcatgcgccaccacacctagctgtttgtttgtttgttttggtagagacggggtttcgccgtgttgcccaggctggtctcaaactcctgagcacaagcgatctgggattacgagtcactgcgcagggtggggagaagtcatttctatgcgcctcggggaagcagtgtggacaaggcccgcagggccctgctcttgggctgattcccttgagggagagcctaatgtgtaagtgaaaaatgaaatgtgcaggagagccactggtcaagcagcagtgctggggcagcaggccctgtcggggatgccagcaggctcagagcacagccaggaggagccggcctccagacaaaagcacatttgctaaaataactttgagaaattttttaatgtttttcaaatttttaccgaaatttagaaaaatttcctctaaactttgcttaaaccgtgctaaaaagtggggacaagcctgaacaaaggcctgacaccagcaaaggtcagcgagcagtgcagaagaggcgggaaatattgccaggaggtggccaggcaaggagaggcgagggaggtccccagagcgtctccccacccccgattggacccaaggcactgggtagtttgccgagggcagtgcagccaccttgggccagggtcccagccgcttgccctctgtcaggagttgctttcttttttttttttttttttttttgagacggagtctcgctctgtcacccaggctgtagtgcagtggctccatctcggctcactgcaagctccgcctcccgggttcacgcgattctcctgcctcagcctcccgagtagctgggactacagttgcccgccaccacgcccggctgattttttgtatttttagtagagacggggtttcaccgtgttggccaggatggtctccatcgcctgacctcgtgatccacccgcctcggcctcccaaagtgctgggattacaggcgtgagccaccgcgcccggccaggagttgctttcttaggtatctccttggatcatgagtttcagcgaggaggggtcgtctgcacaggaaacacgccccggccgttggagactcgctgctgcccccacgaggcactgctcctttggagtgagctggccaagcacaacacagagcctgctccccaaactgggcgggacagcgccaggcctacagtcaccacggaatgtgctctctcactcagcgcctctcctggagcctgagatggctccattcagcactgcaatcctcccagcgaaccccagccaacccaaacagccttgtttgtgcggggctctgtttcccagtcaggatacagggcagcagggcgggaaggagcctcagcagctccccagcagcacacaccaccggcctggcttccctgctctgttcgggaatctcctcccccacaccccccgcagcccccagccccccaggaacacttccccagtgggctctagcctcacctacacagcccccaccagacccctgcgcccgtgtctcagaggctgtcacagagacaaccgatggccctgcccatcatccagctggtcacgccgatgcctcccccacctcccgcaccacatctggtgccacacagctgtgaccaggtgtgactgtacacagggatggcccccatcccctctccactgtcagtgccctggccccaggcctctgctgtgcctttggggagtcctcccactgcccactctgctgtccagagacagacaaatatacattatccagtctgtgacagagagataaaagattcactaaaattgtttaaaaggatgagattctgcagattgtatttttcaaagatggccacaacacttccttctatcccacatgctcttccagaaccctgatactatctgtgaatctcagtgatctcattcccttataaaccatagaatgccacagaactgatgctacagagctcctgaggctggggcgcaagagataatgcagcatctgccttgggtgccagagcactatgcacagagacttggggccaccatgctttcaacgttgccaggctagcccacctgcacagaggtagttgccaggctagcccacctgcacagaggtggttgccaggctagcccacctgcacagaggtggttgccaggctagcccacctgcacagaggtggttgccaggctagcccacctgcacagaggtggttgccaggctagtccacctgcacagaggtggttgccaagctagtccacctgcagagatagttgccaggctagtctacctgcagagatgatataagacttcatggaaagaaacatgtccagccagttgctccagctccagccactgtctgcctggaatggcatgaactacccagctaagatatcctgaattcctgacccccagaaaccatgatagatagtaagactaaattgctattttaagtcactaagttttgagttgttatgcagcaatagataatgttatgcagcatttcataacagaataaagtgcacagagagacccacaacatgtagccaattgattttcatcaaagatgaaattggcaattcaatggggaaagtcaaatattttaaacaaatagcactcaaactattggataaattgggaggatgaactttgacttctacctaacaccgtacgcaaaaactaattcaaggtggggcgcagtggctcaagcctgtaatcccagcactttggaaggccaaggcaggtggatcacttgaggccaggagttcgagaccggcctggccaacagggtgaaaccccgtctctactaaaatacaaaaaattagccgggggtggtggcacatgcctgtgatcccagctactcaggaggctgaggcatgagaatcacttgaacctggaaggcagaggtggcagtgagcagagatcgcaccactgcactccagcctgggtgacaaagtgagatcctatctcaaaaaaacaaaacaaaacaaaaactaattcaagataaaattatagtcctaaacataacaataaaactgcaaagcttctagaagaaacagaggagaatatatgtataagcttggagtcagtaggcaaagatttcttggaaaggacacaaaaagcatgaaatataaaatttttaaattgatacattggattatcaaaattataaacatctgtttctcaaaagataacattaaaatgaaaataattctggtgtggtgactcactcctgtaatcacagcattttgggaagccaaggtgggcagattgcttgagcccaggagtttgagagcagcctgggcaacatagcaagaccctgtctctacaaaaaatttaaaaattagctgagcatggtggtggacacttgtggtcctagctactggggaggctgaggtgggaggattgcctgagcctgggagtttgaggctacagtgagtgatgattgagccactgcactccagcctgggtgaccgagtaagatcctgtctcaaaaaagaaaaaaaaaaaaagaaagaaaagaaaagaaaaacaacgaccaaaagccattgtctcaagaaaatatttgcaaggggcatatctgacactgaactggtactcatattttttattattgatttgcagaagttctttatatattcaaagttataaaataggcagaattaatctgtgattatagaacacaggtcagtagtggcctggactggggtgggggtgggagggtgggaattgactgggaagggacacggaacactttccaagggtaatgaaaataggatcttgattggggttttggttacatgggtttatatatttgtcaaaattcattgaattgagaacttaagatgtgtgtatttctctgcatgtaaatttcacctcaataaaataatttaaaataaacaaaaagggaaatgggtatccaatctgcagcaagtaggttaaaataacaacgatagctatttcagttcctttgcctttccatataaattttagaatagtcttatgactatttgaatatccactaaaaaacctggcttatatttttatattttgatgtataggaatgtatttgggcataactgacatctttacaatactgagtcttctaatccatgaatatggtgtatctctttctttatttagatattctttggtttatttcatccacattttgttgctttcagcataaaaatcctacccatgttttgttagatttaacacctgagcactttactttttgagagattataaatgatactgcttttttctttttttctttttttctttttttttgagatggagtctctatctgtcacccaggctggagtgcagtggtgtgatgtcggctcactgcaagctccatctcctgggttcataccattctcctgcctcagcctcccaagtatctgggactacaggtgcccaccaccatgcctggctaattttttaaatatttttagtagagacggtgtttcaccatgttagccaggatggtcttgatctcctgacctcgtgatccgcccaccttggcctcccaaagtgctgggattacaggcatgagccactgcacccagcccaatgatactacatttttaaagaaatacaattgatttttaaaatttttttatttttattttttgtagagaaaagatctcgttatgttgaccaagctggtctcaatgtcccggcctcaaatgaccctcctgcctgagcctcccaaaggtctgggattacaggcatgaggcatcgagccacagttggtttttgtatgtcaatcttatattcttcaacttgctcaagtgagaagaaacaatctgcctgatctcaaggcctattccataattatggtatttaaaactatatgggattagcagaagggtggacacatagatcagtgaaacagtagagaactcagaaatagatccatataaacatgccctagtgatgttttaaaaataaattttattgtgtatatttgaggtttacaacatgataggtttttttggtttggggtttttggggtttttttttgaaacagggtctcactctgttgtccaggctggagtgcagtggtgcaatcacagctcactgtagcctcgaccttccaggctcaagtgatcctctccctcagcctcccagacagttggggctacaggtgtgcaccaccacgcccagctaatttttcatatatatatatatatatatatatattttttttttttttttttttttttgtagagatgggatttcaccatgtcacccaggctggtcttgaacttctgggctcaagcaattctcccacctcagcctcctaaagtgctgggagaacgggcgtgtccctagtgatttttgacagaagttcaaaagcaactcaatgaagaaaggatacaacaaatggtgctgaagcaaccggacatatatagatgtgttaggccattcttgtattgctataaaggaatatctgagactgggcaatatataaaggaatgaggtttaattggctcacagttctgcaggcttcacagaaagcatggtggtggcatctgttcagcttcttgggaggcctcaggaagctttcaaccatggctgacggtgaagggggtcaggcatttcacgtggcagagcaggagcaagagctaggggaggtgccaacacttctaaatgagtagatctcatgggaactcactcgcaatcacaagaacaccaccaaggggatggtggtaaaccaatcatgagaaatccacccccatgatccaaccatcacctcaaacactggggattacatttcaacatgagattttgtggggacacagagccaaaccatatcaataggcaaacaaaaacaaaaccagaaacctcaatctcacatcttatttaaaaatcgactcaaaatagaatgacaggccgggcacagtggctcatgcctgtaatcccagcactttggaaggccgaggtgggccaatcacctgaggtcaggagttcgagaccagcctgggcaacatggcgaaaccccgtctctactaaaaatacaaaaagtagctgagagtggtggtgggtgcctggctgaggcaggagaatctctggaacccaggaggcagaagttgcagtgagccgaggtcgtgccaccgcactccaggctgggtgacagagcaagactcaagaaagaaagaaagaaagagagagagagaggaaggaaggaaggaaggaaagaaggaaggaaggaaggaaaaagaaggaaagaaggaaggaaggagaaaagaaaagaaaagaaaagagatgccatctcaaaaaaaaaaaaggaataataaactgaagtttagaatgtaaaactataaaactttcagggaaaaaaatacaggagaataatctctaggatctagagctagggaatgagttattagacttgactcgaaaagcaggagccataaaaagaaaaattgataaactggactccattaaaattaaaacttttgctctgtgaaaatttctctgttaaaagtggttctgttacaagaatgaaaaatcaagctacagactaggagaaaacagttgcaaaagatatatccaagaaagggctagtactagaatatataaagaactcaggctgggcgcagtggcgcatgcctgtaatcccaccaatttgggaggccaaggcaggcagattacttgaggccaggagttcgagaccagcatggccaacatggcaaaacccatccctactaaaaatacaaaagaaaaaaaaaattagccaggcgtggtggcacccatctgtagttccagctactcaggtggctgaagcacaagaatcacttgaacccaagaggtggaagttgcagtgagtcgagatcatgccactgcactccagcctgggcgtcagagcaagactccgtctcaacaaaaacaacaacaaaaaaaccctctcaaactcaacaataataaaaatccaattagaacatggacatgagacatgaatagacatttcaccaaagaggatacacaggtaacaaataagcacatgaaaaatacatcattaatcattaaggaaatgcaaattaaaaccacagtgatatcactatacatctattagagtggcaaaaaaagcctggacacagtggctcatgcctgtaatcccaacaattcgggaggccgaggcagaaggatcgcttgagtcgaggaagtggagctttggtgagctgcgatttcaccactgcactctagcctgggtgacagagtgagaccctgtctaaaatatatatataatttttttaattaaaaaaaaatggccaaaaaaggtgatactgttaaatgctggtaagaatttggggaaactagagcactcatatactgctagtgggaatgtaaaatggtacagcttctctaaaaagcagtttggcagtttcctttttttttgagtcagagtctcgctctgtcacccaggctggagtacaatggcgccatctcggctcactgcaacctctgcctcccgggttcaagcaattctcctgcctcagcctcccaagtagctgggactacagatgcatgccagcacacctggctaatttttgtatttttagtacagaactacttggcaataaaagagaaagctatcaacacacagtaacctggattaatctccagagaattatgccaagtgaaaaaagccaattctaaaacttcccacactgcatgattccatcaacgtgacattcaaaaaatgccaaaatcatggaagcggtgattgagagactcaggaggggaggagagtggaaaccgggcatggctgtcaaagggtgatgggaatgttctgtgcctcaccttgatcaacgacaacatctagcttgtagtattatgatattataatacagtgtttcaagatggcatcattggggaaaactgggtgaagggcacctggactctctttgcattgtttcttatgctgtatctcaaaataacaggtttcattttaaaaatatacaaacccttgtgactaatttaatcgacgtatcctactagagatacttttctggggagccgtggggagcctaccacacccctccttgtggctccattagcctcttctcacttagaccagggatgatggtgaggtggtgccaaggaacgtggtgggtgcagctcttactccaaagtcagcgaggagcaaggaggaggtgtttgcgctgtcacttcagcagtgaccagattgcagacagggaggcaggtaagactaggacttgaattgtgtgtggtcgagacgaggagttgaagagttaaatcctcatcctctggaatggtaagtcaacacacagtgctaaaactatttgccatggaaatgtctcccaccgtgaaagtgttcatacgcttctgttttgttttgttttgttttgagacagggtctctctttgccacccagactggagttcagcatgatcctggttcactgcagcccctatctcctcctgggctaagcagtcccctgacctcagcctcccaagcagctgggattacaggcacacaccacagtgctgggctaattttttgtattttttatagagacagggtatcgccatgttgcctaggctgtctcaaactcctgagctcaagtgatctgcctgcctcggcctcccgaagtgctgggattacaggcgtgagccaccagcgcccggcttccctctgtattttaatagtcttcagcatgatgttggccctgtaataaatatctagacaccaatgtctctctatataaagatatggatagactgataatatcatagataaaacgatattttatgattaattattattattattattttttgagacagagtcttgctctgtcccccaggctggagtgcaatggcgcaatctcggctcactgcaacctccacctcctgggttcaagtgattctcctgcctcagcctccccagtggctgggattacaggtgtgcgccacaacgcctagctaatttttgtatttttagtagagatggggtttcaccatgatggccaggctgatctcaaactcctgacctcaagtgatccacctgcctcggcctccaaaagtgttgggattataggtgtgagccactgcgcccgactgattaatttttaaaaatcacagtgggtagctagtatttgtggagccccttctctgaggccccgtggtcccatctggacctcgctgcactggggagccaccttccactgttgtcccactgtacggatgaggagcccaagctctggtccaggtgtgagcaagtgacaaggagccaaggagcccttcccttcacaggtgcttccctgcaggtggggtggccaggtgtcctcagaccgggtggctctccctcagggaccggggtggggcaggaaggaggaaggagttgttgcgcattcggcacaacccatgcctgctctgctgccagccgcgtggaagcttgattgccatacagcacagactgctgcctttctatgttgctgactgtttttaaagaggggttttgggaggggtggtatgaaattgattgtttctctctttcctcattactgttcgcacctattttgggtgttttgtttttccctgtgcttcctgtcctctgtgcactagggaagcctctcaaatggcaacagaaagtggttggtttctttgaagagcatttgaactgagtgaattttcaaaaagcgtggcattgacagaacaatgaaagtcccaggataaagtccaggccagttgccatgacagacggcatctgttgttgacagaaacatggagccaggctgaaactccggcggcaggagggctgcgcacctgggcagggcagtgccgagcacagctcccagtttgggtagccagtgggactgggtctggtaccagccttgatttcggactggagcagagtcacccagttgtgcctctgttttgttttctgtggagcagtggggggcccaccacacccctcctcgtggcttcattagcctcttcttgcctgaaccagggataatggtgaggtgatgccaaggaacatggtggatgcagctctgcctccagagtcagccagcagcaagaacgagccatgcaccatcactgctgcagtgaccggactgcaccccgcagagctctgatcgcctctctgggggctgccgtaagaaaacacctgggtggtctcagaccccagcactcgggtggctcctctgaaagagatgttgttcccgactcccagcctgtgggtagagaaggtgccaaccccacgagagtctccaggccctgggcctgcttggacctaatctgcttacagttcatgcaggttctctatccaggccttgccctcctcccagctgtttcctagtctccttcatcctgcaggagctgcttttggtctcactgtactttgttgagtaggaggcatagcagccttgagagctagaagggtccccagccatcacctgggccaagtcccgccgtggacaggtgagtgtctactgttttgtaggggcagagactcagcccagggtcccacgggctgctagcactggcgtgaggcagaccattcacctttgccgctgcacgggtcatatcctcccctctcagccaacgtgctggcccagcctggactggcccagcccctcttccctgcttctggggtcctgttcaccccacgagccctctctccagctcttcttggataaagccccatgcccaacatggtcccaggcaccggcttttggggcagtcctgggatcgccagcagatggagctcaagggggtcatgcagaccccacccaggcctggctcccaggggctcccaggagggaacttcctacccattgaaatgcaaacgctggaattccaagaagcacttcagatacatacaagtcctgattgtgtttgattcctcctctggatggaaggcttccctctctgaagtcagacgacaaagcagaggcctgggactggtggtataacccagagaccctgcctgcctggcactggtggtacagcctgggaccctgcctgcctggcaccggtggtgtagccagggaccctgcctgcttggcactggcagtgtaacccagggaccctgtctgcctggcactggtggtgtagccggggaccctgcctgtgtaccctctgtccaagtcttggggtgcccctgtattgtggtttgaatgtttgtctccacaaattcatatggtgaaaccctaccctccaggtgatcgtactagaaggtggggcctttgggaggtgattaggtcacgagggtggagccgcatgaaaaggattggtgcccttataaaagaagactggaggccgggcgcagtggctcatgcctgtaatcccaacactttcggaggctgaggtgggtggatcatttgaggtcaggagttcgagaccagcctggccaacatggtgaaaccccatctctactaaaaatacaaaaattagctgggcatggtggcaggcacctgtagtcccagctactcgggaggctgaggcaggagaatcacttgaacctgggaggcagaggttacagtgagctgagatcgtgccactgcactccagcctgggagacaaagcaagactctgtcttaatcaatcaatcaatcaatcaataaaagaagaagcctggggtcagacacagtggctcaagcctataatcccagcactttgggaggcccaggtgggaggatcacttgagcccaggagttcaagaccagcatgggctacaaagagagatctcgtctctacaaaaaatattttaaaaattagccagatgtggtggtgtgtgtctgtagtcccagctactccggaagttgagatgggaagattccttgagccagggagattgaggctgtagtgagctgtgattgggccactgcactccagcctgggcaacaaagtgagactctgccactacaaaaataaaaataaataataacaataataataaaagagggtccgagagatacccttcaccccttccaccatgtgaaattatagagaaaatatgatcatctatgaagtgggctccactctctccagacgccaaatctgctggtgcctcgatcttggacttccagcctccagagccgtgagaaataaatgtttattgcttaagccctgcagtctaaggagttgtgtcatagcagcccaaacagactatgacaccctgtattcgtttgctgaggttgctgcaacaaggtcccaccaactgggttgcttaaatgaggcggtaatgatggagggcgttcagcctgcactcagaaaggtctttgcagatggctggaggccctggagcctggaaggaggtggatctcaggaatttcacccacacacacacacatatctctggccaaatcaagttctttgcccatttttgaatcagactgtcttgttgatgatgatagtaggctctctttgtgattctcaaaaataacctcgaggatcagggcagccaagacagtcccctgaggcacaagtggggcatgggcccctgccccatgctgcaagatgactgggccctggcatgggacaggggcttctgaggatgcaggggtctgtagttggacccttggtttgaccagtgtctgtcacagtgtctgtctgggagtcacgggcccagaccctgggccagaggtcgggcaaggctttgcaggctgttttggtagcaaggcccaaacctggccaattgcatgctggccctgcaccagaagaaggagacctgcccaacaaggccctcacccaggccgagcccctgtgcatcagccctgcctccctcaccccacctgccgtggccagcacctgcccagggcccctctgctgggctccaggtactcccccgaactctaagccagcactcgaggcccagccccgctttcctggctatgcaggcttgtggcatgttgatcccccaacgtgaagccccaaggaaagagggtctctgccaccactccgggtgtatggggtcttctgatctgtgccgctgtgagatttgcggctggcagctgcagtgcagaccagaggtacgagtcctgccctcaccagtgccctccgcctgcaccccttgctggttgggaagtcctagagggaggactgggtggcacgctggcactgtcctgccaagagggccacacgcagctgctcaccaggcgagagggggcaggactcactcaagacgggcctgcagctgaatggctgtgaagatccctggctgcagaacgagcccttcggcaagagccccggggaggggacagagtaactcctttgccctgcaaggccccgcttgggtctccccaggttcagctcccaggtgcacctgatcatgcttccttctttggctgaaacctgctcggccacctctgaggggatgctggtcaaagcatgcagggttgagggctgagcctcgtacctcctgcctgcttttccggtgaggacaaggggcccctcctttcctgcaaaagcagcccctgtcttaggggctctgtctcctgctgctcccccatctctaggggaccctaaaagcctccaccactttaaaggcagcctttggaacaaggaggggcaggaatccacttcagtccaggacgtgacagccggctggccactggccacggaggtccagcgacatgctttccccagtcaagtggaaggactttggcggcatcctggtacagggtgtgtctgtctccaccaacggggaatcccctgctcagggctgatcatggctccagcctacaatgggtgcaacacatgcttgatgggaaatggggtccaacctggggcaaatgaggagcagggcagagctgccaccacgccctgcaagtgggagcaggagccctcacgcaggctggccccgctctgccaatggccctggccatggcacccggggatggcagctcctcaccctcctgacccacaccatccgcccccgcagcaatgtgtgctgtgcattctggggcaggcagagctctggctgtcctccatgggagaggcggcctctgtggcgttcagtccggggggctggagaggacacaatggcagggaatgagctgagactggggtcctcatcctcacccaggtatggccatcacctgaggcctcgaaaccaggtgatgggccgccaagttgagggctctggcaaccaccttccccgtgggagcctgggtgtgcaacaggcagtgcatttgcacgcagcaccagggtccagggaacagaggtcctgaagacgggacagtagggtcctgtttattccagagtgattttcagatctctcttgcctgactgggaggtagatgcagtggggagctggagccagtccctggagcccagcgctgagctctttgtgatggaggggtggggtgagccgcaggatctaggtcaccgtgctctggccctgctctctgcctttcgcaagcgcttgctcccgtgggatgtttgtcatgcttccatgcatgacacaggagaatatcaacattggtgccatttcacatctcttcattcatctgctattcttccaccttcagcttctcataaaatcacagaactgcagtgaggacctctgcctgccgggacagcctggggatggtcccgtgcagccccctcaggcagcatccctgtggagggttcccctccgccccctaccgtggggagctcttcccagctgagtcacactgcacgcctggtccctaccctgggctgctctctgtgttatcttgcaggcgccgtcccagatccttcaggggactctgaaggcccatcagatgtggctgcagacccacctccctcagaccctcagctctggatccaggctggctccctgccgtggagcacaggcgccctttgtagcactcactccagctgcccagggaatcggggacttggtgtggactgagactcagcccccttgaagccctattctgtccaccgctgcaagacataggcggctttaagcaggaccaggccgcaccctccaggcagagacagctgctgtgggttctgtgctcttctaatgggcatgtcttcccatcggtgatgaggactgatttgtgcagtgacccccttacatttttctgaaaaggagatcaaggaaaacattcttcagtagaatcctcactgtgcacacacttccccttgtgctcggtgacagccactgcctttgggagcagggaggacgccccagaacctcctggtctccgcacacccccctgagctgggctgagcacacaagcacccctctgcagacagtagaggttttgggattcagaatatgcagtctgaagctccccagagcctggctctttagtcaggccctccttgcccgccctgtgaatccacgcctaggagcctgtgcccccacccagcaggagctgatgctgctgagcttcccaggtgccagacaggggctgagtgtgggggccagggagccagtcgggagtctgctgcctggcaggccatgtcctgcagaagagaggccagcatagggcacggtgggcctggaggggctggagacagtgctgctgggtcggcagagctagagaagggcagcccaggcagggggcacactagtgccaaggtgcaggggcatgaagctgcaggtcacacggcctccctcggagcccccaggtactgggggtgggttcaaatctcacagggttggcgggcgagggcttcaggaacagcagggacaggagcatgagagcagtagaaaaatgcaggggtcaggaggatcatctgggacccaccaggttgctggtgaattcaggggatagaagggatgtgagctcaggcctcgagcagctgcctgattgggacagcccctggctgggccgcgaccaggtcacagcactttgcaggagtcaggcctgggctccacggtcgtgggttctagtctcggctgtttagtctcaagcagatctccaccgcgccctgacctccacttcctgcgtctactcagggtgaaaaaacaccccattcccagcacaggtcagggttgcccgagttgatcatgcaggtaggcctgtggggctctcaggtgcctgacaccctgcatgcatcttggcctcttccctcatcctcagcctcagatggactgagccatctggaacctgtcagtggtggcctcagccctaactgcagatgacaggcttgggagtgtggcgacatgtgtcacctggagcaaactgctccccctctgaagcctgtcacccacaagacctgctcccaagggccaatggcaggtgccttattctttcgtcgccatcaccgttgccacctccccaccagctccatccttctccgggtcccagccctggggcgctcactcccctgtgtgctgagggaggcccagcatggttcaaatgcagcctctggagaatttcttcactaagaggctttttctgaaaagagtcaagctatttgtagcccaagttggttgaacagatttttcttggtgtagcttatttttttattcattaacttcttttccttatgaattaaaaaatagcatttttttttccacaaaggagtgctttatttacttctttttgtaccacagccagcgcttcctctgcctgctggggaaagtggatgcacacacccactttggcaggcagttttctttcaagccatggcatcttggagaggtaagtgtgtgtgttcagaccactgccctgtggctccagcccccctgatatcagccacagccccaaggcttgggtgttgtttgtttgttttttcattttttttgagacaaggtctcactctgttgcccaggctggagtgcagtggcaccatcacggctcactgcatgcagcctcaaactcccaggctcaagtgagcctctggcctcagcctcctgagtagctgagactacagactcatgccaccacagccagttttttttttttaatttttaatttttatagaaacggggtctcacattcttgcccagactggtctcaaactcttggcctcaagtcatcctcccaccttggccaccgaaagtgctacaatgataggcgtgagccaccaggcctgcctggttggctttttggtgaacaggagcataataagggtttcactgggctgtcagcctccattgtggtggccagtatctcaaagcctcacctggcagaactggagacgcgtctgctgaccgatgccctcatgacccattttcctgacttcagaaatgtcccatgcagacactatgccatccagcaggcctcccagctagacagggtgcagcctcgatgtgtctgtggagggactcgggctgtccctgcactcacagtcatggtgaccaaagtcccagagtaagggagcagatgccgcttcccccttccagcccaggcattttacatgaggcgctgacccaggaccacccttgacttcactcttccaaggagtggctcccagtcctatatattccatcagcctccaggctggctgtcccttaaacactggtctccaatctaactgcatttctgtaagtaatcttttgggacagacttttttaaaaaagatcatgtttatgccgtattcctcatctttcttgtcttctatctccagatttgttttaaaacctattactcctgtatacatgtgcctcccaccctttgagctatgcccttgacctgctatgcacttgtctcaaggccaagttcaaaccccctaacccaaggctgtccagagctgccctgccacctgagccatggggaggggcgctgagctggtgcctttcacaggctgcctgcctccccctgggcagggctcctgtctctcctcctttgtctccacaagcacaggcttgcatgggtcagcacgtggtgaacagccaaccatcattttccaattctttccaaaaagtcctgtctatgctcagaagtcctgcctggccctttgagtgcccctacccccacacacacattcttttttttttttttttttttttttttttgagacggagtctggctctttggctcaggctggagtggagtgcagtggtgcgatctcggctcactgcaacctccgccttctgagttcaagtgattctcctgcctcagtctcctgaatagctgggactacaggcatgtgccaccatgcctagctaattttttgtatttttaatagacggggtttcaccgtgttagccaggatggtcttgatctcctgacctcaacacacatttctttatcgaaattccaaattctccaaagctcagaaacataaaggtttttcaaaactcagtggcaaagctggacctgaacgatgcgccatcacttactgtctttatttcttccagttcacctgaatacatatgttttgccccgaaaatataaatgggtctgattatgaggagcagccccaggttccaaagaggtgccacataatgtatgatgtatacaaaaaagcctgagttccaaacacatcttggatgagaggttgggactgtgggggatccctacactggttagagttctagacccagagcagggttatggtcaacggcgctctggccacagaatgcagcagagcaaggactgtggaacaaagacgcggcttacatgaatttttcacttaccgtgctgggtgctggtgattcagagatggaaaggccctagcgacacccccctccacccagggagcccacgggccagcagagggaccaaggggcacaggacgggtggggagcagaggcggattccctggctgtggaggtactgtctatacggggtgcaggagacatctccatacaagggggccctcacctggggaggtggtgaccgcaagcctgacagccccaaagccttcagagatgccgcctggggacactttgggaaagtccaggcggaggacacctgggaatgtgatagtgacacaaatgaccggagagacttgctctcagtcactgagtctggctgactcactgaagattagggcctgaacttccccctctgtaaatggggtgcaggccctggccctgccttcacagtgcccctcggtcccctacaagccttctccgcagggtgggatcgggtctgcctggagcatccccacagcctatgggtcagcagagaagcaggcgcagagctggggtgagacggtcagggccggtcctgccagacacctcagatcactcctcttcacaaataatcccattttacagcccaggaagagagaggccggaccactgcccaaaagcctgtggcctacagcctgccaggtgcgtctgctcgcagagcaggtctgcgcagcaccgagcggtcagcaggggcaatgctgggcactggccagccgcgccaggaccatccctgctgacctcggcggggtggggcggagcgtgcagggtctggcccggaaagccagggcaggctttagagaagggccaccggacggatggtccgaggaccggcatggacccgggtcccagcgagggcggggggagcgtaaggctgggcctgggctgcggcaccggggaggtggcggggaggaggccggcaggaacagccgtgcagggcgggggcggcgcgggtctggtcgggtgaccccgggcgcggccagggctgtaggaggcgagggcgtcgccccgaggccgtggtctcgggtccatggtgggggacctgggtccccgcccccccgggccgccctgggtcgcgcgtgggcgcggcgggcgccgattggctgccgggcgcgcgggcggagcgggcggcggcggcggcggcgcggaggggccgctcaccccgcagcccggcctcggcctccgccgcttgtcgtcgcgccccgcccgcgagcccgccccgcacgtcccccgccggcggccaccatgagcacaggcctgcggtacaagagcaagctggcgaccccaggtgagcccagcgcctgcccgcgtgcccgcgcgcgcctttgtccccgccgcccgcgcgcctctcaccgtgtctctccgtctctcccccgcccgccggcccggacccgctcggaaccggacccggactcgaccccgaccccgaccccgcagaggacaagcaggtacgtgcgcagcgccgctcccccgccgggagacccggccggctgtcacccattgtgacactagcgccttgggcgcccaggcgcgaccccgcccccgccggccctcacccagccctgtcgcgatcaccgattgtcagccgggcagtgccgccgcgcctggggcttcagaggagaggagtgggggccctggtccccggacccgcacagcagggaccctgcgcccctccccaggatggggggatgggcagagtgtccccctcccacagggccagtgccagcatctcctgctgacctggcctgtaggccatgagctgggggtcctgggtgaggccatggtcgtggcaggccacgctgggggaggggagtcaggctccatcagccagcacagtccctgaacagccctacagcagagggcctgtggtcaccacccacctcccctgcaccttcatgcccctttccctccccatacacaaatttgagtgttcaggtctgcaacagggactcttccccagattgggaacccccagggtctggtctgagtcattctgggtgcccagatgggtcctgggaccctgtgggtacaaataggcttgtggcttctcaaaagggttggccccaccctccaggaaagcaagactggacaggaggctggtctaggcacctgggtgaaacccagccgagctcagggttaaacaatgctgtgaggcccctggggtggggcgggggctgacaaccaggtgggctgggggggctggggaaagcctgctggtgtcctctctggcttgagctcagccatctttggaggaaaaaagaagagcccaattctggcaccagggtggcactggcagcccccatcagggatggagtttctcaggagccatggatgctgagtggaactccagagtcctggcccagggtgcagcaggcagggcaggagggcgggcaggggggccaggagctgggggagtcactggctgaccagtgccattctcctggaagggacacaccccacccagaggtggatgaggctctctgggaggggccccttggggagccaggctgggagctgcctccccatcacagcaggtcagacaaagcctgagatgcagggacacatgcgtcaggctactgtttgagggaaatggaaggaactgaggctgggaaagccaggaggccaggcccctgaggcttctcctgtgcctgcaggtgtccccagcttgacccaagggcactctgagaccctgggctccagccactgctgttgggtgcagccaggttctcttgcccattactgcagggtggggaccccctcctgctgaggtgcccatcgtttgaggtcaaccgggagtccacctcaccccatcccaggcctcccaggcctccaagcccagaggaagaaggcactgtgtggccaaggaagggagccccggagcaggagccaggccaggtgtctgggtgaccagtgggtctgggggagctggaagcacatggcagcttccctgctaccaccgttgctgagcctcagcctgtccaagcattctttttgctctttgaaagggggctgtagaggcattgggggagttccgtcactacgctctgtgcccccacctcctcacaggcagcaccggtgatctcttggccctggctgctgctcccagagctgactcgggtgattctaagaatggaagtgccagagaggctcaggcattgggaggagatgggcgcagctgtgtcatatggctcaggaagccctgggagtatcttttgtcacttggggaccagagaaagggggtggcaggtacggccccttccttgaggctcccccagggaatccacaggccctgactgggccccagtgggtggcagggcaggtgggttgaacgctgagagtgagattcttgccctcctgacctgggcctccccagaggctgtgccttaccaatggggaaactgaggcaggcagtctgagagccacacactctgttagacacctcctagcctgaggcctaggcccagggctgtctgtcttcctggagatgccctgggcctgagatgccagcctgtctgggtgggtgctgggcttcgaggtgtggaccctcagttggaaactgggtgggactcagcctagaggcttcctgcaggtcagggccatggaaggctggggccagtgaggaggctttctggcagcaaggactgagggatgcactggtagagctggggggcctggagctgccccctttccctgggatgaaaggctctcctgttcccagctgtgggcctgcccctcctccccaggtgccagtggtccaggccccacaacaggaccagggcctggacaggaagtggaggaggtctctcagccaggagagcctaagggagggctggtggcgggtggggtggggtggggttggggcctccagcttctaatgttctaatgtgcaggggcttggcctgaccagtcctaccctggaacctttccaggccccatgtcctgctccgctgggcttgcctgttgggattctactggggtcatggaggtgggtggcccacagagcggagctcgggagacccccgcagtccctggagtagccacatgggagggaggcccggctggcaggagctcccagtccctccaatcctgtgggtcagagctggtgaggatgctcagagggcaagggaatgtccacagaagcacgtgggagatgggtcccatcccacccccacccctgtctctgagggcagggccacctgagggctgcagggcagcgcatgggtggccggcgtttattcagcaggctggcgggggcttccaagttttgcagggacctccagtactccggcagcctgcacccttcctttcccttcccttcccttctgtccaccctaagcctcctaggggacaggcaggctggacttcagaaaaggtgggctctgccctcctccggtcccccgaatgtcttgggaaagagtccaccaaacacacatgcacacacccgcgcacacgcacatacccaatgcatgcacacacgtacacacacacgcatacacgcatgtatacacgcgcacacacgcaggcattacacacacacacattacacacacacacccgcacggacgcgcacacacaaacgcgcgcacgcacgcacgcacgcacgggggaggtcagccccaagcagggctggggaggggtgcagggcgcggcgtgtctgtgggcacttggggcgtcgagacgccgccgggaggttttcgggcaagtctgcgagaagacggcgggccctgaactgggcgggtacccgcgctgttgcgcgtgggtcccgggagcggcctccggcgccctctggcgggcggaagccgcgcagcacctcttgggggcgggacgcgcggtggctaccgactcccggcccgccccggcccgcgtgcaggacccggtcgtcccctcctgctgtcctggagcccggactgaggccccgggggcgcggcagggctcccggtccacgcgagccatggcccgaccgcgcctcggctcagccctgccctccgcagccgctttcgggtggctccgcccgcggcccaatttccaggcgaccgtttcccggcgacggcgggcggggccgtctctgccgccccccgccgcgcgctccgcgggcgcctgcgacgccccgcctctggctcgggtgcgggagcggggcctgcccggactgcgacgccgccacagcttggggccagttcgcccagtcagggggatggctcggtcggcctcgggggtcgacgatcccccgggtaggcgacgtgccctgtccaggcctcacttcccgcgtccgcaaaacggggtggacaacgcagcctaaggcagagccgcgccaaggtccctcgctgtcgccgggctctggcggcctgaccgggcctggggtccgagcgtgcccccgggcctgggggggtcgccgcgatggactcgctggcagcgccccaggaccgcctggtggagcagctgctgtcgccgcggacccaggcccagaggcggctcaaggtgcgtgtgtggagagggcggaacgtgggtctgtgaccccgcgggctccgggactcggcatggggtccccgtccccgcgcgccacggcccgccagcgcctaggctcagcccttccctccgcagcggcctcgcaggtccgcggccccacggtggggcgacgtgccctgtccaggcctcacctcacgcgactccaaaacgcggcggagaatgcggccgtgggacccctccaggggccccaagggtctgcgggggctgggcgcctgggcgcgcgggcgggggaggctcggcgccgcggtctataaataggcgctgctccgccaccgccgctgccgccgcccccgcggctggatccgggccaggtggggcctcccgccccctggcactctccggaggggtgagtgtcgaggcccccagcttctccggcttatggagggccttgagtgtgtcccaggggtcccaatcctgctgccctctgcccgaggagggaggacatcgcctgtgcctgctgcggcctgacatctccccacggaataaatacagtgtcggtccctgcagagccctccctgggattggggccaggggtgccttctcctgccaccacctcgcctgccttcttatctccaggcttttgcccacgggccctccccttatttttgccaacgaaatgccccaccctgggaaccgtaccctctgctgtctcctcataccgcatttggtaagagacagggtattgggcttctggagaaacctttgtgtccctaccctgttccatcctgtccccaggacattgacaagcagtacgtgggcttcgccacactgcccaaccaggtgcaccgcaagtcggtgaagaaaggctttgacttcacactcatggtggctggtgagtgggccaggctcctcgggggagtggctggggtcactggccagccaagctctgtcgttggagccccagacctaacgcagctccttctctgtacctgtgtgcaggtgagtcaggcctggggaagtccacactggtccacagcctcttcctgacagacttgtacaaggaccggaagctgctcagtgctgagggtgagtggcccccaggaggccctggcactgatccccagtccccttccatgggacctctccaaggactccctttcaggtccagctcccactgttctgttctcgcggtgtgggtcccctgggggtagggccaaggcaccaagatggatgaggacgagggtcctggctgccaagggtgaggggctgagggttggagaggcccttccagtggccccttccccgtagagcgcatcagccagacggtagagattctaaaacacacggtggacattgaggagaagggagtcaagctgaagctcaccatcgtggacacgccgggattcggggacgctgtcaacaacaccgagtggtgagtgaggcctgctgagaaaggccttgcctaggcggccacagcactcgaggcctggcctcacctccctcctgcccacagctggaagcccatcaccgactatgtggaccagcagtttgagcagtacttccgtgatgagagcggcctcaaccgaaagaacatccaagacaaccgagtgcactgctgcctatacttcatctcccccttcgggcatgggtgtgtggctgtcctggggccaggctcgggagtgcagcccctacaatatggccccctggctgtgcctatgcccacccttggctgctctcggcaggctgcggccagtggatgtgggtttcatgaaggcattgcatgagaaggtcaacatcgtgcctctcatcgccaaagctgactgtcttgtccccagtgagatccggaagctgaaggagcgggtgagcctgccgtcgcacaggggcctggccagggccctggggctgagagtaccagggggacttgtctggcctcaaatctgatggtccttgccccaccacagatccgggaggagattgacaagtttgggatccatgtataccagttccctgagtgtgactcggacgaggatgaggacttcaagcagcaggaccgggaactgaaggtgaacatgcagactggtggggcaggggggatggagctggtgaggggcagaaccagagggctttgtctccttcacattgagcctgctggaggagggccaggtcagcccagttgggtgcaagagtcatttgttctaggagtagaggacctgtacccccttcatccagggctagaaggtaaaggtcaccatgtctttgcctggctggggtgggtcatgtgggccccgtgtggtgcttggcaggtatggagcacttgcccagatccagaggtgcagcagtgggccaggcccccaaccccaaccctcttcccatgggtcaccagaggaaggggctgccccagtggcacaccctggctcccagatttctgagctccagggttggtggctttgggtgccccggcagctagagtgatgatggagaccatgccaggggcaggtggccaccagggcaggggcatcagcatggggagacataggctcagccctggggagggaaggggcagctggagggggtggttcttgatgagggaggagatgaggagggagcatgcctggttgggcatagcctggaaaggccctggaatgtgagccacatgggctctggctccagccaggggcagagaggccagaaaggggcaacgccaggatctctttgaggagagatagttgatggtgatgctggaggggtgccccgggagttacatgcccgtttcccatcagtaaccgtgcaattacgctcaccgggtgtgagcctttctccctccttcccccaggagagcgcgcccttcgccgttataggcagcaacacggtggtggaggccaaggggcagcgggtccggggccgactgtacccctgggggatcgtggagggtgagtagagtcttggggtaccaggtctggtgggggaaggctgtcctgggccggcgccagcccactacccacccccaccccgcagtggagaaccaggcgcattgcgacttcgtgaagctgcgcaacatgctcatccgcacgcatatgcacgacctcaaggacgtgacgtgcgacgtgcactacgagaactaccgcgcgcactgcatccagcagatgaccaggtgcgcgccccagccgcgagccagacctcgcccctctggccccgcccacgtctccataactgagggccggtcctgtcagcccacccagacttgaactttgcaccattccctaagccccccccctcccccagagcctggtctccctagaaccaagtccagggctgtgagggctccggagggcagggcctcagcagtggcggggatgggccaggcatcgccagcccacgctgagcctcccggtggcgccgccccgcccatcctcccccccgccccgcgcagcaaactgacccaggacagccgcatggagagccccatcccgatcctgccgctgcccaccccggacgccgagactgagaagcttatcaggatgaaggatgaggaagtatgtggggcggcgggggcggcggaggcgggcgtcagggatgctcctccgcggtgctgctcacccgccgggttgtctccgcccgcagctgaggcgcatgcaggagatgctgcagaggatgaagcagcagatgcaggaccagtgacgctcgccgcggacacaccgtccgtctccgggacgccctcgcacccctggacaccagaccggactgttcccgacccggagacgcggggccacagcccccagctgaccctaatttattctcagcaccaccccctcccaggtcattgtgtctgtttccgaggggcctggaccgtagcccccgcccagctggccctctctgaccttgggggatcaggagcgaagttgggcgggacttcagagatccgcctcccttgcccttcccccgcccccggacggtcacagcacccaaaccgcaggccctgctctggcaggcaggcaaagctaggcagaagaggattcccaggatcctgggtctgttccctgccccagtgctgcagaacggacttgggagccctcctttgcctgctcccgcgggtcacccagcgagtgctgagaccccattttctgtcgaggcgggccgagtcttcccttatccccagacgcctagcgggcagggttgggctgaatcaaatgggagccctccagacataaggaggccagaggctgcaaggagcggggtcgtgaccgcttacaccccttctccacagcccggcccgacctggagggcccccggggcactgggcggtgagccacctcctggcaactctcggtgccgtcccctgccctcgctcgaggcctcttctccccagcaccgctgtggtgtgccgggatcctgagcctaggcctcccgatgttcccacccgcatgatcccttcccgccacacgatgctccgttttcttccgttgtgaatgccgcgtcctgtcctggtgacaggagaacaatgttggtgaacgtcgcagcgggtgtccgagtgctccgtgtgcccctgagagcgggtgggagcggaagcctgagcggcctgcggcctccggcgatagtgtgctatctgccgctgcagcgcgcgtccgcgcggcctctgggctatttctggccaggccgcagcactgtggtcggtgcgggcgtggcaggggcggggcggccttatcgctcggctctcccgcctacgcctcccgctgcagagtaagccgggctgccgtcttctcgccatgggctccggtgagtctggagtccggtcgggcccccggctgctccctaggccgacccgggttgagaggagctctggtcgtttggctgcagctgggagagacttgggtcagacttagaggggacttccagccggcgtgcggggtggtcagggtggagaggctggcgggctaccgggacgccgggcatcaggggctggatggagccgggccggcagtctgggtactcagagatgtcgcccaggtgcccgccgaccgctcggcttactgcggcgcttcccttgcagggccgcgcggggcgctgagcttactgctcctgctgctggccccgccgagccgcccggccgcaggttgcccggcgccctgtagctgcgcggggacgctcgtggactgcgggcgccgcgggctgacttgggcctcgctgccgaccgccttccctgtcgacacaaccgagctggtgctgaccggcaacaacctgacggcgctgccgccggggctgctggacgcgctgcccgcgctgcgcaccgcacacctgggcgccaacccctggcgctgcgactgccgccttgtgccgctgcgcgcctggctggccggccgccccgagcgtgcgccctaccgcgacctgcgttgcgtggcgcccccagcgctgcgcggccgcctgctgccctatctggccgaggacgagctgcgcgccgcttgcgctcccggcccgctctgctggggggcgctggcggcgcagcttgcgctgctgggccttgggctgctgcacgcgttgctgctggtgctgctgctgtgccgcctgcggaggctgcgggcccgggcccgcgctcgcgccgcagcccggctgtcgctgaccgacccgctggtggccgagcgagccggaaccgacgagtcctgaggagagaaccggtgcgtcctgaggagagaaccggcgctgggcaacacgggcctgcaaactcgacaggaccctgcccgaggggccctcgcgccaacctggaccggtccccgcctcctccgctgcccaatctctcagacccaccccacctgcaggcccagaccacgtgggacagaactcctgcccaccctaccccgagggaggcgaacccgcacttccaggcttgggaggaccatggggcacaatgcggtccagaccctgctgcgtctcccttccaaactctggtgctgaataaacccttctgatctggtcttctctgcacgactgacctggaaattcccctcgccaaactcaggaaaaggccccaggaggcggttcaaggggacacaaacacatcctcacatgcccaccctaacctcaggggcagacaggagtcagtgggtgacctctccccttccagacacactcccaaaaggccacatgggaaggcatgagagagatgctaagtgataacgtgggggccagtgaggacgttgtggggacactgaggaccctgtgggggcagtgaggatgctgtggggatgctgtggggacagtaaggacactgggggcagtgaggacgctgtggacactgcggacgctgtggggacaatgacgctgtggacagtgaggacgctgtgggggcggtgaggacactgtggagtgaggacactgggggcagtgaggacgctgtggacagtgagggcgctgtgggggcggtgaggacgctgtaggggcggtgaggacgctgtgggggcggtgaaggcgctgtggggatggtgaggacgctatccggggcggtgaggacgctgtggacggtgagaacgctgtggggacactgaggatgctgtgaggacgctgtgggggcagtgaggacgctgtggaccgtgaggacgctgtggggatggcgaagactctgtgggggcggtgaggactctgtggacggtgaggacgctgttggggcagtgaggacgctgtggaccgtgaggactctgtgggggcggtgaggactctgtggacgcggtgaggacgctgtgggggcggtgaggacgctgtggacagtgaggaggctgtggagacaatggggacgctgtagacaggacgctgtggaggcggtgagggcgctgtgggggcggtgaggacgctgtggacactgacgacgctggaggtaacaatgaggacattggggacaatgagtacactgtgggggcggtgagaacgctgtggacactgaggacgctgtgggggcggtgagggcgctgtggacgcggtgaggacgctgtgggggcggtgaggacgctgtggggaccgtgaggacgctgtcggggcggtgaggacgctgtggacgcggtgaggacgctgtggggacggtgaggacgctgtggggaccgtgaggacgctgtcggggccgtgaggacgctgtggacgcggcgagggagctgtcagggcggtgaggacgctgtggacgcggtgaggacgctgtggacgcggcgagggagctgtcggggcggtgaggacgctgtggacgcggtgagggcgctgtggggacggtgaggacgctgtggacgctgtcggggcagtgaggacgctgcggacgttgaggacgctgtgggggcgatgaggacgctgtcggggcggtgaggacgctgtcggggcggtgaggacgctgtggacgcggtgaggacgctgtggggacggtgaggacgctgtggggaccgtgaggacgctgtcggggccgtgaggacgctgtcggggcggtgaggacgctgtcgggacggtgagggcgctgtggacgcggtgagggcgctgtgggggcggtgaggacgctgtggacgcgatgaggacgctgtggacgctgtgaggacgctgtgggggcggtgaggacgctgtggacgcggtgaggacgctgtggacgccgtgaggacgctgtggggacggtgaggacgctgtggacgcggtgaggacgctgtggacgcggcgagggagctgtcagggcggtgaggacgctgtggacgcggtgaggacgctgtggacgcggcgagggagctgtcggggcggtgaggacgctgtggacgcggtgaggacactgtggggacggtgaggacgctgtggacgcggtgaggacgctgtggacgccgtgaggacgctgtgggggcggtgaggacgctgtcggggcggtgaggacgctgtgggggcggtgagggcgctgtggacgcggcgagggcgctgtcggggcggtgaggacgctgtggacgccgtgaggacgctgtgggggcggtgaggacgctgtcggggcggtgaggacgctgtcggggcggtgagggcgctgtgggggcggtgaggacgctgtcggggcggtgagggcgctgcggacgttgaggacgctgtggacgcagtgaggacactgtggggacagtgaggacgctgtggacgccgtgaggacgctgtcggggtggtgaggacgctgtgggggcggtgaggacgctgtcggggctgtgagggcgctgtggacgcggtgagggcgctgtggacgcggtgaggacgctgtgggggcggtgaggacgctgcggacattaaggacgctgtggacgcggtgacgacactgtggggacggtgaggacgctgtggacgccgtgaggacgctgtcggggcggtgaggacgctgtcggggaggtgaggacgctgtgggggcggtgaggacgctgtgggggcggtgagggcgctgcggacgttgaggacgctgtggacgcggtgaggacactgtggggacagtgaggacgctgtggacgccgtgaggacactgtcggggtggtgaggacgctgtggacgcggtgaggacgctgtcggggctgtgaggacgctgtgggggcggtgaggacgctgtgggggcggtgaggacgctgtcggggcggtgaggacgctctcggggcggtgagggcgctgtggacccgatgagggcgctgtgggggcggtgaggacgctgtggacgcggtgagggcgctgtaggggcgatgaggaggctgtggacgccgtgaggacgctgtggacgcggtgaggacgctgtgggggcggtgaggacgctgtgggggcggtgaagatgctgtggacgcggtgagggcgctgtgggggcggtgaggacgctgcagatgttgacgctgtggatgctgtgggggtggcgagggctctttggacgcggtgaggacgctgtgggggcggtgaggacgctgcagatgttgacgctgtggatgctgtgggggtggcgagggctccgtggacgcggtgagtacgctgtggacagtgagggtgctgtggggacagtgaggatgctctggggggcagtgagggcgctgcgcggacagtgagggtgctgtgggggcagtgaggacacggtagacagtgaggacgctgtgggggcagtgaggatgctttgggggtggtgagaacactctaggcagtgaggacagtcccagcagtgtgtctcgtcctctgagcatgttcaggggctggttcttgtggacagtgccggccttgaggacaccaagagcatttcaagggttgggtttcctgatgcagggactgcggcgttggcagcattcagttcactaggggagcgttggggcaggtgaccagggctggttcaggtctgttgctccatccgggatccctggaccatccgaatgagaagatggcctctatgtgacagagtcacatgcggtgggggttcttggagggccccacagcgatgagtggacctcaggggttgcagggtctctggaatcattgtgttctggagtgaacttgcccccccacaggctccaccaacacccccaaaccctcttcctgccatccctccccatcccacagcagcggccctggccccagaccccttctgccagggctcagggctggcagcctgctcctgccagccaagagccgttcctgtccctgcccacagctgctgccttccccaggctcccaggctgcaccacacggggcctgcatgttccttctgactggcacaaggtactctccatgccactgctccttgctcatctcctgtgcctctggcgagtcccccaccgggccaccacttccctcaggaaggcctctccgactgcccagaccagcaaggggcttctcagagttctccagtctctggcctcccactgccctgcccggattctggagctgagcaaacaggtcagcacatggtgcccaacttaggaggtgactgacgccttcctcactatttgggctggcctggggtgccagggacagggttcctctgccaccgtccatgtggcccccacctgtctggccttatgaacaatggaaactattctccatgcatcccagagaggccccagatgaggagcctcaggtcctggctgcccggcccaggaaggccctcagcccccaatggccatcactgaccaccactgaccgggtcggggaggctgccactgacatggcctttgtcctggcctttgtgggacaagacagatggccctcctgtggggctgatgctatctcgaggctgccagtcagacgtgaggcaggaaccacccctgcctttgtgagcaggtgcagggcatccggcccattgtgggctgcagccgactgtggttgtccatccggccttatcaccacatcgaggacagtggccccctttatacaaatgaactgcccagcttgccctccccagcggtggcctggcacctccagaggtcctagtgtaggtcagaggtaaccatcgtcataacaccgtgcatgtgcaacactctaaactcagtccaagcagggcaggggagggggtgtgctccccactttctctaagaaaccagatcccagaagggggctctctgctgggccccagagcattttttgtgtgaactggaaacagggctgaggcaggcctcttgcatcccttctctgcctcactgaggtctttggggtgcaaatgtacagcccaggagaaagtggcccagggtcttaggtggcccccagccaagagaaggacgctcctctggtctgtgggaaaaggccccagcaggagatagggggagtgggcagcccactgcttgcaaggcttgaggtctcctgggccagtgtgtcgctcagggggtggcagggggggccctgaagggcaggagctgcagaggcagagggactcctgttgaggaaagctactggaatcactgtgtggttagacctaaggaagaacttcctgcctgctggtcggcggggcagccgaaccctatgattcctccacaatccctcctcttgccggctctccgtggtttagactggttcgtgccaaggtactgactgtggaaggcacagggcttccctcgctggctgaccttccttggctgcctgggagcccccagtccccatgcctgactctgagctgaccctccacacactgaccctggggcctcagcctccaaggggtgtggggaagtgagtagtcccagttcagtatacctgaatggccctgtggggacgggagaaaggcacaccctccctgcagatctgggcaccaccttgatcccagcattgtccttcatttcacagacaacacacctgccccaggaccccctccccactgatgagctgggcccctctgtgacctcagactcttccttctaggcaggaacaggttgggggtcccgtctccaagccctgcctggaccccgcacctccagtcccaggctagctgattcagggctccttgccctgcagcccaagggccctctcaccaccattgcccaccccacctccctgggctcctgggatctcagccttaggtcaaggcccagccctggtgcaccctcccccatgggccaggccctccatgcctttgcccgcgccagtccctccacggggcacgcccttcccgctgtggctactcctcaatcttagaggcccctcccaagcccattctcacagagcttcctaggcctgccctggcctgacacatagtgcaggacagtgtccaggcctgtgtccccaagacccatctggggttcaagccacatcttgggcctatacacagccagctagtgagtgagcgagcgagtgagtgaggccctgcaagatggtcatctgtcttgtcccgcaaaggccaagacaaacgccgtgtcagcggcagcctctccaacccagtctgtgatggccagtggtggtcagtgagggctgggccgcgaggctcacagctcaggccgcacccgccggtttcacagaccggccaggaagctcccagggcgagggcctagtcgtgtcctccccatgggcgagcaaccctaggcaggcaccagagggcgctcgcggtctgcagaaaacgctggctaaggggggagcgcggaaagaggtgggcactgtgggtgcagacagctggggtccgcggagaaacgaaggcctggagcgggggcgctgggttgtccaggctggcggcgagctgcaccgagtgggacgggcaggctgcccctagtgagggcggggagggtgtcgccgcgtggcggctgacagacggggcgggatgagcgtagcccccgcccctgccctggtgcactgacagcctgtcagccgggaagataagggacttcttccgctgggcgtggggtgggggtcaacccaggtgcgctgtccccctcccgctggtgtttgctcggtaaacacttattgggccccgggctgtgcacaccgccgcgggggaggggcgggcgacctgaaggcctggactccatggcctctgccagggatgccgggtccatgggccatcaatgatgcaggaaaagaggctctgtcacctctggccccgcctggagagagttgcctgtggggtccttcgtgggccccctccagcctggggtggccctagcctcagcttcagagctgggctgacccccgactagccgaggcattaatggggccccgtggaggaggtcctgggaaggtctggggagctgaagtcctggccacgtgggggggactgcaccccctgcccagacggagcaacaacattggggtgggtggcggggccctgggggcccatagctcagcgcagcgtctgcgcccaccccctgtgtttccgatggaagacaggctgaaggtgataaatcaccaggtcccacccccacccaccctgccaacgggtggggaaggggggctgcatgtgacagagatggggaccgagacagagatgggagccaggtctagaggagagaccagagacagtggcactgtggtggccccgttgacacgggccaggacccttgcttgggtgtctggcctccccgctctgggcgccccttccacaaagcccatctggaaaccagctgagagccaccgtacccccaccccggctgacccccaacagggaggtagaggagggagggagacctttgcagccataactccgtcccccgcctgcccgcccccaggaggaccataaatcagcaggggctctcaaagcactacctccacaggctgaagggagggcttcagggccactggtcttagggactaggcctgtccttggctgtgtctgtccctctttaaacagccctcaggctgaggcaggcatatcacttgaggccaggagttcaagaccagcctggccatcatggtgaaaccctgcctctactaaaaatacaaaaattagccgggcgtggtggtgttgggcacctgtaatcccagctactctggaggctgcagggggaggatggcttgagcccaggaggcagaggttgcagtgaccccagatcacgccactgcacgccaacctgggtgacagagctaaactctgtctcaaaaaaataaaataaaaataaacagccctgaggggaaccccagtggcccccacacccagcacagtcgaactgactgagcactgtctacactggatgtacacactcacatcctcactttctctctccagacaggaaacgtctgcagggagcaactctgtgtcctcatcaggagaccccctgttgctggcccctcaggaactagggatcagcatgtcctacccagtgaagccctcctgggggtcttctctgcccataggaaatgcctccttctatcctgtcttcctgtcaccaccaccccccagggtactgagggccagctggacaaaaggtggtgagagatgggccaggtggatcccccgcaggtgagcgcaccccacacacatacacacagggcaggtgcagagtcagtacccagtgggagaggcttgagagggcctgggggagtgctccctggagctgtggggtgtgctcagcagcctagttctagccgggccggcctcagcaacccctgtccagggtctagcctacagacattcccagggttcccgtggtgggcataagggcattgtacacaaggaaacacagatgtccaccgtgacatcaccccagcttgtctcaaagagccgtggggttggggatgagggctgcttcttgtctagaaagaccttcagagatgttggaattctgtgcctgagacaggcactgactgtcactgggctggcctgggcctggttacctggactgtcgccttcatcctcagagcaaacccttgagtctagcactagcgatgtctcaggggagggttcagagtgtgcagcagctggaagtgtgctcagctcagcctgtaggagggtctggcttttccagaatgtcccagggagaagagcgcaaggggagtagggtgctggggtgtgcaggggagcccatctcccgtcatccattcacgttcaatcattcataccagtgtgcagacctgtctggagcctgccggctgccagggtcaagggctgggggggtgcagatcccttggccccagacccccacctggcagaggcacttcactcctcttccatccctcctgagagggccagctccctcctccccgcactgggattccccctagtacgaagtcctctggggctcacctaggtgtatttaagcatgtctgacaaattgagggactccaggcctaacagactggaaatgggccgggaaggcgagggctcactcaaccacagggaccagtctgccctgcccttcccaggccgcccaggtgtgactctctccactctctttgtcccagccacgcaggaccttagggccagccctgcaaggtcactgcactcctggtggggtacaggaaccctcaaagatgggaggatctggaagggaagccattgaactttgcctgatggacccatgggatgtgggggcacagaccccagctgggcaccagcaggtccccatttggctggaccatgttgacagaattagggtgcccactcctgggaggaaagcctcagtctatggctggaggtccagtgagccaggggtgagggtcccagggcagcatcagcccacagagcagaccaaggcttctgccaactgcattgcaccatgtggcagctgtacctgccagtcaggggatcccaagctggggtggggcttcaaggaggtgcctacgggcagatccagggccgagctctgcccgggtgtctgcttcaaaatctattttgatgtgctttgtatttggggagttgcttttctctatgctttgtttatttaaagatgctattgaagagttccagccaaactttgtaaatgccgaggaacgggctgctgtctgagcagggctggggagggtaggagcccctgacagccgcctgtcccagcatgcccaccccgtgcccttattgcccactgaaggtgctcgcgcggcaccaactgcactggcttcctccaggagggtagcctgggggctagggccagagaggcaccagtacgcagagcagtacgtgaggccaaggacctggtcactctgagaccaagcaggttccaggcatctatgctgaggggagtgggagaccactgactttctttgtggcaaaagtggggatggacctgtttgtgtgagctcagggcctctcttggcactaaatgcctctcttggccaccctctgccctggggtccttggcatgggactctctggtatgggaatcccaggtctatggaatgttagtctatgagtccctggtctggggttctgagcctgaagagtcctgctctgggtgtctcaggtcagcaggtctctgacaggtgtctgctcagggtccatagtctaggggtcagtgatctggccttttctccccaggggtgccaggtgccgtgtgctgccatggatgtctctgggatatcagtcagccccttctctgttggccaaggagccactgctaacaggagttgtcccagagggtcacactcttgagtctcttgtggcaaggtcaacaggaggaccatctggagcacggagagcatccccagatcataggcagaagggtgtttcctgctaaggccagccagaagactccacagacctcccaagtcctggctagactcaatcctgctgttataagtctccctgggtcctccctgaatcctcccagagccctccctgaatcttcccaaaagctccctgaaccctccccaggttgtctcctggagtcctcccagtctttcctggatcctctccacatcctccctgagtgctcccagaatcttcctgcagtcctccccatgttctctcaggcgtgggctgctgtacctggattggccctagcaggtgactcgggctggagtttggttgacaccagtggagccacaagcctgctgtgcacaggtgtgatggcaggcctgtgagggttcggggctgcatggccttgctccctttgcactggtgtctggatgtgctcagaggccccctgggtccccaggcctctgggacaaggccggttgagtctcaaaaacaggtaggaccccaagcagagccaaggcatcaccagccccagcccttgttcccgtgtgccccatctcccgaagcactcccctgtgtcatgcggtaccagctctgcctctgactccccatgcagtggccctaaggccaccccttgtcagtgtcctcctgggcctcctggggcgggcaagaacctgctcacacaggtacatgcacagcaagcatcggagggtctccttccctgggagacatcaccgccccacagtgggtcaccctcaaggctaaccactcagcttccgggtggcaagcctgcagagtggccccaggcatgccgggccaccttctaagtgtgccagtcccaccctgtgtgtgtgtgtggatgtgccagagatgtgcagtcacacttccatctgtgtcccatgcccccatgagtgtgtcctcacacctcttgccccgcctccctgctgtgtgcccctcgtagcagcttggccctgcccgctgcaccatgtgtacacagaggcttattttctctgcctttcgggccaggggcgtgctcgtaaattgtgcagtcgacgacacatttatcccgcgggcggctggcggtgtgaatttatggctgcacccccttcctggctgaggcaggacaggggccgggatacctctcaggcaggaacctccagtccactccactgggctgttgtggggccatgggggcgggctgggccgggagggcttaggagtgctcccaaggtctggtcttgcacagaaaccctgcaacttcagggtgcttggggcaatgagaggcgaggccactctgcctgggtgagggctgggggcacagtggctgcccacgtgccagaggcatggaggcccagagcccagcctaatgtcccagcctccatgcccccttccagtcggcttctcatcttcccacctaagaaagaggggacaacttggatgccccagggacagcaggtgtgggggtggctcccctcaggtgctgagtcagccacccactgccactaggcccactgggagtactgagatctggggaggactgtcagaaagggtgggggcctcgagggcagctggggctgcacacagggaagaggagcggagatactgtcgaatcagagcagagagcccctcagagctcacctgccctcctctgccttgtaaagatggggaaactgaggcccagggagagcagaggtcccaggtcacatgggtaggataacagagcctcaagatcctggattcctgctccctagtatgcaataaagggggtcctaggcacacccctccccacggagccacctttgtcctgcaaagtctggaggtggggcctccggctgaagcctcaacagggagctgatggagcaaattggcaagctggtcccatcagggccacagctggggcctgggacctggctgcctcccctccgtccgtcggtctgtctgtgtgcagggtcgggtctccaggggaccctctgtcggctctcaagctccctcccatctcggccccagccccccctcaccgcccgctgtcaggatgagcgatggccgtgcccctccccggccctcggccccaggcccggttcccgctcattagccactgacactgtttgctttcccgccatggacgcccaccccgtcacaggccattt[450 bp omitted]cccctcaggcagccccagtacacagcctggggggtgggtcctgaggcagcaggcacccctccctcctgcaccacccccgcccccaatatggccacagctgggcggcatcagggcccgcaggccagtggcagccagtccttcacttaaaaatgtgtttgtgatttcggcagcgaggcagataacggtgacgaatggcccgcctgccccccagggccctcagcccatctggtttgactttggcctgtcggcagtgcccttgggcctcactcctgccctctggcagtgccctccgagtgaggcacccctcaacctttgcacactctggttcctttgctggaaatgcccctcctctccacccatctgtccccccatcatgggctcccctggctatgcccataggagccacccatgcaacactcggggtggcaggtcctgggcagtgctggggtttgcagggtgggggagggcacaggcccagcagggagggggcatgccttgcctgggccctgcatcccctctgtctaggagggaatagtgagtgcccacctaaggccagaggggccgaggctaaggtgacggagtgggccaggaccgagagaggtggcccggcggccagggcagggcctagccctgtgagacagcccatgtggtcattgtcaggaggaatttctgacagggctcgggaccctcctgaccatcgattatccaagcaggaggagtggcttccgggtccggctgtgggctcagctgggaggtcactgaggtcaagcccgagtgcccctcctcctccagtctccccttctactcccttggggctccccagttgggcagaggtgcctggaaggttgctcctgcccagtttgaatcctggccagctaccacagggagtggtcaggggtccactagggactggagctcatgcattccttagcacaacttcccaatcaacccctgcgtgcccaggtcacagacggagtcagacctggccctcagagaggagataaggagaggtggaggtgcttagagctcccctggcccatctcaggggttggggaggggcttgtgtagagggagggcattcgggcaggatagaggaggcagccctccctgggggtctggggtcgcctccaggagaggcactgctccattccccactgcaccctccaggcccactccctgccctgtggcgaggacagctgtagggggaggggaggggcagcgccgtgtcaggacccccaccccctcctccaaagcaggaaaatccctctccgttagtatcacattgttgagaattaactttgttgaaataaaaattggtcgtggtattaactcggcctcaaggattttctctgggatcctggaggccgcagaggggtcagacgcccattcccagggccagccgctggctcgggtttcggggactccagcgacctcagatccttgggacacggtgcctggttcctccgggttgagggagccaccccagtcctgccttctacagccccggacacgaaggaggacggcccagacagtgtgggtcttaggcatccatctgtgcccctcccccatgtctccgtgtcacttgcagccatggctgttgagccacaagatgcccctcccgctcctcaggggtcagccacggccttagtttccccacatgtaaaatgggagcttcaccccagcacagggtgtggggggccctgggcacagacaggcagccggatgctcagacaccccagaaacctggggcgggcacgggtagggacagacccacccaggtctctccagagggcaccaggtggccacacaggcactcctggcctcagcacagcctcgctggccacagaaagaagttggcacccccgactgtctgccagcagggcgtgggcacttgctcccaaggaagcaagcagagagcccacgcgtgctgccaagaagggacggcagccctcaaacgacacgattccacacagacagatccgcgcaaaactgctctgagaattgctggggtcccgcccccccgccatggtccctgctggacagggggcgtgagcactgccgagttcccacgcccccactctggagtgtgtattcctacagagggagtgcccacggacagaagcacaagggatggaggtggggcctcctcagggcctgcgggtggctggtcctgcgtcccggtagccaggggacaggcgagacctcccagccggtggtcccctggaagcctcctctgctcacatcccaggcagtgtgttttcgggggtggggtgcagcctgggaacgggctggttcgggggcctgggaacgaaggcaggggcccctggcgggggatgcaccagtgggcccagctgttgctgcctggctccaattcccactctgcaccaaggcctgtccctggggccaaggctggtggtctgcctgggagggagtgagggggtgtgggggccatatcttcctccagtcagtggtccctgggcagtagaggtaggagagaaccgccttcgagctgagtggcagagcccacaagcagggggtgctctcctgtctccccaagcccaactgcagcaggtcccaaagcctgctccgagcatggaatcaccctgaggccccatcccctcacccagcacccaagcccacctcctccctgggcctgtgttggcggaccagggcctccattatacaccatgagcctggcgccagcccaagccctccaggcctctgctgtggctgctcctcctgtcgagggagcctttgcaccagggccatcctaaaactcctacttaaccttcaagaccccatgcaagtgttcctgccccaggaccccaccccgaatactgggccctgcacccagctggtgtcattctctttacaagactcctgatgcccctcatctggcacaaggctggacaccagagtggggggtgcacatttccacctccaggagcaaaaaaggctgactcctcaaggaggcctccttcccaatgcctcagtttccccatctgaactgtccttggctgacagtatccatggtcctatgggagcaagtgtgaactctgggcaggaaccaaggccagtgttctaagcagggtggagggaccctgaagaggacaggccaactgggggctcctccaaagcaggagagtgggtgcccagccagccaccccacaaacatttggctggcttcagctgaggccaagggaaggcagagctgctggcagggtgggggccagagcgggattcttcttactcctaaaatccctcccgcctgcccagcgggccccgagggaagccccatgatgcgggaacctgatattttaagacttaaagcaaatgtttctggagcccgagctgggcctcggcgcccgcccgggccttgtgggggcagggccagcgaggaggagaggacccctcccctgaaccaatcctgcccctccctggactgcagtttctggtgacaggcaggggcaaggctggaaccccttgggcaccttaaggttccccgaaacctgagggtgggggccccgttgtcggctctccgctctgctggtccctctctcggctgccagcatcagatgaggctcactgagagccctgaacccctctagggctggctttgcctgacccagagcccagggatactccctttcttaccactagcagggtgggcgtgtacaggtgctgcttttgagccactggcaggagccacttggagctcagagctgacacctgaagcttcctatctgagaggacaggagatctgggactgactggcgatgtctgcctggggtgttgcaggattcctgcgcttggaaccgcagcagatgggatcttgctctgtcgcccaggctggagagcagtggcacaatcacagctcactgcagtcttgaaccactgggctcaatggatcctcccacctcagcctcctgagtaactgggaccacagacacacaccaccgtgcctggctaatttatttttttatattttgtaggtgggatcttgcgatgttacccaggttggtctcgaactcctgacctcaggtgatcctccctcctcagcctcccaaagtgctgggattataggcgtgagccatggcacctggccatgatagggtttttttctctatatatagaagggactccccatcgcttggaccatagggcagtctgacactcggctgaggctgagtgaagctggcctgggctcaggggcatgagttccaggctccaggccccacactggtgccacctccttctgggagcctccttgggggcctttgagagcaggagcatcacaagtggaggggtgactgggtcagggacagcagagcagggaggcaggggccgtgttgggcagtgaggaattaaggcctaataatgaaggctgtatctccaaaaaatgtttcggaggcagggccatccgggcccagctgggaatgtgggggtgtaggggagagacgttctccaggttctcccagaacaggccatcctaaggacccagccagcccagtatccagcccagccctccaagcacttggcaccaaggcccttccttgtctgctctcagctggtggggctgggccaagctcctacccactagctgacaagcctcctctggaccatgtccacattttacagatggggaaaccaagggccagggtgggaacagtgcttccagagagcctacagctggcctggctgtgtggacccttcctcaccacccctgaggtcctcctgcctcagtctggaggagggacggagctctggccagctgtttgggttcgtgcagacctgagcgtgagtccacctcggccatgtcccgcctccaggcactgtctgctcacctgaagctctggctgtctcatggggccttggagggtgtcaccacctgactttggtctgctcctcgctggtcctactgccctggtggactcctgtgcacccttgaaacccactggaatcctgcctaaatcgtgagcccaggaatgccccccacttcctagctccagcgcaagcactcagcaaccctcccctgacggggaattccttgtccattgcccccaggaaacccaccagcccccgcctcgggcagtcccaggcttggccccgccacttacctcactggacagtcttggactcacgctgtgaggacagacacatgacgtcacgccgccttagtttccccagctctgaaatggagatggtaaatgttgggtgggtgttaaggccgggtgtcctgagctgcccagaggaagggcagctggcaggagagctaggggtggtgcccaccctgggcctctgcagcaccacttcccactttaggggcccagatgccatccgcagatccttggtccagcctctcactaggcctggaagccaggctgccgctgtgggtagactcctgccaggctgtgggggctggggaaatgtgcccagcggtggctgaagccaggttgcctggggaaccagtgctccccagggggcctactgctgcctccaaggccccataacacccctgtccacagctccacccaagctcccattgctttccctcagcattttctttcatcctttgggcctcagtttccccacatgtgtctcgggaaatgacagatggcagatttgggggcgaggagaggagagggtatccaggcactttgttaggattgaggtggaaagaagaggtggtcagtggaacatggggcgccagggtggggaggaaggccgcaagatccccatctgtcccctccagaggcagagtgaggttagggcctcaccagaccaagtggaggagccaggatttgaatggggggcaggatgccgccatgtgggtggaggctccctgtgcctggggcctgagtgctggccaccacctgctgtctggcgtcctctccaatccacactggccctcaacccctgtcccaggctctggttccccacctgtcaggtgaggtccttttgagcccacggcactggggcggtctgggtggagtccctgccccctcccagcctcaggcagcatcccaggcacacacagcttgcttcccaggcctctttgaggaaggtcaacggccgagaactaaggctagggatcaccggaaacctgtcccatcctcgcccccagaccctctgaccgcagaatctcctgtggggctgtaccctgggtcccctcccaggcctgtgacccggccagaggctggaggcagacaggctcaaaaccaggccccctcctcaaagcctgtggaagcccatgagatgtcccccagcaccccagggtggagctcacccacctgtccacaagcaaaggcaggcgagggcaggaggtggcagtgaggccaggcccagggatgacctggcactaggcccagcccctacccacagcccccctctgcccatccccagccccctggcccagcttgggcacccaggctccaaaccagaaaaactagacggagagcaaacaagcccacggtgcagactcccatgtctagtggaccagtgtgggcagggccttggagctggggttctgccccggcagagccctgagagccagggcaggagtgataggcccatccaaccctgagttcaaggcctgtcctaccaggcaccccacgttggccctgtgcatccctcagtggagggggatttccacccaccagcctgcaaagtgagcactgccatgccagctgccccagatgccacaggctgcttctggggagtgggcttctcatcactaggggtgtgcaaatggtgccagcagccacggcaggctggccgggtaggactgattccccaaggttctgttcagagtccctggacccaagactccagagcctaaggctctggaattctgtcccctgagatggtgacatgtttcacagtgggcacagtggtgcgcacgtcataggggccggacaaacacctgcttattcaatcagcacacacctcagtggggtccaggggtggctgggtgcctcaggctcattgcccttcaccttcccctccaccagccctccccattccctctctaagggtcaggccgaccactgcagcctgcagtgcctcacacaggtctctcctccccaggagtcgctgttcttgccccaggacccttgcacagggtcaccactggaaaccggggagggtccatctctcccgggtctgcttggtattttccagtgtattcgcagattcttagcatgacacttccactcggcagaaaggacagggagagaaggctgtgctttagggcgacggcagcagggccagctggtgagaaccatgcacaagggtggctggcagagggatgtgacatgggctcccaaacaggccaggggacctgaggcccaggatgccacctgagaggctggggagggcagctgaaggagggagggggcagggactccccccggggccagcccacctgctgttctcgcagccctgggcccagtgatgtggggctcaagggggcctcacctggaggtcagttggggagctagaggccgggacaggagctgagggccagaggggactccggagaacactggatcaagtgccatcagctgggctagttgaagagttttgtgagggtttttgtttgtttgtttgtttgtttgtttttgcgggaggggtggaacaaggaccagcatgcagggcaagatgaggcctgagggtggaggggacagaagagccctgccgggacaagggacacagggacatcggttaggtttggacccatgcacaagggctcagccacgctgccagtgccagactggccccccttcctggggcgtggcagcacattcagttatgggcacaggcaacggcaggggccagggctgcctcgagcaggggaggctgggcacccagctgtcctgtgaggacacaccaccccaccctcagaccgtgccactggacactcacatgacccaagtctggccgcttgctcactggcacccctgccaatcatgctgaccttcttcccactagcacctgctgggagctgacagaggtctctattcccagccaggcgcctgctcaggttatatttaggccacaggggtgggagctgggcctctgacccccaccatgcccaagcaggggcagctgggctgacgccgtgggttgctcactgcctgcagggcccctccctccaggccttgtcctctcatccatcggccatgtgcaggctgggaggcgcgggccggccatgcttcatatgggaaacaagctagtctggctttgagctcctggcctcgggacgatgggggctgatggcaccagaaactctagggaggccagcacaaggggacaggcccgggagctcaggttgggtggggggctggcgggaggcccagcccagcctttcagctccggaggctcagacgtgccatgaggtcattccctcctgggagctcccagagccctgcccgaggggatgctgagccccaggcccttcctgcccagccggggctggatccctcttttccctcctgctgcccaggcaggatgtttccagggaggaaatggctcctgggaggccaccccacccccgctggagtctagggccacttcctgccccgcatgggccttggttctgcccccagtctgccagcctgggccagatcccagatttcctgtccctacagcatggagaggcagaggtgtctcggcctcaaccagcctgggaggcacagtcgcaacctcctggaccccaggacctgagaacctccccctggagccccacttcccttgccccacaaccctggtcagagggaggcacgacctgccctgcccccatgcccagccttccccagcgccacagagcctccttcatataggttccgcttgggtaccagctgctgctccaccgcccatctccatggggcccgcgggcctgggccatccccagcccaccccaggaagctgaatggctgcatcgaagctcccttttggctacaatcctgcagggctggccttggaccagcgggttagcctggatctgatgggccctcctagcagaggtcatcacccggctccgtgggcagccccatccccaggggaggtcaatcagctcagtcctcacccaccctattcaatggggcttcctgccgaccccagatctgggtgagtgtcctggtcaccgccccctcgaccaccaccccatgcagcaggaaacacgtagctggggggttgtggggcttcaggactgggattggagaggctgacagcagggctcagggctctcggcggaagtggggcctcagcccactcagaggtccaggaagtgggggtctcggaagcttcctctcggccagacgagccggagggtcagaggcctggccgcagctgccccttcctcttcggccagccagctgctgggtggcccgtgctgcagcaggcctcaggttggggagctggttgtccttcagcccccgcaggtggccagcatcaggaccggaaggctctgaatcagcctggtctggaggtatgggcagctgtgggggccggtggacaggtgtagcagagctcagggcgcacagcaggggccatctcagcctgggcctgtgttcccttcagtcagacctctctccagcctcggcttgcccatctctccagtgaggtgacaatcccgggcctgaccagacaggctgaccaggacagagaaccctggggccttctaaggccactgccatgtgggccgggtcctgtcagacacccccagccctcagcccctgacccatttctgttcatgccctggccctcctgcatgcccacccaaccccactggagctcagagaccctgcccctccaaggccttttctccacagccaggaccaggcccccagatctggtgccccatcagtcctgccggtacacctctccacagaagaagcccagacccaacccagcctgcgtgagccctgctggggggcctgggccatggaggtccccagccccatgcttcaggggaccgcagcccagtcaacccaggctgcagaggtgtgaggagggggctcttgcccttggcaactggcaggagctgaggaggtgcccgggagaccccatcctcacagatgctgtcatcctggcacatccctacctgcagtggggacctggacaactcatggaaccagtgggagctggaggctccaggcattgatgtgctgggcctcagtccctatgggtccccactgtgggagtgtctcagagtgggatgaggagtctgtgtccgtgcctgggccgaggcctggacaggccccacccccggcccacacatgatgggcggtcgtccatcagcacagccagcccctctggccatccatcaccagccagcggccacaggaggaatggcctgtttgttttgccagctccgtgtcactccctggggcgggggctggaggaaatggccattttctgcctgggcgggcgggtggacagcaggggtgggcagggcaccggggacagggatgtggcaggaccctggctcatcccggccctgcatagatgcccacagccttgccctgttctgtgcctcagtctcccctctggcatcagggtgagtgacactgggattttctgactgttcccatggcagctctctccagctgggtcactcacccctgccccttgccactgggtagggtgggctcaggtgtcagctgccaccaggtggggggtccccctatctgaaatccaagatgcttgatgctggctgttcttataaaccatggggggaggctctggagctaggtccaggccataggccaactgttgattggggttggggtgggggctgtcaggaggtctgaaagggcctgggcaccgatttggagacttccagccttaagatcagagcaggggacagttggggccacattaaaaaaggtagcacgtgtagaatgaagggggagacatcctgtaccaagaggctggtgtccagaccccgggactgtgtcctcagcacctgcacaatgaccctcactgcatcctcatggtagaatttgcagatatgatgtagaggtgtgcgtatatgtgtgtaaagggatacatggcaggtataatttgctgacaccatgctagggactctacaatcattttatcacttctcacaacacctacaaggctccggggagtcaaactgggatatttcttttaccactgcagcctcagacctctgccctggtccctgatccagaacacagtcaccccacactcccctggtcctgggctagcaaggagggctgtggaggaggcaagcaagctccaaagtgcagcactgaggctggggcggagacactgagagtccgaaggcacctccatccctaggaagcaaagccagacacccaattctggagtcagaaaaaagcccttcaatttccatccctgcagcccagtgtcccaccaccctcaggggagaagggtcgctttgctctccctggggcactgtgtttgcttacctcccaggcagctctgatgttgcatagctctttttcatttaggagcagtgacttccttcccgaaatttcttcccttagacctgggctgcttcctctgaccctgcacagccctgcagatgtttgcagggtatcgccctattttatctccctagactgaaacatactctgtcctgagttaagactctggctggttgtagcagactttaaggaaagaacttaattgcaaaaattcactctaagtgtgggcgtgactaagactcattgtgtcttgaatgtgcagagatggataggaggagctcgggggttagtgacattgaggccacatgagggaactctcgtgaacactcagttgaagggttctggagttgggaggctagtgaaccagtcccaccagtgcagggctgacggccctgtgtccagagacccccaagcccagcctgttccttgagccagggctgccgtgcctctgcccagcctccagctcacgagggctggcttagcgggattcatgtgccaccccctcggtgacatctgagaccatgcacgtcttggttgtgccttgttgctctctgctgctctacacagggagacaggccggctggtcgcctcgggggttatcttccctggcccccgaagccctggtgaccctgagcctgacccagggggaacaatgacacaacagcaaatgccctggggcgagtgccaccctgacagccccaaggaacagagagaatcagcagggtgcagggctcagcaggtgcaaggggagaaggctggcttatgtggtggtggggacagggcacagggccgggagggaggggacaggtggccaggggctctgtctacatgggagccacatgggggtgtgggtgggcactgcagagaggggccctggtcatggggtccacaggagagccaagccagcctagaggatccagggatggcccaggtgctcctgccccacctgttccaggccagctgtgtcaggggtactgcctccgtttctccaggctgggacctccactgcagtgggtacattggacactcagaccagccccagggcctggcagttcctggtgaagactgagacagcccgacacccgtccacacccccgcccaggatggggtggctgctgggtcactcggtcctggcaaacacgctggagggaggggctggattgactttagggcactggtaaaagctcacatccatctgtccacccagaacagctggtgccaagcacccacttagcaggacagggcagcccgcgcctccacactgcccatgccccctcccgtctcccaggacgtccacacaggagccacatgtgtcctggacccacgccaccccccgctctgtccctctgttccctgagctgggctggcaggggaagctgaggtgtacagggatggccaaggcctcctccctcccccctgcaccccctagccccattggcattacctcagagcagacaacagcttagtggggacccaagtgagggggtgtcagtggcccaggccctgccctgcccagtcactcaggcagctaagagagcaggaagggcccagacgacacccccacagacatatgccagcccctccgggtgaccaaaatcatctcagtaaaggcagatgaggccaagcgaaaaggggtgggtggaagaaccggctctgagtctcagcccacagacactcggacactcgtcggcccggtaggcaggggttcctggtggcctcaggctgtcaggcccggccccctcccgcagctgtctccagctcccacctcccccgcccaccccccaggactcctatttcactgaggagattaagaccacctggcgagaacccctcccacccctcccctctccccagccctccctcctaaccctgtcggccccttgaggtgccctcccggccccggccctcctctcccatccccacgttcctccacggcagcctccacgccctgccctgccctgccctgccatgggcctgaggatgtccccacccgctctgatggccacctcgggtcacttctcctcagcccataccctggcctaacccccaccctgagcctccagtccctccaatcctcaccctttatgtcccccagccctgcatagatacaggcatcgtcaccagccacggcaatggatcccgtccacctcccacccggccactccagacccaaattcagcactggcttcagcctcctgccattcttgctgggtctcaggagggaaccgggccagccaggtgctgtctgggactgtaggctctgagcctggtccctgctcagttccagcagccagtgggccaggggtgctcagctgaggacccccactccatccagcctgccgtggggcagccggcctggcctgatgctggctcagacagactcatgaggaatctgagctctgaaaaccgcagctccgagcttgcctgtttgtttgcttttgagaaattccaacctggttcagcagagccttggaggagggaagggatttgtcaggtctggggtggggctggggcaggcttgtggatgtggggaaaccaaggctgaatctgggcacagggacccagtggggaagccgggagagggtgcctaactgggcctcctggggggtccagctgtgattccccctccccaaacctcacgccaggcctggaggctccacaggggctatggaggcaacagccaccctactcacagtgctgggaggacctgcggggctgggaggggcccaaggaggccctgcagcaacaatagtgacatcagctggggagctgcaattgagggcccacatgtgctggctccatccacccatggggcctgcagcattctccccacttctcagatagcatcactgaggcttgcagaggccagggcgtgttcccagacacagagccctgaagggtgaagctcgctcctggacccagctcctgagactgggcgacatcaccacgctggttcctccctgtgcagaagggcccagagtacaggggtcctgccgaagcagtcctgttctcctttgaaatgaaatattgccagccttctcaccagctccttcccctgggaaggcgggagaccagacagagttggcagcccccagccctgcatcgccaccccgaccagggaaagctgcctgtgcaactaatctctccaggccccggtccccctctgcccacgggcttggggatcctccacaggtctcagcaaaggggttcccgtgctagagccttgcccatcagggacactccccaaaacctgccccagcctgggcagcccacctgcctttggccccaggtcagtgagggcgcctcaggtcagcccccacaagcacagggggagatatgagcagggtctgcccagagcagtgggcagggaggctcaaatgccagcctgggcacctgggcacagtcctggcctaggagggacaatccagcagccttgggggcttggccagggagcagagtggaccgagaggcacagggtgtggggccagtcctcccctccactgagacaggatttccacacagtctctcccagcagtcacactgggctgtcacagtgacagtatggactacttgaatcaattgagcatttaatgaaaactgcaagtgtgatatatttgactactttaaatgctttaagcatctttaaagagagatacaacatatccaatgtttacgggggcatggcctcgttaggacccattaacaaaggtgctgaggtcactggcttagttgtcattcctcattgcctctggccctgtccccagagccttccttctcagagcttcccagggctcattcgccaccaagcaagattcagggttggggtctgagcatggaaagtggcctcccaaggagttccacccagaaggttctctgtagaccgatcttgtcttgagagtctcttccagtaccaatgtccaaggaagcaggctggccagtcggatgccatcatccgagtgcatccccttcagaaatgacccagcaggagaggactgaaatattgcattcttccttcctcacacagcagcaagcttccacagtgcttcgcccaagtcaagtcaatccaaggcacatgtgagcatcgtcattattgtagaagggttacagtggccactgtgagtgataagcctgcacatgtgtgcgcctgtatgtatatctgctacatgtgctgtgtgtgcacactctctcacactggtgtctgtgttggtgtctgctatgtgcatgtgtgtgcccatgctcacgtgtgtctatgtacagaggtgcatgcatgcccgtgctcacgtctgtgtacatgtagagtgcccatgcttgcgtgtctgcaggcatacagtgtgcatgtgtgcgtctgggcccagtccgtgtgtctgcatgcagtgtgcctgtgtgtgcccatgctcacgtctgtgtgtctgatatgtgcatgtggacacatgtgcccatggtcacaatattggtatgctcacatgtgtaggcatatgtgcccacactcccatgtatgtgtgcctgagtatgaacatggtgtgaacacacacatacactcatgctcatgctcatgagtatgtgtgcacgtggtggtgtgggtgcttgaacatgggcaaatgggagctactgtccagtcagggttccctgctgcccagaggaactggaggggcctgtctgcacgtgtccatcttctggccactcaccctcagccaacactcctccagggtcttttgggacaagtcccttcccctggcaagtgtggctccccctgctggggccacagaagggaagggggctagcagggactggttcctcagctggcccgccaggctgagatccagccacctcaccagcctgcacataggtcttccagggtctcagagcctcacctctgcctggctgcacctggggtggaggggctagtgtggccaggagatggacagacagatggacagccagctccccatgtggctgggtcctcccaccaagtgggcagctaaatcaacagcctcagaaattggagaggggtccagggctgggctgtccatcagtctgtctgtttgtttgtttgttctggagttgtgggaacttccagtctgcagggagtcctggtgcctggcgaggtcggggggcagagggtgccattacccatccggccagccatccctctcatcatctccccacatctgtcctcctgggaacttggcccagaacatcgcacccatagttgcgggggacagctaggccgggtgacaggaggttggggaccagctgtatgcggctggctgtgcagaccctggccggccccctcccggctgggaggaggctggtgtcacacggctgtgtgcttccctgtccagtcttctctccacccattaccccatcccatgtctgcctctctcagggtctcgctgttctctttgtcaatcctgcagtcttttgtcccccagggtccaggcactaggactctcaggcgggtcagaccctgccctgggaccagggagcagatggtgctggggcctaggaagagtcccaggggatgctctgggccgggtgagggggccacacctcctgtcatcctgtccagtgtcctcccagccacaaggtgtgcacaccaggctgtgtctaactcccaggcctttgccagctatgtggtcagcctggtcctgaccagactcacagggacacctcctccaagccctgggccccttcctgggaacgtggctgtgggcctggagctcctgggcagggttcctgcctgctgtctgacacaccccccagagcttggaaccagccagagtacccacgaccccagcagtttgagtaaaggcccaacaccaaggagaacacgtgggggtgggcttggtgaggacttccgtgtcaggaggcgggcgccagggaggagagaggtccagggagggcaaggtcaaggagcagtgggaccacctgagccacaggttggggaggactcccattgagaccccaggctgggtaacaggaacggcctccttcttcatcgcaggcagtgtttgcggtggcacaggagatccggcggtggacccaaatgcgccctgccctggcaggcagggaagtagaccgcttctgtctccagccctccctggaggcggacctggcccctgttctggctctggcttgggtccctccactccaggagtccccagcccccagttctaactcagcacccgccccagaggctgcaaacccactgcctatgcacagagggagacagcactcccgtcaacgcctccgcatgcaggacctaatgtccgacccggctttgatgcagatcccagctcgctcccgtgccggctcccgctcccgctcctcccccgccacccccgcccgcggttcttctctcggcttggcggctggggtccgacgaaggggcagaggccacaactcagcggccccgcgggcagccccggcacgcggccccacccgcccgcctcccaggctcggggtctcggctcgtccacggccacgagggtcgcccggaatgtcgcgttcgccggtgctgtgggccaagcactttcgtgggatggagggacgattggggagcgcccgaggctgctgtgttggcgcccgcccccgagggctgggagtcaagaggtgggagtggagaggggaggagagggcagagctcctgggcgcgcggtcctgtccgggttcaggcgaggtttgggcccccagccgcccgcccttctctggggcccggggctgagctgctgatggcgggagggaggacggtgagggcagctcctggcggcgggccttccccgagaccccgaggccgcgtccaaatagggcgctgtaagcaactccaggcggtccatcctaaaacgaattagcagggtcaagtaaagcccggctcctcagtgcttccctttgcacggtgcgcggcggagcccgattctgctctctccatactctgaggcctagaggaggagtcccccgtgcacctcgaacctccggccggtcccttctgtgtgtatatttgccccaagtagcctgggaccaatgctgggggcgcaacttgcctgggaaacacagcccagcccaaagatcctggtatactgtctgcccaccagggacgcacgggaggtaaaggagggtgcgcggcaacccagcggtgctcagaattctgagcagtggggaggtgctgtgcctttatggataggaggggaagggggtcctgctgggtgggcgtgagggtgcctgtctgaaggctcccctgagggagccacgtgtgtgcaggggaggcggaactgggcagacagatgggcggccacaattctccagcggcagcctacctgcgctagggaaaaaaacttctggaattagggtttgcttcacccacaactacgaagactggggtggggggcgagtctcagcacactggactcccttggggcagggctgaggtgcagcccagacagcaaaggccgccgcgggtcctcggtcgcatccctcccttcagcctcctgcactcagccaagcctctgctccccaccccttacctacccgagtggaagccaagcttcggttttccggcctgtaaaatggtatcatagctcccatctcgccccctgcgctgggagaaatgggcgtcttgtcttcgctgcgcattgcatgcggaggagcagatgtctcagcccaggccctagccttgcatcgagccctgaggaatcagaccctgcgacccctagccgcgcctcaccttcctgatccacgcaagggagctcccagtcaggcctcctatcgcgcgggtgtggaggtgcggccggcagggggagcgaggaggaagggaaccgcggccgggccaggtgagggagggaggaacacttgccgcgggccgtgctgaggcgctgcgttcgcgtgcggaacccgcgtgtgccgggctagggccatccgacgggcgcgctccctccgggctgcgggagggcacgacgggtggggtggcggcaggtgaagaggagtgtgggcgggtggcggggtggcggggcggcggagcgcggcggggcggtgccctaggcgggagggagggtcggaggagccctatcctgctgcgcgatggaggcggtggaggcggcggctccggctggaggctgggacggcctcgcgcttcgagggcttccgggcccctttagccgagggctcctggagggtcccagcgttgagcaacggggtccgggggtccgaaatcaagcgagtgagtataggcagccggtggggtagggtcggccaacagagccggctgggtggggcccctcacctcttcccgtcgcccttctggttgaccagggtttcctccaccctgacggcctcttctctgctgtggcaagctggccgcccctgcctgcctgcaggtcctgctcaggcacgaaggggttaatgggggctggaagggctctgctcctccctacaaacctcaggcacagaggtctggggacctctggaccgatccttgagcggctgacccagagtctccaggaggccccagggtttttcactttcacttctccctcctcaatgttggcctcacccacaggccccacatctggccagtgccctgaggtgtgtgcagatgtacacaggacacaagcttgggcataccctcaggctggggcacatgcaggagccccacccccatgcccccaccgactggcccaggcctctctgggtgcagactgccaacacaggcacgtctcctgcaacactaccaaatctgcggccaccagcatccctaccacccgcctccacgggactgtccttcctgcaggagcagctcctggggacaatggctggtcctgctcagagaggaaggaaaggggcctggaaccagctggtccatccccacacagcactcctcactggacttgtccctgggtcccctcagtgacactgagagaca

SEQ ID NO: 502 - DNA, 13676 bp, Homo sapiens
agtgtatttttatttaataagggctgtttccagtttaacaacagaatgcttcagaaggtagcttgctttgtttgacattttccatttctagcttgtgtcgatagataaattcaggctatgaagaaaaattagaataaataaaattttaccattaaaaactaaaggaagttggcccttcaagaaaataatgtactgtactcagcagactttgagcattacatgtacctggtaatatggaaccaacattgaatcagacagccctatcatgcttctgaggagcttactggttactaaaaaaaaaatttttttttttttgagacggagtcttgttctgtcgcccaggctggagtgcagtggcgggatcttggctcactgcaagctccgcctcctgggttcacgccattctcctgcctcagcctcttgagttagctgggactacaggtgcccgccaccatgcccgggtaactttttgtatttttagtagagacggggtttcaccgtgttagccaggatggtctcgatctcctgacctcgtgaaccgcccgcctgggcctcccaaagtgctgggattacagttatgagccaccgcgcctggcatttttttttttttttttgagacagagtcttgctctgttgccaggctggagtgtggtggtgcaatcttggctcactgcaacctccacctcctaggttcaagtgattctcctgcctcagcctcccaagtagctgggactacaggcgcacgcgctaccacacctggctaatttgtgtatttttagtagagatggggtttcaccatgttgagcaggatggttttctgtctcttgacctcaggggatctgctcgcctcggcctcccaaagtgctgggattacaggcgtaagtcaccgcgcctggctactaaaaaaaaaaaaaatgtaaaggttggctgtgctcggtggctcgtgcctgtaatcccagcacttcgggaggttaaggcaggaggatcgctagatcccaggagtttgagaccagccctggcaagatagtgagaccccattcccacaaaaaattaaaaaattagctgagcatggtgtcatgcgcctttaagtcccagctacttgggaggctgaagtggaaagattgcttgagcatgggaggtcgaggctacagtgagctatgatcatgccactgcacttcagcctgggcaacagagccagaccttgtctcaaaaaatgaatgaatgaatgaatgtaagttgtatatatttaatatatttaatctccatgcatggtgaaacagctgtgggagaactgagaaagggtgcttagtctaacctgagagcccagaagaggagcctcacacacctgtgaagtagaagccaatccctgaagggacaggaggaaacaagaagcatggttgtgcctcctctttacatcccctgttctaattatttaagaactcaaatctagacttccataatttggaatggggaaaggattgccagtaattttaatcagcatagaattcaactctgtgaataaacccctttgcgtttctcctgaccagtagttaaaatcatgtgaatttgattcagagaaaaatacaagaacatggccaggtgcagtggctcacgcctgtaatcccagcactttgggaggccaaggtgggtggattgcctgagtgcaggagtttgagaccagcctgggcaacacggtgaaaccctgtctctactaaaatacaaaaaattagctgggcatggcggcgtgtgcctaagaggctaaaggcaggagaatcacttgaacctggggggtggaagttaaagtgagtcgaggtcgtgcagctggactccatcctgggcgacagagtgagactctctccaaaaaaacaaaaaacaagaacactgtcatgctgagaatggaatcttgtccaattaagagttgtgttcccagccggatgtggtggctcacgcctgtaatcccagcactgtgggaggcttaggcgggcggatcatgaggtcaggagatcaagaccatcctggccaacatagtgaaaccccgtctctactaaaaatacaaaaactagctgggcgtggtggcatgcatctgtagtcccagctactccggaggttgagacaggagaatcgcttgaacctgggaggcagaggttgcactgagccaagatcacaccactgcactccagcctgccaacagagcgagactccgtctcaaaaaaaaaaaaaaaaaaagagttgtgttcccatggaaagtactagtagccattcgatttgtgacttttaaaactcaaatccacagaattgtgacctaaatttttccttttgatctgaatgattagactagatttctgagggtctttaagattaaaatattttaattctgggccgggcgtggtggctcacgactgtaatcccagcactttgggaggtctggcaggtcgggagttcgagactgaacctgggaggcagagatgacagtgagccgagattgcgccagcgccactgcactccagtctggtcaacagagcgagacttcgtctcggaaaacaaaaaacaaacaaacaaaaaacattattttaattctttcagataagtaaaagggggcacagcctattagttgggagttcagattaacttgagttgaatctgagctaaaatcataacaagttgggtggggccaccaggcacatagcaactcacctggaatgaacgtgacaagaacagtggaagaggatgagaagaggctttgaaggtgcacactcaacggtattcgaattctgtcacaccagttttgtgacagtattaaaccagagttaggtaatttgaatacctgagcttttgtgctttcagaaacaaaaaaggagggaaataggaaagggaagttctttgatatatagaggcctacaatataccaaagctcactgctagactcttggaatctaatggaagtaaaccatgtttttgtttttgatttttgtctttgagaagctttggtctattgaaaaaattagaatgccatgacagcttaaaagcaaaggcaatcaactgtacctaagaggtggggagaggcttgaaagaggagatgctcttcaactgattctttaaggatgagaacaagtatacgaggtagaagaggtggtggtagaagagatggtggcagtgcttgctggtaaagacacagttataattaatgtagatgatgggcaggaacctaggaaggaaagataaagccaacttgtaaagggcctcctcagccttgtaaatgagcttaacaatgggagccatctaaagtttttaaaaagagaactgtcagattttaaaaggagaactgatgagttttacttttgagaaactgctctgggtggggaaagatctgaaggactaattctctgttactggagagggaccctgagaagctgagccaagatcaaatgccataggaatgtaaagtggcacatagaaggtgaggggagaggtatgatgacttcagagaggattgagtggtgcctttgagacaagagaaagggattagggtgggtgcgtgattcttttcaacaggaagaatctttctttgaggtacctgctggaagccaggtggtatttagcaatctgatgggtttgttattgagaagagaggtaagggctgaatacatatagatttgggaatcgcagcttagatgggatcacccagaatgaggaggcagaacaggaataagtagagaaagagaagctgcggaaggagaggcagccacaagcataggaggaggagccattagtgatggcctgaaagcccagggacagaagggaggggacctgggcattaaatgctggtcagtgataaagaatggtggttactggctggacatggtggctcacgcctgtaatcctagcaccttgggaggcggaggcaggtggattgcctgagctcatgcgttcgagaccagcctggccaacacagtgaaaccctgtctctactaaaatataaaaaattagccaggcatggtggcgtgcgcctatagtcccagctactcgggaggctgaggcaggagaatggcttgaacctgggaggcagagattgcagtgagccaagatcgcaccactgcactccagcttgggtgacagagcaagactccgtctcaaaaaaaaaaaaaaaaaaaaaaaaagaatggtggttaaagcagtttcactagagaagtacttagctcatcttggaattgaattttttttttttttttttgagacagtgtcgctctgtcgcccaggctgaagtgcagtggcatgatctcggttcactgcagtctccacctcccgggttcaagtgattctcctgcctcagtctcctgagtagctgcgattacaggcgcccaccaccatgcccggctaatttttgtatttttagtagagatggggtttcaccatattggaccaggctggtctcaaactcctgacctcaggtgatccaattgcctcggccccctaatgtgctgggattacaggcatgagccagtcaccacgcccagctggaattaagttttctacctttttttttttttttttaactgtgaaatatttcatacatagaaaagagtaagggtgccgtggctcacgcctgtaatctcagcacattgggaagccaagacaggtggatcacttgaggtcaggagttcgagaccagcctggccaacgtggtgaaaccctgtctctactaaaaagacaaaaattagccgggcgtggtggtagatgcctgtaatcccagctacttgggacgctgaggcaggataattgtttgaacccgggaggtggaggttgcaatgagttgagatcgcaccattgcactccagtctgggtaacagagcaagactctgtctcaaaaaaaaaaaaaaaaaaaaaaaaggaaaaagagtaagcctgggcacgttggctcatgtctgtaatcccagcactttgggaggccgagggaggcagatcacttgaggtcaggagtttaagaccagcctggccagcatgtgaaacccatctctgttaaaaatacaaaattagcccggcagtagtggggccctgtaatcccagctactggggaggcttaggcacaagaatagcttgaacccaggaggcagaggttttggtgagctgagatcacaccactacactccagcctgggcaatagagtgagactctgtctcaaaaaaaaagtatatgtaagctgggtgtggtggcatgcacctgtagtcccaaatagtggggaggctgaggtaggaggattgcttgagcccaggagttcaagaccagcctgggcaacataaacccccatctctgcaaaaaattaaacaaggattggctgggcatggtggctcatgcctgtagtcccagctacatgggaggctgaggtgggaggatcacttgagcctgggaggtcaaggctatagtgagccatgatcgtactgctgcactccagcctgggccatagagcaagacgctatctcaaaaaaatttacaaaacaagccaaaaaaaactatcatctgtgtgctccctttaaaaaataaataaataaaacattggccaggcgtggtggcccagactgtaatcccaggactttgggaggctgaggtgggaagattgcttgagctcaggagttcaagaccagcttagacaacatggcaagaccctgtttctaccaaaaatacaaaaattaatcggatgtggtggcatgcacctgtagtcccagctacacagaaggctgaggtgggaggatcgcttgagccttggaggttgaggctgcaatgagccatgattgtgcctctgcactctagctcgggcaacagaacgagatcccatctcaaaaaaaaaaaaaaaaaaaaaaaaaggaatattaccagcacctttgaaacttcctttttctagaagttgattgtattggttcttagcatgcataaggagattttaagcttagaacatattagcacttggtttaaagatgttttgtgtatggtttatacatgtagaaactgagaacgcttttaaccaaaagagctgagagattcgttatcatcagaaaagaaaagtcagttacgaattagttgttaggggctttgctgctcaaagtgtgtagtggacaataggcaaaaagtgagaagcatggtcaagggtgtttggatgggcttgaaaaccctgtgcattttattttattttattttatttatttatttttgagtcggagtctcactctgttacccagactggagtgcagtggcgcgatctcggctcactgcaagctctgcctcccgggttcacaccattctcctgcctcagcctcccgagtagctgggactacaggcgcctgccaccacgctcagctaatttttttgtatttttagtagagatggggtttcactgtgttagccaggatggtctcgatctcctgacctcttgatccgcccgccttggcctcccaaagtgctgggattacaggcgtgagccactgcacctgccttatctatttaattttttgagacggaatctctgtctgtcgcccaggctggagtgcagtggcatgatctcagctcactgcaacctccgcctcccgggttcaagcaattctcttgcctcagcctcccaagtagctgggcctacaggcacacgccaccacacctggctaatttttgtattttaatagtgacagggttttgtcatgttggccaggttggtctcaaactcctgacctcatgatccacctgcctcggccttccaaagtgctaggattgcaggcatgagccactgcgcctgggcaacactttatattttaaagggaagttgggggagggtgctattttcaaccttgctcaaagaacaaataattgggaagcaataaattttctgatgaatatgcttcatatttctttagacagtggggtctaatggaaaggctaagatatctgacatggagcaacatgtatttatctcttcagtggaactaatgtgtaattttcaggggagtttgatgaataaatgagtttgagaatatagggcagaggacttggaatttgtgtcagggttatggctggtgagattgatttggtgtcaaatttatgaatatctctgcagatactaacacagaaaatgagccccaaggtcactatagcagtatagtagtggagggaaatagaaactatctttatcaaatttctacacagacatacccctcaccagggaagcaaggaagttgaaaagcacactttgcctccctaacccaggaatttagatgggggatcagcaaactgttgagtaaagggtcagattttaaatattttcagcttttccatagagtctctgtccaactactcaactatgcctttgtagtgaaaaacagtcatagacaatacgtaaatgaatgggcttggctatcttcttttttttgtttgtttttaagatggagtcttgctctgtcacccaggctggagtgcagtggtgtgatctcagctcattgcaacctctgcctcccaggttcaagcaattctcttccctcggcctcccaagtagctgggcctacaggcgcacgccaccacacctggctaacttttgtatttttagtagtgacagggttttttgtcatgttggccaggttggtcttgaactcctgacctcaagtgatcctcccgcctcggcctcccagtgttgggattacaggcgtgagccaccacacgcctggctttttttttttttttttttttttttttttgagatagagtcttaactgtttcaggcagtgacgtgatcttggctcactgcaagctccgcctcccgggtttacaccattctcctgcctcagcctcccgagtggctgggactacaggcgtgtgccaccacacctggctaattttttgtatttttagtagagagacagggtttcaccgtgttagccaggatggtctcaatctcctgaccttgtgatccgtccacctcagcctcccaaagtgctgggattacaggcgtgagccaccacacactggctaactgcttttaactatacaaataataaaatactcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaatttaaaccaggtatctctgtgtaatcaaaaggtttctgtaaaacagagatggagtgtatgtgtgtgtgtatacttgtaatttgaaaagacattcagaatagtaacttttgggacagtacagactacaaaaattacaacatgatagaaccttcttaactactaagaatatagaaaggaaaataaagccaggcgtggtggctcacacctgtaatgacagcactttgggaggctgaggcgggtggatcacatgaggccagcaggagtttgagaccagcctggccaacatgccaaaatcctgtctctactaaaaatacaaaatttagctgggtatggtgttgcacatctgtaatctcagctactcgggaggctgaggcagaaaaatcacttgaacacgggaggtagaggttacagtgaactgaaattgcgctactgcactccagcctgggtgacagagcaagattctgtctccaaaaaaaaggctgggctcagtggctcacacctgtaatcccagcactttgggaggccgaggcaggcagatcacgaggtcaggagatcaagaccatcctggctaacaaggtgaaattccgtctctactaaaaatagaaaaaattagcggggcgtggtggcatgtgcctgtagtcccagctactcaggaggctgaggcaggagaattgcttgaacttgggatgcagaggttgcagtgagctgagatcctgccactgcactccagcctgggcaacagaacaagactccatctccaaaaaaaatgtagaggccgggcatggtggctcatgcttgtaatcccagcacgttgggaggccgaggtgcgtggatcgcccgaggtcaggagttcaagaccagcctggccaacatggtgaaaccccttctctactaaaaataaaaaaagttacctgggcgtggtagtgggcgcctgtaatcccagctactcaggaggctgaggcaggagcatcacttgaacctgggaggcagagtttgcagtgagctaagatcacgctattgcactccagcctgggcgacaagagcaaaacttgtctcataaaaaaggaaaataatttattatagaggagagtggtatattaagaagtttgacaggcactggcttagagtaagatttttctcttagagtaattttctttctctcttaaggtatccaagcccaccaatgggatctgtctcagcacccaacctgcctacagcagaagataacctggaatatgtacggactctgtatgattttcctgggaatgatgccgaagacctgccctttaaaaagggtgagatcctagtgataatagagaagcctgaagaacagtggtggagtgcccggaacaaggatggccgggttgggatgattcctgtcccttatgtcgaaaagcttgtgagatcctcaccacacggaaagcatggaaataggaattccaacagttatgggatcccagaacctgctcatgcatacgctcaacctcagaccacaactcctctacctgcagtttccggttctcctggggcagcaatcacccctttgccatccacacagaatggacctgtctttgcgaaagcaatccagaaaagagtaccctgtgcttatgacaagactgccttggcattagaggtaaaatctgttcagattagctttttgggtcctttgacatttggttttaatttttagttttagtttagtttctgctcatttaagcttatattcatggaattagagcactggatgattttggaagatacgcactgttagcgtttcattttaaaatttttttatagagacgaggtctctaattttaaaagagttgtttgcccaggctgatttcgaggtcctggcctcaagcaatcctcctacctcgacctcccaaagtactgggattacagatgtgagccaccatgcctggcccattattagtgtttcacagcttgttttgttctgtcctattccttgtttgccccaaattctcagccttcttgctctttcttgttcccaaagcctaacagatttagttttgcagttgttggtttttcttccagtaaggaaagataatgattaaggaagacccatgacctagaggcaaaatcaacatatatggttctgtatttctaacattggaatcagttgagaaatatgaaaatgtcttagaatttctcttgagcttggtagaggaatgaattttttttttttttttttttttttttgagatggagtctcactctgtcgcccaggctggagttcagtggctcaatctccgctcactgcaagctccacctcctgggttcacaccattctcctacctcagcctcccaagtagctggaacgacaggcacccgccaccacgcctggctaatttttttgtattttcagtagagacagggtttcaccgtattagccaggatggtgtcgatctcctgacctcgtgatctgcctatcttggcctcctaaagtgctgggattacaggtgtgagccaccgtgcccggcccaggaatgattttttttgagatggagtcttactttgtcacccaggctccagcacagtggcatgatcttgcctcatggcaacgtctgcctcctgggttcaaatgattatcctgcctcagcctccttagtagctgggattacagatgcctgccaccatgcccgtcgaatttttgtatttttagtatagatggggtttcaccatgttggccaggctggttttgaactcctgacctcaggcgatctgcctgccttggcctcccaaagtgctgggattacagacatgtgcgaccacgcccagccatagaggaatgattttaaaatacatcagcccttgcttgttatggattttgtaaattagaatagcatgaaatagaacttgaacattttaattaccaagtcattttcttttcttttttttttttttgagacagagtctcgctctattgccttgttgcctaagctggagtgcagtggcgtgatcttggctcactgcatcctccgcctcctgagttcaagtgattctcctgcctcagcctcccgagtagcggggctacaggcatgcaccaccctgcccggctaatttttgtatttttagtagagacggggtttcaccatgttggccaggctggtctcgaactcctgacctcaggtgacccacccaccttagcccgcaagtgctgggattacaggcatgatccactgcacttggccaagtcattttcttctaactaaatattactttttaaaaaaactctttctcagctgggcacagtggctcatgcctgtaatcccagcactttgggagggcgaggctggtggataacttgaggtctggagtttgagaccagtctggtcacagacatggtgaaaccccatctctaccaaaaaatacaaaaatgagccagacgtggtgggcatgcacctgtagcctcagctactcaggagactgaggtggaacaattgcttgaaccaggtaattagaggttgcagtgagccgagatcatgacactgcatttaagcctgggcaatagggtgagaccctatctcaaaaaaaggggggagaatgttgagagagagcctaagtgcatttcagaaggatgaagtaagggaccctcttgcttcaaaaaaaccaaatcctgactcaccaaacagcctgcccacagataaaagttagctagaattggtttcatgggtatttttccataggttgtcctcagtgtttttttgtttttgtttttgttttgttttgttttgagacggagtttcgctcttgttgcccaggctggagtgcaatggcacgatctcggttcactgcaacctccgcctcctggattcaagccattctcctgcctcagcctccggagtagctgggattacaggcatgtgccaccatgcccggctaatttttttgtatttttaatagagacggggtttctccatgttggtgaggctggtctcgaactgctgacttcaggtgatctgcccacctcggcctcccaaagtgctgggattacaggcgtgagctaccatgcctggccctcaa

SEQ ID NO: 503 - DNA, 1602 bp, Homo sapiens
ctcttggatggagtctaaggtggaactgactgtgctcttaatagtgtctgaaatttatatggtacttactggactgttcacaggctctctgtggctcttgaaatagcaggggctgggtgtgatggctcacacctgtaatcccaacactttgggaggccaaggcgagagaattgcttgaggctagaagttcaagacaagccctgaaaacatagtgagacccccatctctacagaaaatttaaaaattggctgtgtgtgatggcaactgcctgtagtcccagctactcaggaggctgaagtgggaggatcacttgagcttgggaagtggaggctacagtgagctgtggttgtgccactctgcactccagccaggatgacagcaagaccctgtctcaaaaaaaagagaaagaaatagaagcagggatatacttgaaggggtatgtgtgtgttcatgtcggtacattggatgcttggtgctgctcggtaattttgaatgcctcacatgcattatgccattaattctcatacacctgacagatgcagggttcgtccctaaggctgattagctcattatgagtgaagagtttagaaccagactccctgagtgcaagtctaacctcttctttggctcctcatttgtaaaatggggataataacagcatctacctcacagactattaaataatccaatctcttcaaagatcgtaaaccatgcctagcatagataataagtatgagctctttattattactcttgctcctactactcttgctagctatttatttttatttttattttattttattttatttttttgagacggagtctcgctctgtcacccaggctggagtgcagtggtgcaatcttggctcactgcaagctccgcctcccgggctcacaccgttctcctgcctcagcctcctgagtaagtgggactacaggcacccaccaccatgcccggctaattttttgtatttttagtagagacggggtttcaccgtgttagccaggatggtctcgatctcctgacctcatgatccgcccacctcagcctcccaaagtgctgggattacaggcatgagccactgcgccggcctcttatttatttatgttttgagacagtcttgttctgttgcccaggctggagtgtaatgatgcagtcatagctcactgcagcttctaactcctgggctcaagtaatgctcctgcctcagcctcttgagtatctgggaccgcaggtgtgtgccactatgcccggctcattttttgtctgtttagtagagacagggttttgatatgttggacaggcaggtctccaagtcatctgcctgccttggcctcccaaggtgctgggattacaggtctgagccaccacgcctggtggatttattatttttaatttggcaagtctgtaagcccttttttgttccttttttttcaagaggccagaggcagaggcctttgtcattttctgtgtgtccagggaagtgtgcaggatgtaagccatagattaggactgggaggaagagtgtgtggtggttgtgacaagggtccaaaggaaggcagcttccgaacttacttgagattataaaaataaattta

SEQ ID NO: 504 - DNA, 11001 bp, Homo sapiens
aactatcttgaattttactaataggagaatggctgaataattttttcctatcaattgtcgaacaaagccagacactagttaaagtggtaaggacgaccgggcacggtggctcatgcctgtaatcccagcactttgggaggccgaggagggcagatcatgaggtcaggagtttgagactggcctgaccaacatggtgaaactctgtctctactaaaaatacaaaaattaaccgggcatggtggcgcgtgcctgtaatcccagctaccaggaggctgaggcaggagaactgcttgaacttgggaaacggaggttgcagtgagctgaaattatgccactgcactccagcctgggtgataaagcgagaatccgtctcaaaaaaaaaaagtggtaaggacagattttaatcagtaatgattattgcaacagggaagagagttcagtatgaactgaactcagctttaatttgtatagaggtattttaaagggaggttgaccagcctgggcaatatggtaaaaccccatctctacaaatgaataaataaattcgccgggcatggtggtgaggttgaggtgggaggattgcacgagcctgggaggtcaaggctgcagtgagctgtgattgcaccaccgcactctagcattggcaacagagaccctgtctcaaaaaaataaataaaaaaaataaaggaagattgagggaggaaggggtgggcaagtgattagtagagtcagggaagtgaaatattacaaaaggttaagtcagtgtaaatgcagtgaggctagctgtgtctgccagttggcaatgatcaaagttagaatttttgcctcccacagagcctgggagacagaggtcacatcctcggttgttgcctggaataaacggtaaacatttaccagcagccttgagttttctcaggcaggcaccttagcgggggctggctagagtcattttagagatgttagcagctgttagaaactgttagtgtttgtttaagtctttttttcttttctttttttttttttttgagattaagtttcactcttgtcgcccagactggagtgtagtggcacgatctcggctcactgcaacctccgcctcccaggttcaagcgattctcctgcctcaggcttccaagtagctgggattacaagcgcctgccaccacgcccggctaagttttgtatttttagtagacacagggtttcaccatgttggccaggctggtcttgaactcccgcctcagcctcccaaaatgctgggattacaggtgtgagccacggcgcctggactgtcttttttttctttttagagatgagtctcgctctgtcgctcaggctgaagtgcagtggtgcaatcaaaactcactgcagtctcaaactcctgggctcaggccatcctcccaccttggcctcttgagtagctaggacaacaggtgtgctccaccatgcccagctaattaaaaaaaaatttcaagccgggcgcagtggctcatgcctgtaatcccagcatcttggaaggctcaggcgggtggatcacctgaggtcaggagttcaaggctggccaacatggtgaaaccctgtctctactaaaaatacaaaaaattagccaggcgtggtggcacacacctgtaattccagctacttgggaagctgaggcaggagaattgcttgaacccaggaggtggaagttgcagtgagccgagatcgtgacactgcactccagcctgggcaacagagtgagactctgtctcaaaacaaaaaaaattataaaaaaatttctagagaagcgggatcttgctatgttgcccaggctggcctcaactcctggactcaagggatcctctcatcttggtctcctgaagtgctaggattacaggcatgagccacagtgcctatagatcaaggttgaggcttagaagtgaagggagcccagaggaacctggctagagtttggtcaaggagagtctttgtcaccatactacagaaaattaagcagctgttaaacagaatgaggccggtctgggcatggtggctcacgcctgtaattccagcactttgggaggccgaagcgagtggatcacttgaggccagaagttcgagaccagtgtgggcaacatggtgaaaccctgtctccactaaaaatacaaaaattagctgagcatggtggcgcctgcctgtagtcccagctagttgggaggctgaggcaggagaatcgcttgaaccggggaggcagaagttgcagtgagccgagattgagccactgcactccatcctgggggacagagtgagactccctctcaacaaataaataaacaaataaaagcagtgtgttagggtgcgagaacccgggtcggggacgcgggtgagccgcgcggtaatcgccctgtcctgccaccagctggaggacaggggctcctcagagcctcaggcccagagaacgggccccacgaccgggaagcgaatactccacagggcacagtctcccaatgcaaaatgggcacctggacccaatcatttctgaacttctagttttttctccctatggctatgaaaagggtcattttttttcataggactttaaaagaaggcttaagaaaagcacgcaggcctggccgggtagctcacgccagtaatcccagtgctttgggacgtcaaggcaggcgggtcgcttgagagtagagtttcgagacctgggcaagatggtgagactccgtctttatgaaatattttaagaaaatcacgtacacctgtggtccccgctacaagggaggctgaggcggaaggattgcttgagcccaagaggttgaggctacagtaagccgtgatccagccactgcactccatccccggcaacacaacgagaccatgcgtcaggaaaaaaaaaaaaaaaccaagaaaataaaaaagaaaccacctaaaggcgtcctccgcgcgcccgcccctccgccatctttgcgtccgccccgtcctgcgccgccacttccttcccagccagaagtttcgcgccaaattgttccgcacacaaaatggagcccggaaggaggcgaggtcatgcactttgcagccaatcatcttcggcagacagtccgggcggcggggctggagggctcagaacggtccaatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggagggaaaagcagtccagggtaatgagtctacttggaatcttctgaagcaaactatggtttgctcactaggccagatctagcctgctgaccctatggcccaggaacacgttcgttcatttaagtattgcccacagctggtttcgcactacaaaggcagggtatgtggcctcttggctggcagaacctggaatgcacatcctccggccctttctagaaaatgtttgctgcccccagtctgaaggaaccccaccctcttcactggctgctctttcttggctccttcgctggtgcctcctcagcttcccatccacctgtggcacagctgcctcattccatgctgttgacatctctcacttggagaggcacgctacctcctccctgatcccccgcgtccaccctccaccccctcagtctgttttccacccagcagccaggtgtcccttgacactcaggtggtccagtcatttacttcttagtcaagtcctgcacagcccaccacgatctgctcctggcttccccaggcctcgctgcccctcctctctccaggcccggcctcactgcctccttcctgtttctggaatacactgactacccccagtctcactgcctttgaccttgctgtttcctctactgggagtgctgttcctcaagctaccatagtctgtgtcctcacttcttcaggcttctcttcacatgtccccttaccaggggcatcttgcccaacccttcatcttcagtttggtgtgcacgtacctcgtctctcccacacctgcctacttttttacttttcttcacagcatgtagctgtcactctttaatatgattgtttgcttgtatgtcttttcagcctcccttgataggaacttaggctccacaagagcagggacctttttgttcagtgctgtgccccctgcacctggaatagtgtcagacacatagtaggttttgctatgatgtttacttctt

SEQ ID NO: 505 - DNA, 10040 bp, Homo sapiens
aactatcttgaattttactaataggagaatggctgaataattttttcctatcaattgtcgaacaaagccagacactagttaaagtggtaaggacgaccgggcacggtggctcatgcctgtaatcccagcactttgggaggccgaggagggcagatcatgaggtcaggagtttgagactggcctgaccaacatggtgaaactctgtctctactaaaaatacaaaaattaaccgggcatggtggcgcgtgcctgtaatcccagctaccaggaggctgaggcaggagaactgcttgaacttgggaaacggaggttgcagtgagctgaaattatgccactgcactccagcctgggtgataaagcgagaatccgtctcaaaaaaaaaaagtggtaaggacagattttaatcagtaatgattattgcaacagggaagagagttcagtatgaactgaactcagctttaatttgtatagaggtattttaaagggaggttgaccagcctgggcaatatggtaaaaccccatctctacaaatgaataaataaattcgccgggcatggtggtgaggttgaggtgggaggattgcacgagcctgggaggtcaaggctgcagtgagctgtgattgcaccaccgcactctagcattggcaacagagaccctgtctcaaaaaaataaataaaaaaaataaaggaagattgagggaggaaggggtgggcaagtgattagtagagtcagggaagtgaaatattacaaaaggttaagtcagtgtaaatgcagtgaggctagctgtgtctgccagttggcaatgatcaaagttagaatttttgcctcccacagagcctgggagacagaggtcacatcctcggttgttgcctggaataaacggtaaacatttaccagcagccttgagttttctcaggcaggcaccttagcgggggctggctagagtcattttagagatgttagcagctgttagaaactgttagtgtttgtttaagtctttttttcttttctttttttttttttttgagattaagtttcactcttgtcgcccagactggagtgtagtggcacgatctcggctcactgcaacctccgcctcccaggttcaagcgattctcctgcctcaggcttccaagtagctgggattacaagcgcctgccaccacgcccggctaagttttgtatttttagtagacacagggtttcaccatgttggccaggctggtcttgaactcccgcctcagcctcccaaaatgctgggattacaggtgtgagccacggcgcctggactgtcttttttttctttttagagatgagtctcgctctgtcgctcaggctgaagtgcagtggtgcaatcaaaactcactgcagtctcaaactcctgggctcaggccatcctcccaccttggcctcttgagtagctaggacaacaggtgtgctccaccatgcccagctaattaaaaaaaaatttcaagccgggcgcagtggctcatgcctgtaatcccagcatcttggaaggctcaggcgggtggatcacctgaggtcaggagttcaaggctggccaacatggtgaaaccctgtctctactaaaaatacaaaaaattagccaggcgtggtggcacacacctgtaattccagctacttgggaagctgaggcaggagaattgcttgaacccaggaggtggaagttgcagtgagccgagatcgtgacactgcactccagcctgggcaacagagtgagactctgtctcaaaacaaaaaaaattataaaaaaatttctagagaagcgggatcttgctatgttgcccaggctggcctcaactcctggactcaagggatcctctcatcttggtctcctgaagtgctaggattacaggcatgagccacagtgcctatagatcaaggttgaggcttagaagtgaagggagcccagaggaacctggctagagtttggtcaaggagagtctttgtcaccatactacagaaaattaagcagctgttaaacagaatgaggccggtctgggcatggtggctcacgcctgtaattccagcactttgggaggccgaagcgagtggatcacttgaggccagaagttcgagaccagtgtgggcaacatggtgaaaccctgtctccactaaaaatacaaaaattagctgagcatggtggcgcctgcctgtagtcccagctagttgggaggctgaggcaggagaatcgcttgaaccggggaggcagaagttgcagtgagccgagattgagccactgcactccatcctgggggacagagtgagactccctctcaacaaataaataaacaaataaaagcagtgtgttagggtgcgagaacccgggtcggggacgcgggtgagccgcgcggtaatcgccctgtcctgccaccagctggaggacaggggctcctcagagcctcaggcccagagaacgggccccacgaccgggaagcgaatactccacagggcacagtctcccaatgcaaaatgggcacctggacccaatcatttctgaacttctagttttttctccctatggctatgaaaagggtcattttttttcataggactttaaaagaaggcttaagaaaagcacgcaggcctggccgggtagctcacgccagtaatcccagtgctttgggacgtcaaggcaggcgggtcgcttgagagtagagtttcgagacctgggcaagatggtgagactccgtctttatgaaatattttaagaaaatcacgtacacctgtggtccccgctacaagggaggctgaggcggaaggattgcttgagcccaagaggttgaggctacagtaagccgtgatccagccactgcactccatccccggcaacacaacgagaccatgcgtcaggaaaaaaaaaaaaaaaccaagaaaataaaaaagaaaccacctaaaggcgtcctccgcgcgcccgcccctccgccatctttgcgtccgccccgtcctgcgccgccacttccttcccagccagaagtttcgcgccaaattgttccgcacacaaaatggagcccggaaggaggcgaggtcatgcactttgcagccaatcatcttcggcagacagtccgggcggcggggctggagggctcagaacggtccaatcgctggccgcgaggctccggcgaaccaatgggagcgcagcggctgcggcgtccgaacaccgcctcttgtttttcccgcgaaactcggcggctgagcgtggaggttcttgtctcccctggtttgtgaagtgcggaaaaccagaggtgaggctagtgggagtgggactgggactgggagccagcaggcatctggatttccgggtgtagttggagtgggacaggagtttctcgggaactggggttggagtccgggagcgcggccgggggtccccctgctccggactcagggcagggacccaggcgtcggaggggaggaggtgccaggcgctgcccccagcctgttctggccgtttgttcccaccccaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaaatacaggtgcggctcctgcggggccgggggctcgagttccagtgtggccgctcacacgcctctaccagcctgctagagtcctggacagtcagggcacagatgggcccagacgggggaaagagccggtcctgggtcacagggctcatcccggcagcctcacgccttggtataaggctttgtgtattttgttttactttattttattttattttattattaacgtatttgtttattattttgagacggagtctcgctctgtcgccaggctggagtgcagtggcacgatctcggctcactgcaacctccgcttcccgggttcaagcgattcttgtgcctcagcctcccgagtaggtgggactacccccgccatcaccacgcccggataattttttgtaattttagtagagatggggtttcgccatgttcgccaggctgctctcgaactcctgacctcaagtgatccacccgcctcagtctcccaaagtgctgggattacaggcgtgagccaccgtgcccggcctgctttgtgtattttatctgtacctggagttaacttctgggtgagtcacctgttgagtgggccaccagcaaccagctagcgccacttggaccgtttagttctttatccagatcttgttcctgttcatctgcttcctatcatccttccatgtcatgtctgagaccttacaaactcaagttccctgtaggtgtaaaaggtgaagatggcagttaggattcacttcacttcgctcattcatttatttataccagtcttgcaccttcattgattgagcacctgctgcctgccagatactgttctgggtgctgggctgcagcactgaagctggacctggctcctgcttctaggtgattgtacgacctgtgacatcatgagaattctcataggcccggcctctatccctgaaatgttaaaatgcagagaacatgaggttgcaggttcagcactggcccattattagctgagtgacttccaggtgtcagtgtctctgggcctcaccaggccagaaatgggtaaagccattcctgctttcacttactcatgcagcagctgatattgcccacctgtgtgccaggcactgcgctacaaagatgaaaagacgtgcttcttgtcctagagaagctcctaagtcagaggagtgagtcgtgaagaccaacagataacttccacggtggtcatttcctccacagaggaaggtgaaaggacttagggaagttttccggggggctgaagtttgaggggacctttgagctaaggtcagagttgcaggtgtagaaagctttctgtctaggtaggagcaattgcttgtgtagaggtgtggggtgtcctcacagcaagtggctttcagtagcagtctggccattttactggctcctggacataagggagacggggctcaggcctgtgatactgcgaggctggggaacagcctgtgcgttggtcagtggtccccaaatatgttcttgccacagcagtcacatgggatgctctgctaagcatctgggctggacgcagtggctcatgcttgtaattccgacgctttgggaggctgatgccaatggatcatttgaccccaggagttcaagacctggctgggcaacatagtgaaacccaggctctatttaaaaaaaaacagtctgactagaggttgataaggcagatgtgttttctgctgccttggtgcctccagtttttttgttgttttgttttttgtttttttttttttgagatggagtctcgctctgtcacccaggtttgagtacagtggcgtgatcttggctcactgcaactgctgcctgccgggttcaagtgattctcctgcctcagtcccccaagtagctaggattacaggcatccgccaccacacccggctaggtttttttttttgtatttttagtagagatggggtttctccatgttggtgaggctggtacctttttggtttttttttttgagacagagtctcagtctgtcgcccaggctggagtgccctggcgagatctctggtcactgcagcctccacctctggggttcaggcattctcatgcctcagtagctgggactacaggcgtatgctaccatgcccggctaatcttcgtatttttagtagagactgggtgttgccatgtggcccaggctggtgttgaactcctggcctcaagtaatccaccctcctcagcttcctaaagtgttgggattacaggcatgagccacctcactgggccccaagtttgagctgtgtgcattgttcttttccaagagaagttaaaggctctgcggagtccttcagtgacagaactggtttgttgttttgtgcacgctggcctgggtgttgaaacatcctttgactgtcttgtggaccccttccatggagctttctttagggcatgcctgtgccagcagtgagtagcctctgcagggttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggttgaggtggtgatggtcactttattgtaatgatgcaggcatggagtcttgaattccgcctccccagcctcgcttctgcttcccacagcctcttcctgctttctttgagagccccagcaaaacttctgctcatgtctggttctctcgttcagccggaggagggcattgagaaacggagacaaggtggagagagattgtcccagtcctgtacactagtggctcaggagctttgtgaagggcaagggctggccataggaaggagtggatcggctgagaatttatgttttactttttattatggataattcaaacattagaatataaagagaatcgtataacgaatcctcttgtactcatcacccagcttaataattagcaactagaggccaatttttttttttttttttttttgagatggagtttttgctcttgttgcccaggctggagtgcagtggcacgatctcagctcactgcaacttccgcctcatgggttcaagtgattctcctgcctcagccccccaagtggttggaattacaggcacacaccaccacgcccggctaatttttagtagagatggggtttcaccatgttggccaggctggtctcgaactcctgacctcaggtgatccatagatgccaaatcttgtttcatctgtggccctggagttcttttgaaacaagtcccatacatcatataatttgatctggaactatttctccatgtatctctaaaagatgaatctctttttttttgagacggagtttgactctgtcgcccaggatggagtgcagtggcatgatctcagctcactgtaacccctgcttccccggttcaagcaattctccggcctcagcctcccgagtagctgggattacaggcatatgccatcacacctggctaatttttgtatttttagtagagacggggattcaccatgttggccaggctggtctcgaactcccgatctcaagtgatccgtccgcctcggccttccaaagtgtcggtattacaggcgtgatccactgcacccagcctttgaagagtcatttttaaaggcatagctacaataacatcacacttaaaaattaacattacggccgggcgcggtggctcatgcctgtaatcccagcattttgggaggccgaggccagtgaattgcctgaggtcaagagttcgagaccagcctggccaacatagtgaaaccccgtctctactaaaaatacaaaaagttagctggacatggtggcagttacctgtaatcccagctacttgggaggctgaggcaggagaatcgcttgaacccgggaggcggaggttgcagtaagccgagatcctgccattgcactccagccttggcgacacagcaagactctgtctcaaaaaaaaaaaaagaaaaaagaaaaaatattactgccttattgtccggtgtgggaatagtcattaagatggggaaactgaggctcaaagagaagtgacccagacagaagaccacacagcaggttttgacagaacttgaactagaatgtgggcccctgcctcccaggtttgttctgtgttgtactctacaggtccaaggatgtcgccatcagagctggggtcaggtctctctcctggcacctgccactttgtagtgaaatgtgcttagtgtatctcttgccctgccacctccccccccaattgtgctgcgaggtctttaaaagcaggagctgtgcctgaggctcctctgaaccccagggtccagatagcctggcactgggtggatgctctggaagcattttttgagcggaacagaagagctgtggccctccctgcagctctgtgcccacctcctccaggctcctgcccaggatatttactggcatatctcagatgcgtcctggctccccttaaccaacaagcttcccgatggctctattacagtcggacatgatgtcacacctggtgaagatccctggcatcatcatcgcggcctctgcggtccgtgccaaggccacccgcatctctatccagtgccgcagctgccgcaacaccctcaccaacattgccatgcgccctggcctcgagggctatgccctgcccaggaagtgcaacacgtgagtctgtggcccagagggactgtgggaggtgacctgagtgaagatcagaaaggatgagaacaagtagcaagcactgcctgcagctgcttctagagatccactgggatgggctgggcaggggtgtgcccttaggattggcacagatctgatgccctgtggctctgagacaccatgaacagggtccctctacattggtgacttctgtctcaccaggatacccagacagcgttgtagggaacccagggttgggaggga

SEQ ID NO: 506 - DNA, 1593 bp, Homo sapiens
ttaaataatggaatgatctggaattagatgtgtgtttgggaagaggaatggtgaggtcatggtggctgtggtgtgggcagattcaggggtgcaggcacacctcagccagtgttggtttcctcttctttgcacccttcctgccccaccctgctatgtgcccactccagggatgaactcaagcggcattacaacctgggggagtactggattgaggtggagatggaggatctggccagctttgatgaggacctggccgactacttgtacaagcagccagccgagcacctgcagctggtgagtgggaccccatccctgagcttcccagggctgctctgccccagttactaatagcctgtgcccttccctttctccagctggaggaagctgccaaggaggtagctgatgaggtgacccggccccggccttctggggaggaggtgctccaggacatccaggtcatgctcaagtcggacgccagcccttccagcattcgtagcctgaaggtgggtcggagggcagtggctgctgcatggtgcagagggctttggatgcagccagacctgagtgctagctgtgtggccttgagtgaggcacttgacctttctgaacctgtctcctcctggagacaaaaggatcgtttgttgttttttgctttttgttatgaaaaattacacacccaaaagcagagagtagtataatgaatcccataaagcttcacccagatttaataattaacattttgtgttgtttcctattttgtcctttttcttttttgctaaagaattttaaagtaaattcatgcacagtggctcatgcctctaatcttagcactttgggaggccgagggaggaagattgcttgataccgggagtttgagaccctggctctccaaaaaacaaaacaaaaaaaaaacaaaaaaaacaaagctaggtatgctggcatatgcctatagtccaggctacttggaaggctgaagtgggaggatcaaggggcctaggaatttgaggttacagtgagctctgattgtgcctctcagcactttagcctgggtgacagagcaagaccctgtctctaaaaataaaaaataaattacagacatgacactttatcccgaaaaaaaaaagttttcttacatagtctcattagcacctcaactgaaacatcaaagatctcttagtatcattgaatatacagtctagattcagattgaccaaattacctcacatgactcttacagctcgtgtgtctcagccaggaccaggcattgtactggattgttgtttaaatctcttttaatccaggacagcttcctttactctgggtgtaagttctttcacagatacattattgatttgctaaagaagcaggagccattatcctgtagaatgtgctgccttttagatttatctgaaggcctccttggggtggttacaacataccccttcccccccgtgatttttggaagctggaagttagatgcaaaggcctgactgtgtttcgatttcacataccgggcaagaacgcttatgggtggtattggatccctcattgcatccctccatccactatgctgagactgaccaggtgctaggt
